United States Patent 11,001,841 (CCCTC-BINDING FACTOR (CTCF) RNA INTERACTOME) - sequence listing, part 46

SEQ ID NO: 109253 - DNA, 3205 bp, Homo sapiens
agctaaagggcgggcagacgaaagcgggcggcgagtcgccagttagtcttcaccgctctggagagagttgctagccacgggatcctgacccggacacgaactcgtttctccacgtcggtgcgcgcttgcatccctggccccgaaagcgtgggaatgtccggaaatgctggcgtatgggagttccttaattagaaatgcgttagcgaatattatacgcttatactatgggcggacgggtggagagccttaaaaacaacaacaacaaactaagcagttgctcaatcgttgattgatcctcaggcacgtctagattttcccacttacataggtcttgttaagaaaccagtcctgccttcttgccactcgtgtctttcgatggctcccttcccgaagtcccgctgcctctaagcggagtgttaagcggggctctcggaagccggtggaccgagatttccccgggtggggcgggcgcggtgtagcggcccgcgggctgacttgctcccggctgtcccccggccccagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcaggtgagtgacccgccgcgactcggcgggaacgcgcgctgtgggactggcaggcaaacgcgcccagcccgaggctggctggggttgttgagcgcggagttgacatctgaaggtccggtgtcggtccggtagaggctcaggaaagccatttggcaactttgagataggattcccgtgcaattttggtgtaacggcgctggaagggatgggggcgagcaaacgggttcagttgtgaatttttgtttgtgacctgtggaatggtacaggtcacaaacaaaaattcaatatctttattgtattcccgctaaaatcgagacggtcaatcaagagagcaagtggacttttttcccagagacaatcaatatgactatgtgagcatgatgaaaagttttttgaccctaacctcacctccgtggtgttagattgccgttaaagagaagacgataatttatttgaagccactgtagcttttgtgagtccaggagttgggtgacattattaaaccctcgtggcagtgtcgctgaagttcatgagtttccaaaatgaaggttccaggtgctcagcggtacggagaattgcatctagagccttaggatttaacctcctgtttaggataggcagcaggaaatagcttgttacggttttcccagatttgctctatgatgtagtgttttgactcttaagaggtataggtgtatagaattttgtgaccggtggcatttctttcaagaatttcttttttagtaaaaccaagctgaaggtttagtcacccccgtgagtttaagataataacatatttaagtggaaaatatagactcctaagtttcataaataacatccctccatcccctactttaaagatgggcagtcattagttctccgaactaattgcactaatgtaggcttttcccccgccgtttgccttcgttttcctttcctttcactgacttagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataaggtatttgtatggaaataactattttataactttttaaataactattgtaaggtaatacgtttttacaagatgtttcagttttgtaactatcctaaaattcattcactccctatttatcctgatagtctttctgtctctctctctcacacacacacacacacgtttcatatgattttaacactgaaattatcttttgtttatctggttatctttggtacctctagttacaaagttttccattgaatggagtcggtgtgtgtttctgtttgaaagagtattttcccttggataatttttttttcttaaagccttctatggaacccttagataatttaactataaaatgagttttctaaaacgtctgcgttagaattggagcattcttattgaatgttgaagcttttaagagagaacttgatgtaagaaaactcaagtcgtatgcctgtgattagcaatgagaacttttaaatacttgcagtttttaactgcaagtaaaaaaatctaacagtttcagttaaaatcagtagtattagcatgaccttatgaacttttccgtgttttgtttttgtttttttaatgcagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggtaagggatttttactgttattggcaagttcaagtaaggaaaatggacttaaatgcattacatattttatttttggctttaagaaatttgtatgtaattacagcggaaagcattggtttcattatctctgaccgtattttattttgggggagtggtggtgcctgttaaaatacttattttttagctaaagaaatgaagtataaatagttcatagtaatcctttttggaataaaagcattgagcagttttagggtcctgagtactaaataggcattattttactataaatattcagttcatttttaaagttatattttgattgctttagaataaattagctaaacttgaaaatgtagcagttagccggttttaccatcttcattatttcagtgcattttaactctaatgttagtggcccctgagtatctgtgatatgaaagagctttgcttcagtttgactactgctgtaattaagtcctttagaaatgggggaaggacaagctaatgtttgttttctagaaatggagacaactagaggtaaaatgtctagattatttacctgttgagactttttctcttctgtttaataatgtaggaaattgattgttcaaaaatgactcgatggaacctaaaaata

SEQ ID NO: 109254 - DNA, 1023 bp, Homo sapiens
ttttcctttttttaatacaaagtgctttaattacacagaatcatctattttaatttggtttcttttgtgctttctattgtacaagttgggttggaaaatagattgccaggaaatcagattttattccattgcatattaattacatttgatttatctaaattttagaagcctttgcttcagtatgacagaacttttaaggttaagggaaagtgttaaagtagatttgcaattgatttttttaaaaatctgtttaaaagaaaatcaagggaatttagttgttatttctttgtgattctttttactttaaattaacggcacactctttaccctcccacacaaaaaaactaaagtgtatcacccggttactaccttccttcctttttctttgaatcatcattttaaaaagctgcagctttttaatctgtcaacatgttaataatttgtgtgggttttggatatggtgggaatcttgtctacgtcttctcaatcataaacgtttttaggcttgtttggaggtgggttttttcgttggctggttggtttggcttcttgatttttgtgatctttgagaaagggaccaaaacagcatggaaaagtatcaattctttgctaagttgggttattaatgagaactactggcagtttgtgtgcatgttcaattgaagtttttaatccatagaattagtttcagtatgaaatgagtgaattttgaagtaggcctatgacttaataccaacaattgttttctggttttgtttttcctcaaaacaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacaggtaagtttattaaagacttcaaagattctcttattcttgttacttttttttctataaagctaggttggatgaatc

SEQ ID NO: 109255 - DNA, 1080 bp, Homo sapiens
ttttaatatcttttgttaccaggcacagtatatttgcaatacttcaacctaaacttatttaaaaattaatgttgaggaaattaattgcagatatatttctaaacaagattggaatttatagaatgtggcattaaaggattttgtgtgtttttaaaatcaaattgaactgttttattgacttacatattctgggacttggtttggttaataatggataaaaagttatgtccctatataatactaaatttgatgatgataccaatttgcaggaaattgtacttatgtttatcttttgcttaatcttttaccgtcatcctgggataatcaaagttttacatttatccaaagattcatcaaaatacactgcattttaacccttctaaggataatttttttctctgtacagcatctctgtacgtaattcagtaataaaggaagctaatgtaatattgtcccaacgaagtaaataatttataaattgtcaaatttatattacatttgtgcttctgaagtatatgggatgctaaagccaatttgttcacatgataatctgaacctttttatgtgatctttacaattgtttaaaaaacatttcttcccaaataatacaaaggtgaatgttccaagttaacagattcagtttgactcaattaaatttatagataaggaccttaggaactcacttgttaggaataagaaacagggattggactacggtagaactaatagtgcccaattaaaactttgagggaaagtgacaatggtttctatggattgttttttttaagtcgcttatgaaaatctcagactcctaactggcaatttaaagcatttgatggtaagtaaaaatgtgatttttattaccttctctcctactgaataacatctatcttaaaaactgatttgggaggctgagaaattggaaacagcatcgtagtatcaacatccaagacctaaatcattacttggaataaaacatgtagactatttggccagtaatagtgattaacagcaaaagtaatctaaatttagtaaaaataaacatttatttttgagattaaaaagaaccaaattttttag

SEQ ID NO: 109256 - DNA, 2906 bp, Homo sapiens
tgtcaaagttttcaacttcatatgcttttgtcttcatattacaaaatctaaagtttgaaacacgaaccaggctgggtgcattagctcacgcctataatcccagcactttggaaggctgaggcaggcagatcacttgagcccaggagttggagaccagcctaggcaacatggtgaaactatgtctctatagaaaatacaaaaattagctgggcatggtgacacacccctatagtcccacctactcaggaggctgaggtgggaggactgcttaaacccaggaggcagaggttgcagtgagccaacatcgtaccactgcactccagcctgggtgacagaccttgtctctaaataaataaataatagccaagttcttttttttttttttaattattttgtaatttggagatttaattaacctaggtctgagttgttgcctagccatctgttcttttttccaatgtacttctcttaagcttgtcacataaactacttgggttctagtctcttagtctgtagaaatgagcctatgctataatatcaaaagaaatttttagttttttcagtaatgcctcagttttccaaaggtgtctgattcaatatccacaactagggtgaaggtggtggagagcagcaaggaagctacctctaaccaaccagaaatagatatcaagaagtccagctactaacaagttactctttctgttttattttagaaagatactaaccttggtggtttagttccttggcctctggtagcttacaaagatcaaattagagtaaaatgtattggaggaagataaagaacactaatttatagtatagtataataaaagatatagaaaataaaaagatgatcaagataaaaacttaaacctcagtaattttaggccatttaatttttatgcaaacactcatatttgctgtaagaatcactgaaaccctccttcatagtaattacaagtaaaaataaagagaagaataattgaggccttactaggacaacaaaactttgttatagctatgtactgtttgagttttctgtagttgatgcttgctaaaatttggattacatttgaataaggataaagggcatcatacctattcattcctcttagatttctaagctgtatttcagtaaattgattctcaaagagtggtataactggatcataatatccttgtttgccactcaagaaagtgttccataacttaagataacagtggtgggaaaaatcatttaagaccttgtttcatatgctttaagatacaagaaatagagataacactgggaacatatgaaactttgtcagcatcagataatagtgttgtagcgacttgaaacattttttgtctgtgattgtgccagtcactatttgtgacttggattgaaccttgatatgactttaaattcaggttgatgttttaaaattatttctgaaatatattgagcttattgccctaaattaaaactatattctgtaattttacatgagttatgtaagttttctgaagaaataaggaggaatcctttaggcacagactgtcaatctacagattacataggagatggcacaaatggaaaaagaaggaagaaaggaaatggtagcaagtggtagggcaggcaaaggacatcaaagaacagagcaacaagaaaagtcccaggttgtcattgtaataccacagtagtcttaatagtcaaaggacaagtaaaggcctgttaatagcctgttgattcaataatgctaatctgataatatggtaactggtttaaaaaaaagcaatacggtataataatcttaagactgctgtaatcccagcactttgggaggcccagacgggcggatcacgaggtcaggagatcgagaccatcctggctaacacggtgaaaccccgtctctactaaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagactgaatgttatacaggagttgagatgtaactattttgctttgtaaatatcctgcctttaaaaaaaaaaatgctcaactctattagaggaaatcatagctgtatctttcattttatttggagagagaggaacaaacaaccaaaaatgagcaaccattgttatttacccaaagctaagctgtttcttaatagctgtactctatctcttcagtaagtaatttgccaggagaaatacaatgtttttaaggaatatttttgtcagcgtaaactgttaaacactgaatcccaacttttagctatctgaaaaatgtatacttaaataatacattatggccatttgactcaaatgtaagttcttttgggatggtttttcattttcttaaaataagtgttcagatattctccttgaattgggtagaatattaattgtcagatattgttttttatttggatgataaacactaacccacaggatttaaactacaacttctagactaggcatggtgggtcatgcccttaatcccagcattttgggaggctgaggcaaaaggatcgcttgagcccaggagttcgagaccagcctgggcaacatagagggaccaccatgtgtacaaaaaaaatttttttttaaagattagctgggtgtggtggtgtgcatctgtagtcccggctacttgggacactgaggtgggcggatcgcttgagtctgaaaggtcaaggctgcagtgagctgagaccacaccactgtactccagcttaggtgacagaacaagaccctgtctcaaaaaaataataaatgagtgaacaaacaaact

SEQ ID NO: 109257 - DNA, 2449 bp, Homo sapiens
tgtaatccaaaggtttgggcatttttccaggcttcaatcctgtctaaaacttaaactcttgctgcaaacatttagagagaactaacagttgaaagcagaataaaatactttatataaatatctacatattttcacttatataccgattcatacataatataatgaatgttatggaaaataacttttggggtaacagttttactttgataatcattgtgcttatagactgtcagaagtatcgaaaagtgatttatgcaaataaaattatttcttaatgagtagattttcaaataagctgttttgtccactgttattgaattgtttactttttgtaattatgttgaggcttttggtgaattatgatgctctcattagtaagttttaccccacatttttaaggttcacctgtattcacttaggaaataggaatcactaagatatttgaattaagaaaacaatatactatttttaatgtgtaattctttttgttgacttttttcgtctttgctattttgttgaaaataagaggtatatcttttttcatttgcctgtacctattcttccattgtaatagtctagagtacaaacaagctactcctataacgtagcagcatttggcctgaacatactcagacacaattttctctccaccatcaaactaaatgactgcctagcagtcagccttgatggttacttattatggattttttttctctttactcttcataattaaactgcataaatgcaaatatgtaaagttaatctaagattttaattacagttcaaagttgttatattagtgattacaaactgaaagttttctgatgtcttatgtaccagtgccattagttttctctagtcaaggtggtctgtttgatttctgttattaccatgagaaataggtaatatccttttctgtcaaaggctcttgtttttagaaaactgaacatgtaagtttttgactacctttgaaacccattacttgttaaggaactcctaaaaaccatgtttgtagagaaagttggtaatactactttgggacagggttcctaacacagtttaaccatgcaagtgtttttgaaaattctttgttttagaacaggagcttcaattgtgttattaacaattgataatgtttccactataatcagattgcagattaagtgaaagctttcctaaattttacttaaagaaacaagttttatttatttatattgaacattctagttggggaaatgagtgtgtgtaagtgggtgtatattacacttttataaggatttatctaagggaatataaattcatgtttcatatctccctgtgtaaaattaaaactcttaggaataccagtgaaaataacatttttatttataccttattaaatcattgcactactaactgtacattatttagatgtttattactcttggctttattatttaactgctcccaattctcacttaagattgatttagctaaacatacacagtgagtatgaaatataacttttttttaaagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaaggtgaatcatctgtagactttcattgtaaatcagaatgtttcatttatgatctaacaaattttagtaagtcagatattcatgttataatacttaatgaagaagtgttatattgaaatttatatcttaacatttaagatgaacattctccttattaactgtttttatctaatgtttgcatattttaagttcatattgtacatatgaagtgtgtattcagtctttaaacttttaatttctgtagttaaacagggtaaagatggtggaaaaggaaaaggatgccttagaaggagagaaaaacatagctatcgaatttcttaccttggaaaatgaaatatttagaaaaaagaatcatgtttgtcaatattatatgtaagtgccttgattgatattaccaatttttatattagtttttaaccattaagtcaaagcccttctcttttcctagagaaacatgaagactgaagtgaaaaaaaatctctaaatattgttttgtgtgactgaatgtgttagctcatgcctgtaattccagcactttgggaggctaaggcaggaggatcacttgaggctgggagttcaagaccagcctgggcaacatagcaagaccccatctctacaaaaaaaggaattatgtggtgaacttatccaatgtgaggactatctggctgtgacacctgtcatcccgttgatcaccagggttgaatttattaaattaggcatattaattcattgaagttgactttttagtatcctgctttaagttgggaggtag

SEQ ID NO: 109258 - DNA, 1975 bp, Homo sapiens
actgttttttgagatgggctgtttcacccagggtggagtgcagtgtgtgatcacggctcactgcaatctcaaccttccggactcagttgatcctcccacctccacttcatgagtagctgggactacagggcacacaccaacacacctggctaattattattattattattgttgctgggatttttttgtttttattttttcttttttctttttttggtagagatggggtttcgccatgttgcccaagctggtctcaaacttctgagttcaggcagtctgcctgcctcagcctcctaaagtgctgggattacaggcgtcggccaccacattggtacaatgaaatcgatttttgttcctaaattctagccttgacccagggggattttcccctcatagcctaggcagtcatatattgactagttaataatattttagaaacagttagttttactaaaattgttatacagttttggaaatggcattttaggagcttcaatttctttttttttttttcctccctatagttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagtaataatattttgggaagtactaaaagtatttagataattgtattacatgtgtatttatatataaagttacttctagcacattgtgagtgtaagacatttgccagcatatcaagtggtggcccccttagtgaaaaaaaaaaacttgccttgcatccagttccttgttacagatgaaattccctactctgaagtcttagaaccgtggggatgctaccccctagtggcgtagcacagtaacaaacaataagcatttggcttcacagtttaatcttttagtagtccacaaatctgatagagggataggatttgggtttttctagatagatttttaagggttttatcatgtccctacttgatgccatttttcaatgacactagtatctctaattatttttaaataaaaaaatttgtatagtaagtttattgtatagtaacttgtaagtatattcgtaaaaggtaaaaccaaaattttactcctatggtaaaatttttatatacctagacattgtagtcactggaaaatgtgttattttccctccaacttagaaaggcaaaatagctgtcataatcaaaaatacaggtgcttcttcaactatggggagagggatcatcttggaataaggagagttttaggatcctgccttattaagagcctggacatatttatagaggaagtgttccaggtaggaaatgtggttttaaaatatgtgcacattcaaaataatgacttacaatatacttgctttgctaggaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggtaggtgttagaaaaaaattcttaaaatttcacgtctgaatatcatacctagttttcatggatgtgtttgccccttattgcctaagagaatgaattagtattctaaatgttgttttaaggtttgtctctgaacatgattttaccccctcaagggaaaccttgcttctactgactttattttgcaggaggttttttgtttggttttggaattttgcagagatggggtctcagtctgttgtccaggctagcgtgcagtggtatgattatagtcttgaactcctgggcttaagaaacctacctcagcctcccaaagtaacgtggactacaggtgtgagccattgctcctagcttgactttgagttttaaagtttatattacaataatatgttattgggaaaacatttac

SEQ ID NO: 109259 - DNA, 1050 bp, Homo sapiens
atggagtaaaatattagccctacatgatgactctggaagagtaaagttgtgaaagattttagggttggggagatggtaaagataatttgtggtaagttatgatataccaggaaggatagtttagaaaattccgtgtagtcagagcatatttatagctaaagaagaataattacaacctgaaatcaggagagaaggatgacagacctgaggccctgccagagacagttttccttcataagaggtcaggtgtttgtagaagtagttttactattagattgagagaatatagaaattacagtgaatagtcgggaaaatacttgttaaagctagctaatttaactctgattataaagaaaagaagaactagaggaccctgagaaatgcctttaaatatgtcaaatattgatagtattgggtaacataaagatgtatgctcctataacttgttttataatctcaggttgaagaatttaaaagtatacctgccaagagtaacaatatcattaatgaaacaacaaccagaaacaatgccctcgagaaggaaaaagagaaagaagaaaaaaaattaaaggaagttatggatagccttaaacaggaaacacaagggcttcagaaagaaaaagaagtaagttttttttttttatcagtgtttattttggtggcttttttttttttaacttaaagattattttttcaaaaatactgaaacctgaactggtaagtttggacttttaatgtccaacattcctaaaactagtcaacctagacttagatgactattcttttaattcctgctgacatgttttttaaaaagtttactaaatgagagtttgtagtagtagcagaaggtgtgatgtcaaatacagtaccttgattattatatatgccactcctaagcgtgttgaatcatcatattttgttgccacctgtaaaacctggagccacactaagcgcaggttaatgtctcttttgtttttgcttctatagctcttgtgtaatagttaaaagctgtggctcttgtttcagttcttggttcaaatcctaggtcaa

SEQ ID NO: 109260 - DNA, 4256 bp, Homo sapiens
aacgagagcatgaagttgtcacattgatatgtattatctaccccaacaagagtaagcataaaattatctttgtttgtatgtaccacagcatttttgacagtgctaagcatgttaaatacctatgttaatggataatggtaattgactgcattaaaaagtcatggtagagtctgctttggcatatcaacatgttctaatgtcaaactataaaacttaacaggttagaatacctgtgtgatgaagtgtcacttaatagagtctgctttggaatatggacatgttctaatgtcagattataaaactttacaggttagaatacctgtgtgataaagtgtcaatggataatgcagtagctttcatgatgggatacttcatagttagtggattttcactgtttgcttatttaatatatattgagtactcatgtgccctgcaccccatgttaatgacaaagctaggcctcaaatgtctttattcctcagcgtaatgatcgatctcacaaagctcttgtgaaatcagttgggaaaagactatgtacagtgaatattgacaactaggcaaaaactgaatctagtccacttgtgagaatttcttatttctatatactgtgcttatagaatctcctttcttaaatcgaatataaaatgtatggtttcatttcagtgtaggtttgaaagtaaatatctgtccagatttaatgaactcatattttaacagagtcgagagaaagaacttatgggtttcagcaaatcggtaaatgaagcacgttcaaagatggatgtagcccagtcagaacttgatatctatctcagtcgtcataatactgcagtgtctcaattaactaaggctaaggaagctctaattgcagcttctgagactctcaaagaaaggaaagctgcaatcagagatatagaaggaaaactccctcaaactgaacaagaattaaaggaggtaaatctttgcttctctgttgcatcagaacatcattcgtccacttcagctttatacatttttgtttttaatctccgcgtcagaggtgactagtgataaattttcttcattttgtataatctcaaaagaatgaggtcagcatttcagtattccatatgtgaactgagactatcaagaaactatattatccccagaagcaccatatagtaagtaaatcaccaccaccaccccactgtagaaataatttaaacaaaagaaagtttgtgtttctttaaatcttaagtatagacaatttaaagataaataaaaaacaagtgtatatgtatttatataatgaatatacaaacaactatcttaatgtgttttgggttttgaatttatggatgtagtttctttgcttgcattccaaaatgttataaactaactaagatgtatagcttatcggtgcctgtcccccatccttgagtgaattagatgtctaaggaatttcgtaaactttaatctccaaagatctccaaaacctcagtaggcaaggtggcaataaaaaaaaaatctgtttgaagtgtaattatactgaaaataaatatgagtctttttcattttagttaatgcatgctatttggtcatcagggaatttcatgaccaggtagaatttaaatgtaaattaagttagatccagtgactgcttctgtcttcctgggattcggtttcttttgggatgaattatgtcagtaacttggtttaaactttatgccagtacagtaagtaatagacataatttaaatctagtggatggaggaatataccagttagaaaagatggctgctgagaagttggagattgagaaacagaggttgtgtttatgtgtgcatgtttgtggttcctttcttgttgggagcctggcatttttgtatagcaataggactatccagtcatctttcgtttcagaggtgtgctttttctccagtaccccccagccccgttcagctaaaataaagcacagcataaccgtagtcctgcccagtcattttctgggtcagcttttcattagggcagagctgaagaattagggcacacttatgtataactatgtagtatcaaactgggatttccacagccccagctatacttctctatcaggatgaactgtttgctcctgaaaaaaatattacacctaatgttttcttttattgacccaagtaatttatgccccttttaaacccatccatattttccacaaccaaaccagcaattgccatacaggtgctcagttttggttcaaatttttattgttggtctttctttctttattgttattaaagcattacaactaattcagtgctatgactggtcatatttagaagttaatgcttctggatttcattttattttcacttttagaaagaaaaagaacttcaaaaacttacacaagaagaaacaaactttaaaagtttggttcatgatctctttcaaaaagttgaagaagcaaagagctcattagcaatgaatcgaagtagggggaaagtccttgatgcaataattcaagaaaaaaaatctggcaggattccaggaatatatggaagattggtaaagtagatttttggggggcatggctttactttttttttttaagaaagtgtaacttatttttttgccttgacaaccatatttcaagtgtcactgtatataaaataagattcattttgtttgttttaaggcacatttatttttaaacattttgcccttacagtttcttgtttacttagctttagataaatacaattatttcatacatatcaagaaaaatactagtaatgtcacacaaacttaaaaccattttatccttttttttaaaagagagactttagccaggcacaatggtgtgtgcctgtagtcccagctgttggagaggcagaggcagaaggatcacttgagcctaggagttcaagtccatcctgggcaatatagcaagactgttttttaaaaaatgaaaattaaaaaaaatttttttatatatttggggtttcacaccattttacttaggtttgggctagcatttaaggatataacaagggataatctaaaaatccaaggctagcaatagtgaggaccattactgcttcttagcttcgagggaagggagttgtggtccagaggagatggggaaaatggataccttaaccccacctatttcctgccctccagtcttagctgaaacctcaaattggctgaaggtggagagtcaaaggagccagttgatgcagtccttaagtcagcctttcggagaagggaacaaattgatgtaaaaattacccaacatgattgcttctgcatcttgtatcgggacttccaccttattttcttaaagataaacagtttgatcctattcatttgctctcaaagaaagcccaaaccagtgaatactgctagatagttgtgtaatagataaacagataaatgtgtttcatcaggatttacataattttagatgcttttcaataattcaaagttttctgagttttgcttatagttcatttaggttttaagcttcatgttgttttcataaaatgaaaacagttctttcattttgtgctcattagaaattcaagctgcatattcataaacttatacatattttgtattttgttgtgtacccttttgttctctttaaaaccatgtctacataaagtttttcaattaaaagaagtttttaaaacttgatgaatgaaatggtcctgtgcttttctgcctaactcttttttcaccccactcttcattattagggggacttaggagccattgatgaaaaatacgacgtggctatatcatcctgttgtcatgcactggactacattgttgttgattctattgatatagcccaagaatgtgtaaacttccttaaaagacaaaatattggagttgcaacctttataggtttagataaggtgggtattcgtaataacctacctataattggaattttttttttttgagacgtagtctcgctctgtcacccaggctggagtgcagtggcatgatcttggctcactgcaagctccgcctcccgggttcacaccattctcctgcctcagcctcccgagtatctggtactacaggtgcccgccaccacacccagctaatttttttgtattttcagtagagaggggtttcactgtgttagccaggatggtctggatctcctgaccttgtgatccgcccacctcggcctcccagagtgctgggattacaggcgtgagccaccacacccagccctataattgaatttttaagtgctaagtgtgttt

SEQ ID NO: 109261 - DNA, 1413 bp, Homo sapiens
attttcttggcatccttgttgaaaccacccaaccattaatgtaaaggtttatttctgggctttcagttttattacttgtgctggtataggacactgtcttgattattgcagcattgtaataagttttaaaatcaggaagtctgagtcctctaattttgttctttatcatattgactgttctgggtccctataatttgtatatatgacttttaagatccagatggtcaattactgccacaaaaaaaggcgaggaagtaactgggattttgatacaggttgtattgaatttgtagatcagtttagatagtataggcatcttaacggtattaaatctttagaaccacaaacatgagatgtcttccgtttaggtctaattttagaaccttttgtgtataattcttgtttcttttgttgaatttattcctatgggtttttttttgtttttttttttgagttttcttttttgttaactgttgtttttgtttgtttgtttgtttacttttagatggctgtatgggcgaaaaagatgaccgaaattcaaactcctgaaaatactcctcgtttatttgatttagtaaaagtaaaagatgagaaaattcgccaagctttttattttgctttacgagataccttagtagctgacaacttggatcaagccacaagagtagcatatcaaaaagatagaagatggagagtggtaactttacagggacaaatcatagaacagtcaggtaatagtgtttttgtttcttggtttgtttttttttccccccacagcattgactttatttaatcttgttggggagacatctgaagctgacttctctcccctgttttccaggtacaatgactggtggtggaagcaaagtaatgaaaggaagaatgggttcctcacttgttattgaaatctctgaagaagaggtcagcatatctaaaattgtatccagacttttttttttttttaaatagctttaccgaggtatatacttactacaaaatttggccattttaagtatggtgtactcaaattttaatagatggcgttttctataaatgactagggattttttatgtaaagccctttaaagttttagaaaacaaaatattaatcagaaactatatgctcaaagtacactttttaattagtacatttggatcatacagatattccataacttacataattatttctgttttacatttaatttattggggttttttttgtattattgctgtattacataattttttacttcaaaataattctttaaaagtatagcaaagacttgatgcaaatctcaacttcagagtattttaaacttttttcctcctcaaaaacatgttctgaaatagcttgaacaccttttcccaaagtgttgtgctttgatttttttccctcccgtattttgaaaa

SEQ ID NO: 109262 - DNA, 1022 bp, Homo sapiens
attgggattggaacaggtggtttgattttgttctggtctttaagatcagaagttttaggctgggcgcggtggctcacacctgtaatcccagcactttgggagtctgaggctgtcagatcacaaggtcaggagttcaagaccagcctggccaacatagggaaaccacgtctctactaaaaacacaaaaattagccgggcgtggtggcacgcacctgtaacagtcccagctactcaggaggctgaggcaggagaatcgcttgaacccgggaggcggaggttgcagtgagctgagaccgcgccattgcactccagcctgggcgacagaagttttagttttcttcgtaagttgacttttctgtcaatctgaaatggctcttagagaaaactttctttgtaggtaaacaaaatggaatcacagttgcaaaacgactctaaaaaagcaatgcaaatccaagaacagaaagtacaacttgaagaaagagtagttaagttacggcatagtgaacgagaaatgaggaacacactagaaaaatttactgcaagcatccaggtatgtgtgtgtgtgtgtgtgtgtgtgtgtgtgtactgaaactattgggattcaactggaatttatcagaaccattttgctatttgcttacaatttattaaatatataagggagggaggatctataggcagatataactcttgatgattttgtttcactgagtactaatagataacgccctgtcacagtgttgttccaaccacagctattcctgttttccgtttgtactccatagaaacattactttccttaacaactatatgaccctttatttttattctcttttcaaagtggaattttttttaattatgaaaaagcaatgcacgcccactgtttttttaataagtttccagaaaatacccaaatgatcaccttcattttgacgtatgttctttcaacttttctaatacctagtttgcatgtaatgtatttatatatgtggtagatatgtgtagatatataaagtgtgcat

SEQ ID NO: 109263 - DNA, 1026 bp, Homo sapiens
actcttcgttgtcacaggaaggaacgctaattcatcttatatcctccactttgttttaatgtggagaactgcgaagttatgttagcagaagaaaataaccacaatttcttcattgtgggcaagttaatattgagttaggcacatagtgtatctaaggctaaaaatcattatgaactcagtagtcaaggaagtgccctaagaaaaagttgtaaagatattttaaaagaagctgagaacatgaagccattaagaaatggtgtgtttacagccgagctagtgtgtttaactttgtgcattgttgtaacaccatttgttttgatacaggatatcgtttttttttttaaggtgctttttcccatatgcctaaaatttgttttaatgcatcacgtcaagtcatagcaactgaagaaatgtacatctaacaaatgatgttcattagcataaaaacacaaattaggttctttattttttaatttcagaatatgatgctgtggctgagaaagctggtaaagtagaagctgaggttaaacgcttacacaataccatcgtagaaatcaataatcataaactcaaggcccaacaagacaaacttgataaaataaataagcaattagatgaatgtgcttctgctattactaaagcccaagtagcaatcaagactgctgacaggtagagtatgcatgttaccctaacttgttttccctttccctgccttcacattggaaagggggttactatgtaatgttccataaaatgtttctcttactgttaatttattgaacctgtctgacacattacctaatgggacttccatgacggaaaacctataatgaacatttatcctatggccaattaaaaaggctggtaaacaggtatgccataggaaagtacaggtagactgtaactccccagttgctgtgagggcatagaaatcagttttgtttctctggtctcggggagggagtagttggtccttaatttaaatagatacaggccttaaaagaataagtaaaagaggtaaaaatg

SEQ ID NO: 109264 - DNA, 3946 bp, Homo sapiens
atattgattatctggttaaattaatccagagtgttttgctcagagataaggaggtaataagggagaagtagtgtcttgcttttttggaagtacttgttgccttgtcttgaattgggaagtatttgaaggtacaactttatgggtgtagagatttaacaatctctgacgagaaaatgacaaaagaatttgataatctaatggacagtgttgcatcagtctaaagttgaatgatacaagcagcttatataagaaaggcatttataattaaaaatatacaactcatcccataagtgtttgtataaacctacaaaaactgatttaaggatggtttagtaaatcataaacttaaaaatatatgaatagaaaaaatgtcacattaaatttcatgaaaagttctttagtaggttttcagaaacaataacaaatcaccttaccacatttttgatgcatcattttgcttctttagaaaccttcaaaaggcacaagactctgtcttgcgtacagagaaagaaataaaagatactgagaaagaggtggatgacctaacagcagagctgaaaagtcttgaggacaaagcagcagaggtcgtaaagaatacaaatgctgcagaggtatgagttgctttgtattgaagaggagatgggatgatactggaaccaatttaaagagctggatatatgacagtgcctagaatgtagtaagcactcatagacttaaagttttataactatcaatttttatttgtacaataagaatactataatttgtgaatttaaatgcttaaattattttaaaatggaaggggcatgaggagagattggtaattccttcatctctgtaatgtgaaaatgatggctctatttggaaaattctatctagcagttcttttcggtgtttaggaatccttaccagagatccagaaagaacatcgcaatctgcttcaagaattaaaagttattcaagaaaatgaacatgctcttcaaaaagatgcacttagtattaagttgaaacttgaacaaatagatggtcacattgctgaacataattctaaaataaaatattggcacaaagaggtgagattgttaccgtttagtttaattttaaacatattctttatgaaaaaggagggtttggggaggattgttttagggggttggggttcttaaattttgtttgtgagctacattgtgatttttaattctgtgatcacttctaaggtttataggggacataacaatataaattgttatatacagaaaagtctgagtaacgattagaattagacaactaccctttcaccctagggctgatctggacatttaagaaaagattacatggacacttttgagtgttacaactatttttcttgaagtcctttgaaaaataattgataaatcagtcacaactcctgttgttttcatagctgtgtaatttgtcatatttttttttaaacaatgaattgtatgtaatattatgccttctctaactctcccctaaattgaacttttagatttcaaaaatatcactgcatcctatagaagataatcctattgaagagatttcggttctaagcccagaggatcttgaagcgatcaagaatccagattctataacaaatcaaattgcacttttggaagcccggtgtcatgaaatgaaaccaaacctcggtgccatcgcagagtataaaaagaaggtatgaatgaactgtgtatgtatactagttggagttctttttagtccttagcctaaattctgatctttagttttgtataattaacaatgctgttggccgggcgtggtggctcacgcctgtaatcccagcactttgggaggccaaaggcgggtggatcacaaggtcaggagttcgagaccagctgggccaacatagtgaaacctcatctctattaaagatacaaaaaattagccaggcgttgtggcacgtgcctgtaatcccgggtactcgggaggctgaggcaggagaatcgcttgaacctgggaggtggaggttgccgtgagccgagatcgcgccattgcactccagcctgggcgtcagggcaagactacgtctcaaaacaaagtaataattaacaatgctaattatcatatcaaatttatctgaatagattttccctatcataatcttttcacaggaagaattgtatttgcaacgggtagcagaattggacaaaattacttatgaaagagacagttttagacaggcatatgaagatcttcggaaacaaaggcttaatgaatttatggcaggtttttatataataacaaataaattaaaggaaaattaccaaatgcttactttgggaggggacgccgaactcgagcttgtagacagcttggatcctttctctgaaggaatcatgttcaggtgtgtaattatgctgagtttataatcccactgttacctttttctacatattctccaaactcagtatttcttggaggtaggatgtgaaggcaagatgtacaacttgtttcatttactagtaaatactaatttgcttgcatgctatttatgcttgcagtttacaggggcagacagccagtatttacaaaatatttgtctagttcatcttttcttaaattttcaaggcatttttaacatgaggattgagaaattgtatttgataaggagaaagaatagcaagaagtataatacttagcttgctctttaaatcttaaaactttggtatgtgctcctatgtatgcatcctccaataacgtttttataaaataacagaaaagagaattcatatttgtgaaaagcaagttacagattcctaaaaaagatagtagaactcaattatggaaagcaaatcacaaagtcttaactttagctttacaggtaatttgactatgattttcttaatcatttcagtgttcgaccacctaagaaaagttggaaaaagatcttcaacctttcgggaggagagaaaacacttagttcattggctttagtatttgctcttcaccactacaagcccactcccctttacttcatggatgagattgatgcagcccttgattttaaaaatgtgtccattgttgcattttatatatatgtaagtaatcattttgggattttcattccagaaacttttaggggtatcctaaacattacacatggaattctttatttcttacaattgagctttttctttattgtctaataactccatctccatctcctctggtatcagtggagaccaaattattttttatttgaaccaaatatttccattttggaggagtaaaatataaattaaaaatgcaaattagtagcagaatcacagctagaatcctaggtcatcttcctagatcttttccactagaagtcaaaataaccaaattcctttcacactcaaatactgttttatgaattattcctgccatcattcctttacatgttatcaatgtaatgtttattgtccaaaaaatatttgaggttacatgtttgtgtgatttacctgttattacttaatgtttgacttttctttgtttctctttaggaacaaacaaaaaatgcacagttcataataatttctcttcgaaataatatgtttgagatttcggatagacttattggaatttacaagacatacaacataacaaaaagtgttgctgtaaatccaaaagaaattgcatctaagggactttgttgaactttatgctgaagattcttcaagttgattcagtgtattactgatttttttctatttgtaaaggattatgagttgtataaaatacatactccctaaactagatcatgaaactggtttctgttttatgcagttgtcatttgtaaagtctaataaaatattctctataattgcttctagattacaaaaatatgacaatcttgtaagtagcagactatggagaaaaatgagttacctggagggtcaggtaacttgccaaactaaaaagtatg

SEQ ID NO: 109265 - DNA, 3220 bp, Homo sapiens
tgtatttttagtagagatggagtttctccatgttggtcaggctggtctcaaactcccaacctcaggtgatccgcccgcctcggcctcccaaagtgctgggattatatgcgtgaaccactgcgcctggccatggcacttgggtttttaagttttgcctaaggtactttcaacagtggtataacttgatttttctctatcaaggggtaagctagtctttagaattgtggctgatgcattgagggtaggtataaaggaaagcagtaggaggtggtagggtgcaaaatggtcaggcttctgttactggaaatatcagtagtagcttgccaagaggtcaagttacttgtgtcagagatggtctctgaactatcgctacgtttctttttctgtctcagagaaatacggatcgagagactttcatgaaggaaagatgactaatggtcttctttttgttctttaccatttagtgctctagtttttcacttaaaaattaattcacagttactatagtcaactcttatctttcaaactgatttttattataagaattaattcaaaatttttctgtcttctaaatctgcaagttaaaattattgctttagagaattatactatgctgatcctggggtttaagcgttcttgtattctaatttgagaagctaaaaaatttatggtagtaacagttactgtggagaaatttgatagcttgctttagaaaccattattgagccaactgggacatgtttcctccttttgtgttaaagaatatacttttgctaagcctaacttgttgtaatagaaatagtcttgtctactcattatatgtgcttggttttgattttatcatcttaaatgttaaaatgttgcacaaaatagttgtaatcactaagtagactttaacagaacactttgaattttagtctttattatgtagtgtattagtctgttttcatgctgctgataaagacatacctgagactgggtaatttataaggaaaaagaggtttaatggactcacagttccacatggctggggagacctcacaatcatggcagaaggtgaaaggcacgtctcacatggcggcagacaagaaaagagaatgagtgaagcaaaaggggtttcctcttacaaaaccatcagatctcgtgatactacaagaacagtatgggggaactgcccccatgactaaagttatctaccgctgagtccctcccacaacatgtgggaattatgggagctacaattcaagatgagatttgggtggagacacagccaaaccatatcacatagcaacaaatttaaataacttaaatttgaagcattttactacaaattaatgataattgctttgtttgggatgattttggtccctaaggaataaactcttaattgtgatcagttattcactatatatactaggaaatgaattactcagaaaacttcattttaaaaataccttgttctcttttaaatgacaagcagtatggtaacaatttggaggttaatgcctagaatgttaaataatatgtacaggtgtctctatgtaaacttaaaatacatttttctcttgacaggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggtaaggatgaaaaggaagttgaatttttaaaaattttaaacattgttgtagttacattaatttcagtaatactgatgtcgatactctttttcaaccaacacatcataacctttttaagtgaaatcactttaatatggttttctgaagcctctctatctgtttaccaaagtttatctaacagtctgcataaggtaaagaatatactgtgtcacattttctatttgttgaaggaatttgtgtggaaaatagtttcccattgaaaatgtcaacctgaattgtttaaatgggcttattctgtacattgctaaacaaaaaatggggtagcatggataaagagcaaactaagctttattagtgctgcaactaatataaacaaatgtttatatttgttgcttcttttggttagcaatgatatgtcaaagttatatctgaaatagtcaaatctttgggaaacagaatctagtaacaatttgaaaagtaatacactatcccatttttattggctttatgatggttgacataatgttgctgtgacatttaaacattcttgtaccaatattgtcttttaccattattatatactgcagttaattggctttacagttctttatatatatagcaaaatcctgaaagaacatatacctttattttgatgtggcttgaagcttttgaatgggtgaataaggatgatag

SEQ ID NO: 109266 - DNA, 1044 bp, Homo sapiens
ccgtggctcatggctcattgcagcctggacctcccaggctcaagcaatcctccctcctcagcctcctgagtagctgggactaacaggcgtgcgccaccatacttagctaagttttttattttttgtagagatggggtttcactgtgttgccagggctggtctcgaattgctgggctcaagtgatcctcccaccttggccttccacagtgctgggattacaggtatgagccattacaccaggccaatttttattcttttttttccacttttcctcttttttttttttagttgaattattttatattccttttggtttggtaagtaaagtgtatggtgtcagctctgcccatgtaatttttttttagctctgtagattttactgaagagtatttctgttgtttcacatgaataaattatgtcgtggctgtgtacagaattctcagctcatatccctttccttctagtctttgtggacattgctacattctgttctagcattccttgttgctggtgatgttctggttatttcctgctgtgtaacaaacatctgaaagcttggctggccagatattcaagatgtctttttcactcatgtgtctggaaactccttgcccttctatttggcctgtctcttcagcaaagtagcctggacttcttacatagcagtttgtggctccgaggcagcaacctgccaaactagttaagggctatacctagaactcaccacatcacttatactgtatcctattggtcagaacagtcacatggcccacacatattctaatgggggagaatagatttcatctccatgtgcagggagtagcagcaaagtcacattataggacagctcatgtgggagataattattgtggccattccaattttggaaattccagtctcccagaggaggattctgagacctttggtttagttttccttttttcatccttcttttctgtgtggatacttgtagaattgttcttatttctttaaaattgtattatatttttaattgcttaatagttaaaagcgaaaccatgattt

SEQ ID NO: 109267 - DNA, 1256 bp, Homo sapiens
cactatttttgtatatttatatgtgacagaattatttttaaaaatcttgtttctcagactttctgcgataatgttaaaaaaatcttatatatgtttataaatggtgcagttgtagttatttcttaagtaagtcttgacttgcatgaaatgtatttcttctttatcagttaggtccacaaagatgtgagccccagtttgggtggtggcaccacttgaattttcccatacttaaagctgactcactagaagtcttgggacaagtcatcgaattctataatgtaataaatatattttcctttcagaggttgtgaaatgtaatgaacgttttacaactgttcatgtttagagttgaaaggcaggaaagcattagtgaattaaaacttaaaaactggtttacacaggagaatgggtaatgatattttcggtgctatttaatcatctattatactgtctattacctaatatgccagttagacatcagggaggctcactagtgaattggccctctggagaaagacttaataaaaagtttggaaattcagaaatgtatttgttttgacacttaaacacactagacattagtgaaataatttgtaagtagagtgatttagcctcaggtttctttctgagaagattcatttttttatattaatatttctcggttttaaaagagaagcaggaaatcttgaacttggtttttacatgagcttagtactcactagaggaaaatacattttacatggattattttacttttttgctttttaaaaacatacagtagtataaattgattcaaattcatttagcaaaaggaagactggataataggcaagacgcttgaaaattttttaaagttttttttttattgtgtaaaatatgctaaacataaaatttaccattttaatctttttaagtatgcagtttggtggtattaaatacattcaaattgttttgtaattatcaccatcaactatctccgttaactttttcatcttcccaaactgaaactgtgtacccattaaaccagcagtcctcaacctttttggcaccagggaccggtcttgtggaaggcaatttttctgtggacgggtgggggtgggtggtgcatggttttgggataaaactgttctaccgcacatcatcaggcattagttagattctcacagtgagccacaacctagatccctcgcgtgcgcagttcacagtagggttcacgctgttatgagaatctaatgctgacactggcaggaggcgga

SEQ ID NO: 109268 - DNA, 1732 bp, Homo sapiens
agcccttcggggcagaggagggcggggactcggggcggctctcagcatccgcctggagctcgtggcgctgtgtttccgtgctgtggagttgcctggtccgcttcctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgagggtgagctgagcggacgccgccgagtcggtcagtcccgcggggttggggacgggcgggtgccgaggtggaggcgcgttaggagggaggcctgggagagtggagctttgagaaggggaagggaagagtactgccattttgagcccctttgtgggaggtgctcgcaggacttaagtgaggtaggtgcagttacccattttacagatgtgaagcctcacttttgagaggtatttggtaatactgacccaggtcccacagcattgaaatggcagaacagagagatgagcaaactatactaaatcagttataatttagagctggcaaggtattttactcccatggatgcttttgtcttgcagttaattttaagcactctaaaatgaccgtgaatgttttttctgccatcaccattgttgggtaatattgtcgagagctcataagctacttgacgttgtgaaaagaggtcctttgtgacagtctgtttggtcagagttaggattttcaaggaacaagcgatacctctactgcagctccagcaactgtgttggtgtttgtggcttttctgaaaacacgatgaagcatcgtgaagataaatatcaaagacagtgaactaacaaccatttttatgacatgagacaataaattgaaaacattaaagataacattattttaattttagaataagaataaaagattctggaggagttggagaagagtgtattcagcccccaaaccacgagatcaacaaagtaggtaatctgggagattaaataaatatgaaaaacaattaagtttttacagagtgtatgatttaaactacaaagtgaaatttagaagtcttttgaaaaaacattgtgttggcggtgtataaaactccaaccattttatcgaaggagcggagcataaagtgaaaaataaacaactcccttctctgatctgtaccttaaaagtagtcacttaactcttttgtacatccttctagaaattttacaagaatgtgtacatctcaaaacacatgcaaagttgttattttatacatacagatctgcagaactacacaaaactgcaaattaagttacctggatactttttcactatgcattcatgtattggtctttttaaatgagtaagtagctatttaatctggcaaggtgaaattttgattttaggtgatgttagttttgacattgcctttcactaaacacgttgatgaatatttcccaccagatatatttttactttgaaaagtacagcaaaagcaattaaagccttaatttctcaagtcaattccggttaaattgaattaatagtctttttttgttttgtttctagtttttatttttattttttagtttagggaaacaggttgatatcaaa

SEQ ID NO: 109269 - DNA, 1141 bp, Homo sapiens
tggatttccatgtttgttagaagatgctgagtgcagcctcagggtaggtacagggtgatgtgggagggtgaggaagtctagagacaagagctcacaggcttctgtgggtaataacagcaagtcgttttggtgtgattggaacatgaggaagggggcgtgagcagaaggcaagggggtgaggaggctagagagggaggtggggtctgatctaaaaggtctagctggtggagagccaaagtgggagtctgggacctggtaatgtctgtgctttagagagaacactttggctgcaaaagggtgaaaaaaatcagagaagagcttactagcaggctttgagccaaggtaatcaaccttttagactctgaggcagaaggcagaactggtagcttcctccagtggcctcaagttgttatcccagtgtgctgtactaaagttgtcattttctgtgtgctgtgatgagaaacagatgacaaagcactgccatagaggggagcaaaaccctaggtgaggagactggtttgataggaattccaactggaaatcatattgacctgaaccaagaagtcaagacctgattctggactttgtaacttactggttgtaagtagtgaaaggtaaatagaagtaagtaagagacccctagtctgggacaactagaagggtgatggtaccattcactgaaatagggaacataggtgaagagtttgtggggaaagactatgagttaggacatgctaatgataggtacctggaagacatccaagaagcgatgtccagtaagcatgtaaatatgtggctctgaaggggaggaggaggtctgggttacagttatgaatctgggaatctcagcatatctagtaattgaagccatatggtcagtgagtaatggtggccaagagaaatgtgtggagtaaaaggaaaatggggctcaggagaggaacatcaacatgtaggctagggcccagggaaggagttccaaaagagaagatgggccaggtaggaaggagaaaggtcaaaggaggtggtgtcctgaaagccaaaattaagagcctttctagaagatagaagtggctaagtcctttctagaagacgggaggttaagggtataacactgtggatgctggctgtgtgtggctgtaaa

SEQ ID NO: 109270 - DNA, 1845 bp, Homo sapiens
tactctaatattacccaagattttctccagcctgtttttactcttactttgaaacagctgtttaaaatgactcgtaatctgcttaaatctacatgctttttgtggttctcaatccagttacctaccttccagataattccctcactgtcctgtcctctccattcctctgatgtttaagccctgtgagccacctttcccccatcctttgtgcatagttaccattttactctttcttgttgcccaggcaggaatgcagtggtgccatcttggctcactgcaacctccacctcctaggttcaagcgattctcctgcctcagcctcctgagtagctgggaccacaagcgtgcaccaccacgcccggctaatttttgtatttttagtagagatggggtttcaccacgttggccaggctggtctcgaactcctgacctcagatgatccaccctccttggcctcccaaagtgctgggattgcaggcgtgagccaccgcctggccaccattttactctttttaggtacagtaatctaatatccaaagtcttggactcagctaaagagggtatttaccttaaaaaaaaaaaaaaaaagactccatcttttgattcataattgtggtgggggcggggaatcaagacaaccttagtcactttggtattaccataattcttgtcttttcagggttgtcctgttcagctgcataaaacatcatgtattctaggtatttcctaccttcacttacatttttacttgccgatgtgctgccttcataaatgggtatattccgccacacatctagtaagcccccaatgcagtacacaatgtgtatcactgataaaactcgcacttctgccatgtcagtattatattcagttgagtggtctttagcatagtggcagtcctagtcatcctaaccttttagttaaggtaaaattacatatgtttatagaactcatatagacaagctagtttttaaaatcttccttttaaccagtttaggatgatctaggatagctaagttacctacatggtgactgttcggtctaattcagaaacagaagtactaaaagaatactaaaaagtttttacccattatctctatccctgttttctttttgcaattctcagctgcagggagcaagaaaatacacagcagataggaaatgtttgtttgcatcctggctttctcaaccgcactttacgtccttgaatattctagatatttactccttcaagaagtcaggagtatatccaggcctacctatcatccttgccatccccattaaccctcatttttcagtatgtgttttacatttatggttatttttcagtctatagtatctgttcactcattgctctatcacatctgagtttctccgtctttctttccactagattgtaagctccttaagggcaaggtcggcatataagcaaagttctgtaaacaccgtgaaggtaccatgagttctatgggtactcaataaatgcttgtgataatgatgcaatttctcagatgaactgattgtagtgactacctctaaaagccttcaatctacagtttttaaatttgtctcattgcatctgagttttagaaagccttcgatagaaagggaagatacttcatagcttgccagatgaatgcccatttccttatttccttttcctcacttttgatattttgcccagtgtctggtctggatatctgacatccataagggtattgaaatggatccttgtgtggttttcagataccagttatatatattatgaagcagaggtaacctaatattgtctaacactattgatacagtttatattttggaaatactgtatggatgatttattga

SEQ ID NO: 109271 - DNA, 2614 bp, Homo sapiens
tgggaggatcacttgagcccaagaggttgaggctgcaatgagctatgtttgtgctactcatctccagcctgggtgacagagtgagaccccatctcaaaaaagaaagaaagaaaaaaaaaaccttctataaactgtttcaattttctaaaggatggtaagacagtgttggcattcatcatctctccagacctttttttaagggtaatgggattagtactataatactgtttatatatattttaaaactaattatcacattctttttcttttttttcacctagattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagcagacattggtttactctgcagcctgtgttttctgtttccccctttcccacctccttccccccacccaatccttttttttttcttttttgcttttcttttctttttttttagtttttatttactttacctagtatgcctttttttagttgcttctcaagtcagaaaacttttcaggaaggtttccctgtgcatttgcaccagatgaatgtttgatgctatgaaaagctttccatatcatcaaaactaatttgtgtagatttttgcatgaaaaaaatcataaatttccctcaaaatagactgtgttgcagtacacaagttgccataatagtataaaacagtaaaatgtgcttaaaaggccatccttttcattttcagagataacataaagatctttgcatgaggtaaatctacagcatagttcatttttagattttgttgagtcctgtaaagaagaagaagaaaaaagtttcagttgtggtagaataccgtgctgtgtttaaatgttacttgttttcaaactttgttttctatgaaaatgatatggaaacttctaaaatggaatttggtgcatatgtactgctgaataaagaccgatgaagaggtttgagtagatgtacaaatcaagtaatggtttgaacacctttaataatatgcctaatctgttcaattgttttagaatctttttatcttagatgtaggcagccatgaacaatctattttgagccactttagggagaaaactttgtatttttaaaacttgcataaaagttatgcaagtggtttttataaattggaataatacctcagttttgaggttatgcacactaaattaaatgtgacataaattaatttgtacaaaaagaactctttataaggtggctcattgtaggaaatcctgtgccttcccctttgagcacaagtgttgcatgaacaacagtttgctataagaaacataccagattagccaccattagcatctatatctactttgtgtttaaaaatcaactggtaattctgaaacactgtagaatggataaaaattattttgtgatcataactctttgttgaactagagtatttttgcagcattccttgtcatcagaaacatggttaaagtttaaaactagaagcagcagaaaactagcttgtaaaatttatccaagtagagtgcaggctaggctgtcttggggaaataaacattaaaacttaaagcaatgttttacatggggtgtgtgtgtgtggtgtgtggatttttttttttttataaagttagagtataattcaatggcttacattagcttcctgtctttttacctagaaccagcataataagaaatttctttggttctgtcatttcagtatggacatattaatattttagcccactgagtttgtccagttgacaccatcagtgcttcagttttctctctatccaaagcaaggttttaactttccttcattctccagtaaaacagaccgagacaacttgaactatattttgagtattgctatatcttca

SEQ ID NO: 109272 - DNA, 1028 bp, Homo sapiens
tacctcactggaggtaagacccaggaatccccagtggattgtgccataggagtggcaggccattggtgattcatctaggggatggggtgcattcaggtggaacatggatatctggggaatgaagcctttggagaaaggaggcaggaagagaccagttaagaaagtatttatggccgggcacagtggctcacacctgtaatcccagcactttgggaggcccgaggcgggcagatcacctgaggccagaagttcaagaccagcctggtcagcatgatgaaaccccgtctctactaaaaatatgaaacattagctgggtgtggtagcgcacacctgtaatcctagctgcttgggaggctgaggcacgagaatcatttgaacccaggaggcagaggctgcagtgagccaagatcacgccactgcactccagcctgggcaacagagtgagactctgtctcaaaaaaaataaaataaaataaagtatatagtggccaagccacaataaatgaaggcagtaataatagagacaaaggggagatgaggagatttaaagtccagtggatggactttcaagtttttgaggtttgattgtgggatattgagggaaaggggaacttgggctttctcttaaatttcaagctattgttgattatcaccaaataagaatacaactgtaggatgaaccgtttaaatgaggaaggcaaataacaaattgtgttttggacagtttgagttttaggtagctatgaaatttcctggtagaattacacaagcattttagttttatgcatgtgaagctcagaaaagaaatgaagctatagatttgcaagtcctcagcctatgtgtagtagccagattttttaatgggaagatcaccagaatgagtgtgtaggtgagaagtgagcctaagataactttctccatttaagaaatggatagaggaagtacactcatgaaggggcaatttcacttttttcaaagactttaaaattatttttcctctaaagtaaaacaggatccaatttgtgtat

SEQ ID NO: 109273 - DNA, 1055 bp, Homo sapiens
tgggcaacatagtgagacccccgtctctatatattaaataaataaataaatcctgcgcaacatagtgagaccccatctctctatatttaattaattaattaattaaattaaaaatagcatacagcctccattaacagcctccttaactgatttcataatttcttactcttaaagggaaaaatctttgaaggaagtatttcttatggcaaagaaatgtttaatatgaagttgagtgattcctttattttaactttacgttgtttttttctaagttcgggaaaaaggaaactaaatttaaaagaaaaggaggttagattaataatgtgggcacacttaacatgagagagatgaggtcatatttctatactcgaaatttcaaaatcagaattattccagtgagataacatggcacacaaagtttacctatattgcattattttatgttgtttttattcttcaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggaggtaagtttattataagctcttattccacatcttaatgttctctttgtaactacctttatttgccgactaatatagcacatctatatttttctgtcttagatattcaagtaacagaataaagtaaatattgtattctatatgtgcagtcctgctcagcctcttgcatatgcttaggtaactgaattgctgccatatattgaacaggcactgtgataagttactgggaagacagtggtaaacaagacacagtccttgccctcaaggcatgtagtctagtcttgataaatatgaactgatttaatgtgctaattaccctaatagaaatgtacaacaaaatgggatgcctaatccattctggaagaagcaggaagtgcacctgagctggattttgagagatgaataaggattaataaggtaaaaagggatgaaagg

SEQ ID NO: 109274 - DNA, 1061 bp, Homo sapiens
gcgtgatctcagctcactacaacctccacttcctaggttcaaggaacattctcccacctcagcctcttgagtggttgggatcacaggcacacaccatcatgtgtagctaatttttttctatttttgatacagtcagggttttgccatgttggccaggctgctcttgaactcctggcctcaaatgatccttccaccccagcctcccaaagtgctgagattacaggtgtgaaccaccatgcctggccggattactgatttttaatgtagaccagggaagttcattatagcaacatgcatggcatctgaaacaagtattgacagacacttattttttcctactcctcttctttttgttcttcctctttcacttccctacttctttttttttcttccttgccaaccatccttatttactcacctggcaagtttagttaactcttatcttcattggtgctgaaataagggtactctactgaaatgtgctgtttagggactttctaaattgttgcttttcacttatttaaatttattttttattgtttaaattctttcacataatatttatcccaaagaatttgcatttagaaagagccaaaaacagagtgtgagaagttctcagagatataagcagtagctgttaagctacagttgtaatgggggagacgcagcaagctccctctacctttctgaggtaaatagtatattttaatctgctaatggcttagaatctgtaaagtacaataatcgcataagagaaaccgttagtctgtagcctaagtcattatgcctgaacatcaaaataaactgtgtggagctgtttttaatttctcctgctcaacccctggagatttctgtttcagaaaatatttcttagaaacttgagctttaaaatgctcttcaggtgatactgatacatagtcagattagagaccctgtaccttaaaattaaagcactttaaagaaggaacacttagctaaatacagaaagaattaatataattggctggacatggtggctcacgcctgaaatcccagcactttgggaggccgaggtgggcaga

SEQ ID NO: 109275 - DNA, 1027 bp, Homo sapiens
agggggctgggcgcggtggcttaacgcctgtaatcccagcagtttgggacgccgaggccaggggatcacttgaggtcaggagtttgagaccagcctggccagcatggtgaaacccccgtctctactaaaaatataaaagttggctgggtgtagtgtcacatgcctgtaatcccagctacttgggaggctgaggtgggagaattgctcgaacctgggaagcagaggttgtagtgagccaaggtggcaccactgcactccagcctgagtgacagactgagaccctgtctcaaaaaaaataagtagtgatagcaccaaacgtagggctatgctgtataaatcctcttgaaattcaaagatggtgttatgtaaaacatagaacttgaaatggactttgaatagagtttgaatacatagaagaccgggcatttcaagtgaggggtttaggataggttcagtcttatttcagttgaaatgctgtgacagacaactaacctattgtttagttacacagaataagattagttataagatggagccaacttgtgaagtagtttaaagctaggtcaaggagtttacattgataaaggtagtaaataagcagccatcacatagtttatatagggaaatgatttggttaagctttcataaacattgcttttatatagtaatacagggtgttccagtgggtaaagatatgattaggccacactgaggacttatcagctaaacctgtagtctcccacatgtgaaaatagacactaggttttgtttttatcttataagctccatgagagcagtgatgtgtctgtcttttttacctcagattctctagcatctctctggctgttttcctatcagttgctgtgcttattccatttctctttagttgctgagatgaaaatgttgttgaacttttatggccttaaatttggtgtgtaaagtagaaggaagaattagggactaatatcagctataacatatttcagcagactacctgcttttgtcatttgactctcttgtgacctag

SEQ ID NO: 109276 - DNA, 1562 bp, Homo sapiens
caaagtaaaccaaaacaaggtaaaaaacaggatagatagacgtgtcagaatcatggtaaatctaacagtgttttctatgagataaggaaattgtgggtgagcaggagggctcctttggctttttttcgctttttttttttaaatagttgaatttactaatcttgtacgtgtgttattttttgtaatatcatcggttcatatgaggggtgagattatgggctcttttattctttgtacctctgtatttttataaaccttatattatagtttttaaaattgtgatatagccaatattgtattaataatttcaaagagatttttcatgttttgcaatatgaatgggaaatgaagattgaaaatcatctacatagtatgatttttattatgagtaagatttgactttatatccatatggctaaaagaaaagattagaggtgtatattgaaatgttaatagtggttttctctggataatggaatttgaggtgattttaaaaatattttcctttaatttttttgtagactatgagaagacaacgaaatgaagttgtagttgaattaaggaaggtgagtctgattaatattgggtacttctaagcataattctaacaacattatagcattatatacaagatgccaaatatatattatgtttttaggtaaaatgtataacctattgtataactaaattttatttactaaatttagttaaactttttaaaatctcaactgctaagcatttttctttagaaaaaggagagattttgactaaatttgacaggcttttgaagttgaaaggatacaactagttacttgttcattatgcaaaaacagatataaagaacttaaagtataagtcattgagatacagttgtattaaatagttctgctattaatgggcagtagtaagtccctgaaaagaacttgttgcaaacttcttcaacttttaagtattatagttgagaatatatttataaatttgctccaagcattttaagtgaagttgaaatggcccttgatttttgtaagacattgttggtttttgtctaactttgaactgcccaacttctgctttgactttgcttttaggtggtaaagaggagctcccagatcatgtataaaatggtttagtacttttaaataaatatttgtgtttggttctggcttaaactgtacactatattttttagtcaaacttttgtttttgttttgttttgtttgtttttacatagttcacggttcattaaaaatgtaatatttgggaactgggactcaaattagtgttgcgtgagtggttaattcacagtttggtttaattttttacatttgaattttacttttaaaaggcacttcatatttcagtttttaggcacaggattgcctgagctttgtatgaaagtattcaggttttctttttaactcaaattctctgtttggtttttttttttttttttttttttttaagaataaaagagatgaacatctcttaaagagaaggaatgtaccacatgaagatatctgtgaagactctgatatagatggtgattatagagtggtaagtca

SEQ ID NO: 109277 - DNA, 1054 bp, Homo sapiens
ttgtgttggtaatactacttttgctttagtgtgaaccattggctctccaattcacttgaactctgacttcgagaagtgtggaaaacaatatggcttagtggttaagtggctttgtgtgagactgtctgggttgtaatcctagccacctttggacaaacaatctaacttctctaagcctcagttttcttatttttaaaaagaaataaagggttgttttattcttacctcataaggctataatgattatatgagatagatgttaacacttaccgtagtatttagctaattatttttactcattttgcagcctattttgttattttaacattgactcctggtgttttaaaaaatctatatctgtaccaaataaagttgcatagtatattagaaagtgataaatggtatagagataaataaggcagggaagagagagagagagagaaagtacccaaatagagagttggcagatggtcaggaagggaaaagccttcccatagaggtaaggaactgagcactgcaggtagtaggggaagagcattccaaactgaggaaatagcagcagcagtaatactaagctaacacatacactgctgtgtaccagggacagtttaagtactttacatattttagctgatttaatccttaacagcagtcctgtaaagagggtgtttttactatcccaattttatagataaggaaactgaagtgcagagagctagtaagtagtatggctaaaaaaattgaacccaggcagtttgactttggagtccatcttctgagaagttactgtatagtgtattagttaaggccttgctacaagagactttacagtgtgttcgagaaatagcagagttggtgtgagtatagcagaatgaatgaagataatggtaggagctaaggtccaagcagtggtatttagggaaggaatgaggtgggaagatttgactggacgtaagccactgtaaagactgggcttttaagtccgaagtggagcgtgtgagagtctttggatatttttgaacaggaggatgatatgatctgactttttacaaaa

SEQ ID NO: 109278 - DNA, 2849 bp, Homo sapiens
atcacttcttaaagagataagaacttgattctgcttgagaagacttttgcccatcactagtagaacttcaggcctttaatactagtgttaataagtgctacctgtgagaaataaatctacagattgaaaatttgaactaaacttacttcttaaatgaacttttctaaatgaaggattgtaatatgggtttttatccttaggagatattaattattgacccacttgagtaagcatttaacagtgttaggcatttaaactttcccttttattgtcataatgtaatttatttgctaattacatgcagtttgccaacataaatactatttgacaaaggcatgaataagcaccatgatggttgctgctgcagagagagagaaataagaaataggaaaacatacttttctagttatgctgttttagcttttggttcaccatgtaatcgggttgaacaactgttttacctaccaaatgtgtttgggttgtgatgataatttgggttgaaatcaccagtaactcacttttctctagaaagtatagcttagctttatgttatgtgattgatttgtctccttgcctacctgttcatttctggcttctgatattcttcagcagattccacacatgccatctttcatagttctctctttttgtacatgctatattttctacctggaatgcctttctctaaatggattgccgttcagtcttaaaaattaagcttacatgttatctttagtaattaccctctttactgtcagagtgcgttgtgtgcatgttattaatacgtgtattaaataagtacagtcaagtaacatgtttagaatggtgtttggcacttgctgtttgctaagtttgggccttattactattttactaagttatatttctgtatcagaagagtgctacctccttaagggcatagatatgcagtgtctggtccatctttgtatttctaatgcttggcaattaggtgattaataaatgtttgaatgaatgctttccaggagtctctaaattagtaatactgttaactcatgttggggagggaaggcgtgtgtgtgtgtgtgtgtgtgtgtgtgtgtgtgcgcgtatataacttttaaaaaccgctttattacctctcataaaattcaccaattttaagtgtagaattcaatgatatttagtaaattttcatagttatgcaaccattatcacaattcagttttagaatatatcctagtcaccacacagaagatctctcgtgcctgtacaaattttttaattcttattttcttttttttttggtagtgctgttacctaagtattaaccttcccaaggtatcaatgaaagtcaggctgggtgaaataaaatgaagacattgtatttcttatctttgtattatttagaaagaattttctttaacatttttctctagtgagattgagtcctaactaaatcctaactttgctcaagaaaatttaaaatatccaaaattgtacagtaattactatgtcatattttaaactaacaatttttagggctttaaagaaaaaccatgtgttggtaaaactgacttgaaaattagcaggaatcaagtagccactaatcagaaattaaggagcaattaagtggaaagaaaatactagaatctacacctcattaaagcagggtaagtgtttagtccctagtgcttaatacagtgatggatgcatagtaaatgttcattaaatacacaaactgcattccttttaaatagagctagcattctgttttgacttgcttaaaattttttgtcaatttcttatccccttttgcctgaatttataattttataactgtttgacaagcaaagaaatataaaatacctgagtgatctgcctaaactctacccacctcctttgaggaaatagcagcaacagtcctcaacctcccccacttacagtcgctgtcctttatatagctctctggcctatacataagcctttggccagtttgtcagctttctggaattctaattgacaccactgcttactgcatcagtgtaagtcatgtgaattcacaactaatatattttcatgtagtatacaaagcctgctctttaaggacaggcttagaagtcttatatatccctttcatggggtcccgaagaacaactattgtttggagtaaaaaacatgcccaaatgctgccaggctgtggtgcatagggtgtctttctaccagttcattcattctctaccttggagaggaaaagaaaacccttgctctataatgaagggattgtcaaatctcttattttgcaaagtttctgtgaaagtggtaatagcctggtcttatgttgttactacagtgctaagttggtttgataaatgctttattagtagtttcaaattatcaaaaaacctccagactttgttgtaacaaatgagtatcaagtaaaaagaaaatctttcgggtcaggcgcggtggctcacgcttgtaatcccagcactttgggaggccgaggcgggtggatcatgaggtcaggagttcgagaccagcctggctaacacggtgaaaccccatctctactaaaaacacaaaaacttagccgggcgtggtggcatgagcctgtagtcccagctactcaggaggctgaggcaggagaattgcttgaacccaggaggcggaggttgcagtgagccgagatcccgttactgtactccagcctgggcgacaaagtgagactccgtctcaccaaaaaaaaaaaaaaaagaaaagaaaaagaaaatttttcgtaaatctctggatttaataaatgagatgtaatataatgggagaaaattttttggagtaaacaaaacatttatgtaaatatgcagtatgta

SEQ ID NO: 109279 - DNA, 1051 bp, Homo sapiens
actcccactaccagtcttctgtggtgtgaggagtataggggtatcacatgagaagtgtaacatcatttgactgcttcttcaggagcacccccggaaagagcagtttcttttagacaaggtggtaaatatgacattatgttagttaatgtccacctccgttcttactttcctgttaactttctactcactgtcataatctggggcaaagcattattgtctcatctccagagtggttaccttgtttctgctattgcctttctccagttcataaaataacctgcatgttttttaaaaaataataataataataaagtaaatcaattctcacctctcctgcttcattagcttctgaccacatttagcttccatactccttactgagaacttcaaggccataccaaatttggtccttgtctacttctccgtctcactctactatctgccttagttacttatactcttattcatttatcttcttttaattccactaacacattagtggtgttctcctcttcaccccttcacacatgctgctctgtctgtgagaatgctttctctgcgcctccagtccccgtctctttccttcatttacatggttatttctcatcctttgaatctcgcttcaaagtcatttactcacagaggccattcctgaaaaagttaattgcaagttaaacccccctgttttccttaagagcactgatgatatatttgtgtgtttactcaatgttagtttctcccgtcagactataagctccctgaaacttacctattttgtacaccactatattcttaagtctcattacagagcctggtatgtagtcagcatttaagtaaatatttgagggaattaaatgaaattttttttttaagaaaacaggagggtactctgattagaattagtaactaaattagaatttttatttttaaggttatcttgtgtattatataaatttatggaatacaagtgcagttttgttacatgtatagattgcgtagtgatgaagtcagaatttttaagtcaattttttctcttgatagaagtaatgca

SEQ ID NO: 109280 - DNA, 1268 bp, Homo sapiens
ttactcccttattttcagtggctgttttttctctctgcttgtataacttgttacattgaacaagtaatagggaaaggttttaatacagagacatgtagctgctcattgaagggcagtttaggcacaccaaattagtgatccttttaaagttgtaatttctgagtgttagagttgaaagttattcatagatttcaatctgatatttgttcctacctctctctaccattctgactcctctaaaatgtggtcatgttaagtttcttgaaacacaaacgcaccaaagaaggcatatgttcagtatccatttaaaataattatcaggaactatcagatgatattcaccatggcgtggctgcttcttacagtgttgtagaagatccccagtcttagtttgagaatagtaaccatagaaaagagggtatatacagtgcaacacaggaaatgggtagtgaccaaacttgaaataaaaaacttgtcaggataaagtaaattaagctcatataatttatgttttttaaagtagaggggaattttcttgtagatttcctaataaacctgcatactttttatgaaagttctgagtgtctaggttcaaatagagcataaaatataactagatcttttaaaaacacaactttaagaaaacaacttaccctaaatataaaagaatattaaaatgctacataattagaaacttgtgattatccacacaaacataaaatatgaagtcagcttgaactttaaaaaaaggtgcttggttggcaagagtttaataaattgatcagctgttttgttgttttgaaagagcctcagtgatttgttaaagtgtacagagtgaaaagcattgttaaggtattaagtcttgttaacttttagagactgatctctctcaccacaaatcttggaacatatttactatacttaaaataactactgtctaatttttcacataatagtccaagcatgtgacaatatgaaatatctgatagaaatatagttaggaattaaatgactgtttctgtacttcttgccaactttcctggtttacaaggtagccagtttgagaattgcttcattgatagttttcctggagataccaagatgcccttatttttcgtagtcactaagtatgtcaaatgaatgtacaagattgggaagaattgtaggagtgatttagatttcaaagaatgaagctactttagaaaaaaaaatgcaaaggtagtttttaaacattgatttctaatacctgatagtggttgtgggtcctt

SEQ ID NO: 109281 - DNA, 3027 bp, Homo sapiens
ctgcccccgccgcacccctccgggcccggagccggctcctcccagcgtcgttcgcttcccctttccgttcgctctttccgccccggctctccatcgccccttctgattggtcgaacgcaccggagcctggttagccaatgggcgagccgggctggaggcgatgggcgtggccgcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggaggtaaactcggggacgacgccggaggggtgggggctgtgggcctggggccggtctccgccgggaccccgagtgtggggattaggggcgggagccgcctccaggcctcggggaatggcgctaggggccggcccgtctgtgacgcctctgctagcgcgccgggaagtttatgtcgggcctgctccgcctccgccggggagcgaggtgcccgggtacggccggcgcggcctaggcctgcccggcggagccggcccggcgcgggtgcgaggggccgggccgcgcggcggggaggccgggcgcggcgcgtgcggaggaggcgtgcgtgtgcggccggtgctgccccggccgggccgcggccccttccccggcagtggcggagattccggctctcgctcgggcaccgacgtctggcgccgcgggaaggagggcggtgggaatgggagggtgagcgtgtggcgaccgagtggggctctgaacttcctcagcgaggcccgaggcgtctccacttaaaggcattttttctggtcttcccgactcccgctttacccctgcctccccccaatatccaaactacaggacaacttctccgttgaaaaaaacacccccggcgtgagaggccatcctggtgatcctaacagtgccttccagcggcctgtgttttactctggatatagctgattcaagatgtggctcacggtgtgccctcttccaggcaaaggataccccttatttcagcttgtccacaaatctctttaccccctcctgagaggagaccaccagctgcattcttacatataaagtctaaagggttatacaaagctgtcatcctctagtctacagtatcctttccctccacctgctggtggtggtagtgggggatggggtgggctagggaatggcaccatcacgtttgattatttaaaaaggaaaaaaaaagcttcattgtcttagatacagctgctcccgagattgtctacataaggtgtatgggttaaatacacacatgcacacacgcatacccacacaccccactgagatttttgatagaagacttcttcccttcagcttttaagagtttagataaatagatttaatacttcccttctgcatcttaatcacgagtttagcttttagggaaagtggtcaagcagtattttttatgttgttctcggtacgttttcataatgaaatcttcaacttcccatggcatttctgaacttgagagtctgcttgactgagatattttttgggctttttacaaagctgttaatattatctttaaagtagttcaagcgttttagtgggtttcataatttgagggacgactaagtgtccagggatgttaattctgtggttcttttaaggttaacatattaccattgtgatccctttttttaatgcaaagatgtcacatctttattgagataatttgcatgccataaaaatgagcttcttaaataacaatgatttttcagtaaatttacttgtttatgaaagaatgtggtgaaaatgttttttactaatatgaatacttagaatgagaaaaaatcacaaatgataaaacttaaaaactggtaagtaccacaaaattacagaatccagaaaaatagcaattaggtgcttgacagatccctataacccttttttcctctacatttctggcttcatttttctggcagcttcattgagatgtaattcgcatgccatacaattcacccacttaaagtggcttttagtgtattcgcagttttgcaaccatcaccacagtccatcttagaacattttcacggccccaaaaagaaacctgtactcattaacagtcactctccaattcccaactaccccagccccaggcaaccagtttttgtcttcttagatttgcctatcctggacatcccatataaatggaattgtacaatttgtgctcttttttaactggcttctttcacatagtgtaatgttttcaaggtttatccgtgttgtaacaagaatgtatcaatgtttcatggccgaatgatccttatggccgaatgatccaatgatcctccagctcatggatataccacattttatttatcccttcttcagttaatgaacattttcattgtttccacttttttagctattttacataatactactaagaacatttttgtgtggatgtatgttttatttctcttggctatatacctaggaatagaattgctagatcatatggaaacttactttgaacctttggtggaattgccagactttctgaagttatccttattttttaaattgatgtttcctcctacctcatatcttttggcactttagtcaaaatcagattaagtcctgaggctgtattagaagaatattgtgatgtgtgacttttaaaaaataagtatatattgacattagccaggtttttttgttttgttttgtttagaaattcatagtgccttatggttgtcctctgatgactttgatatccttgtgca

SEQ ID NO: 109282 - DNA, 1110 bp, Homo sapiens
gcgatcctctcccccaccctcgggcactgctccgcctccctcccggcgggctgtccccgcagtgctcccggacccggcgagccttcggggcgcgcgtcgctggtggtggttgaggctctagcgataataaatgatagaggatacaatgactttgctgtctctgctgggtcgcatcatgcgctacttcttgctgagacccgagacgcttttcctgctgtgcatcagcttggctctatggagttacttcttccacaccgacgaggtgaagaccatcgtgaagtccagccgggacgccgtgaagatggtgaagggcaaggtagccgagatcatgcagaacgatcgactcggggggcttgatgtgctcgaggccgagttttccaagacctgggagttcaagaaccacaacgtggcggtgtactccatccagggccggagagaccacatggaggaccgcttcgaagttctcacggatctggccaacaagacgcacccgtccatcttcgggatcttcgacgggcacgggggagaggtaggagctaccccggggctttgtatttgtgtccgtgtatgtctcgtgtgtgtgtgtgtgtgtgtgtgtgtgtgtgtgtgtgtataaacaacaggacagcgtgtgcgcagcgggagaggatctgggtgcgaggggcgtggtgatgacaccacggtgcctggctggacaaatgcggctcaagttgccaaaagcactgctggatccagacttcttggtgctgagggtccactttagggaaaggagagtcatccacagcatatttgttgctacttaatgtgaggttcccaaggccggaacccagaaaacactgtgctagtttagcaaggagaattaatggtatctccagtgaactttggtcccagaccccagtgcccttgttctagggtttgagctgaactaggcacagagaaggaagacaatatcttatgcttcattaggcaaacaggctatatctgcagagcgagctcattgagggtgaaggaagctgtgactccttcccatcgccttcactctagggaggaatccgaggggcagctctgcgcttctttccaactctatcaactttacaagtgcaatcgggc

SEQ ID NO: 109283 - DNA, 1586 bp, Homo sapiens
ttgattttagtatagatgatgttagctcctgtcacagaagaggaagctttttctgaactttctattatttatgtatattctagctctagaatggtgcagacgataaatgaggagtttaattttatttctaataactcacactagtaagatagaccatcaaaaactagggcccgtctgtaattgtagtactctttagatgcagaggagacattaccttgtatatccttgtacatccatttcatctgtgtatatcaatttcatccctcaccctttttttttcttttaagctgagatgctgatagctggagaagttgtgaccttcctaaggctatgtggctagttcaaggccttcagtttgttgatctctatatgaaaccactggacaaattggcttgaatatttacctagatagatggtgccctggggatacaagggtgaatgaaatataacccctatcctcaaaaagtttcagtctagtgagagagatagacctctacaccaaaaattatagtcatggtgcgcttagagtgttacggtgacacagaggagggacatttaaatcagactggtaggtaggaaggcccaggaaaaaacgccttgaaggtattgtttacttcaagattagcagcataggttttgacttgagatctggctttgaatctgtgctctgctttattctagctgcgacattggacaagttgctgaaacagctttatctgggagtttattatctaaaaaatagggataataatgcctgtaaggtgcaccttcatcagttgtattataccctgtctagagaagtacctaaaggagagaaggatatggaagaggaaaggccaagaagaccaagaagtctgcagtgctggggcagcactattcaagggagagagactcttcctgtgtgagccacaacttttatctctatgaagatgtatgtagtgcagggataatttattagctatcccccaaactctctatatctcaaggttctaactttcagtggactcctgattactaattcaggatttcagttatccagatatttgagaaaagtgtgtcatggctttaggtgtaaattttcttactagtcaaaaggaatattctctatgattaattaagaaattggtattctgatttgtacttcagcctcttatgatttgggttaccatgagttagttctcttgagcatatttaactgtgaattcttcggcaaagatatgtctctggactttttatgctgaggaccagactctctagggctgtggcttcttctagatggatgagattttaaagagccttatctcagtggtcctacaggccagcttcctcccttgattctaaccatgatactgtgtgtggatggttcacagtgtgtgtatgtgtctaaaggtatggcagtgattgtcttcttatataacaagattaaaacaacaaaaaggtaaaaaggagctcgttatataaattgatgtagaaagattattttaagataaaaatgatttttgtctaggaaaatcattgtttttgtgcttacttgtaatttttatctacaggcaaaaggtggttttttttttgttttttttttttaa

SEQ ID NO: 109284 - DNA, 1358 bp, Homo sapiens
cattttagcttgtattatatgtatttatgtaagtttcattgactccttctgaaataagatacacttctgaataaataaattatgactggcacagtgaatgatctgcttttcagacattatagctactgttagtaaatgttcggctttcacattatgatgtataagaggcctagggatttagtatggacaaatgccttatggtttaagagaagattctgattattttggtttaaaatggcacattaaagtttctgcaaaaaatttttttttcaatgaaaccctccttcctatgcctgtgcttaaagacctttttgtatgggaatgtaggaacctgactgctgaccttgctgcgtcttctgaacaggttgttaagaaattcagttcaattaagccaacattttctgtatagtttggcacctgtgaaaagcagtgttatgttctatgtgatgtctaaagatgatttggtgcattctgtgtcctcagggagcattctgtctacttggagagatgagctttttttaaaaaaaatagcagagttacaagatgcctgccacctacaagtgtgtgatggcttgactgaaggagcttgggaaattttggataattttgaagaggaactgacatttaattgtatcctagcatttctgtagacagcgattgggtggagaaaggaggggaagatgatattagagattgaagaaaaaatatggaaatggtacagaggaaataaaatgcaggcaccgttggaagaaggcaggtagtcttatttgtcaggagtaggctttccccaacggtaatcattctagaagctcattcattatttttttccatattcaagtaccctctgtgttttgatatactaaacttatttttaaattaactgtttttttaatgttaagtatatttatttgaaaaagaaacttcatatcagcaccgggagtggaaaaatccatgaaatgaaattcttggcctttaacctgctgagatgctgtctccatcttgatggagcagaatgattctaaaaagatttatctcctagtctctggttgtctctagagttcctctatcctcctccccttgcttttttatgaggagaaaaggtggcttttaaaatttaattgccagccataatttgaagcaaggcagcctgcttgctccctttgcaggtggagagcacttccagtgatgccactttgtgaggagctcaggtttggagtatccctttccgctgtgactcatgtggcagagaagattttatttgtatcatgcctccatgggaaacacagagttatgggcagtgtttcagcatagattccatcctcatttttaatgcaggtaaatgggaagagattatagga

SEQ ID NO: 109285 - DNA, 1524 bp, Homo sapiens
taaacaaaaatgacttatattttattttacttcagagtaccaaaggcttgactttaggataaatatgtaggagtgtggatgtgtttgcataacttttctttatattcaagcttcgactttttttttctttttcaggatcaaaacagtttcctattgcatatattgttaattttaagcagcaaatatcattttctcatttgtttataatactgagttggtatgtttagtttgagtggatgctaatcctgcgttttcattctagaaggctacttaatacattattttcttagccaaacttaagtcaagccaagctttggttatggctagttataatctgtttttaataggaatcctcaaagtcaaagtttaaacaaacaaaagaagccatccttttcaaaatagttattgtaatgataatcccttttatagctttgttttatagttttaggccctcctctgaaaagtacagagcatttttattaatatttatataggcaaaaatcatgcatattgataaactaatatattttcaataaagttgaagtctatgctatgaaaagctgcttaaaaagtgaagatatatgatatggtctgggtctgggtccccaccgaaatctcatcttgtattgtaatttccatgtgttgagggaaggacctcgtggaaggtgattagatcatggggggactagatcattagatctggggattagatcattagatcattagaccttcttgctgttctcatgatactgagtgagttctcatgagatctgatggttttataaggggcttttcccctctttccacttctcattctctctcctgccactctgtgaagagatgatttccactatgattgtaagtttcctgaggcctccccagccatgtggaactgtgagtcaattaagtctcttttctttgtaaattacccaatctcaggtatttcttcatagcagcgttaaaatggactaatacaatataatattgtacttctgaaaaaaaaaagaagctacaagtcttgatcacttgatctctctggaggtttttttttttttcccttctctttctctgtttcttgataatagggcccaattgaatggaaccttagctgcttccaacttttctggaattaaggagggccttgatactcgagtctgttaagattgagacttaacctactttcttccattcctagaagacaagagagttcctgtctgccactgggcgtgaggctcctgaaggcaagtttggggccattgcataccatagtgcaagatgtacaccgtacagtgttactaggtggagagacattattttctaatgtgtgcagagctgtctgctccccaagctaggcatctatgggtctacaataacttggaaacttttctagtttgtacagaagctaaaggcgccgtagcagtaggctgtatttctgagactcacagactttttaccataccatccaccattagtgccctccatgtcctgctcttgtatgagcagctgacagatgatgatctttgt

SEQ ID NO: 109286 - DNA, 2340 bp, Homo sapiens
caagaatatattatcttgttttaagataaaatgtatgtaaagggtttagtatagtgcctggcattgtggtattttatgaagagttagctgtcatcatcattgttctctttaacttgatgttttattttagtgaagaaactaatgaagtctttactcttcatttagcaactctgtttccctcttatttattttttactttctatggaagtacacatattaacaggtatacgttgctattctctaacttaatgaattttcaccaacagaacattaccagtagtaccccagaagccccactcatgttctactgtggtcactatcccttattttttaggaaaagaatggtttttcttttagtgatagagcgactcatggctttttgtaaactcttaatagctatggctgacagatatagcttagggatggccttattatatgcttttattttctttggctttaaaagcatgtctgctggaaagggatttcagtcctgcagattgttacatttagacatgataggctgagtgatcttgtagatcttcctcgccaaataggtgaggtgttctttgcttttatttgtatatactatagaagtccatggaaaccaaaaagttgtccattgtattaaaagaaaaggaaaatggcctagctgcacagacctcttagatgtcccctctaaaagcatttcacattcaagagagctcagggcacatgaaagaaatcctgtggtggaggaaggctgcacaatgctgggtgcactcatttcctgcaataggagagatgattaggctgaaggaccggcaacttctagaagtaatggactacagtgtgtttaccctgcttttgtctgcgcatatttagaaaaccagtggtaatttttcagaaggcagcttctcagaggaagcctaacgatatgggggttgagcttaggccctttatatatcttctttttgaaatcaaagtgcagaacatgttcattctgaaacaccctggacatgagccgtacctatgtgtcttgtttaacttcctgtgcccagcagtggctctgctaaaatactgtatatgtatttcagaatgtcattacttatttttggccagtgttttgttccttaagatttatttggtttttaaagaaattgagatataatttacatgccataaaattcaccactttaaagtgtatgactcactggtttttaatatagttataaggctttatagccattaccactgtctacttctagagcattctcttcactccaagaagaaaccctgtgtctgttagcagtcactctccctattctgtttgttttttttttgccaaataaatgttgtcatgattatctctattacataggagcctgtcttccgcagagtgtcatgacagttgtttgacctttcgcgtataggtttatcacgttcaccttttgttctaaggttgatggaggttgcagttttcagcactaccaccaccaccaccatgttgactgaaattattataggacataaaatgacagtgtgttactcacaatcacttgtgaaagtttcagtgcttatgaacaacagacaactgagcactgtgcagatttctgactatgtgacaaagttggcctgtgctttaaaatttaatgaatagagaagtaaattcttctgggctatgtggaaaggtttagatttatttgtttcttacactaattagttttttgaaaaaaatgcataaaatgtgttcatacttacacttatttctgaaggactggaattggttgttcctaaactaacatgattgactttcttaaaaaacctcatttataatttaaaactattttgaatctgtgtttttattattccagaagtgatatatgctagttgaaaaattttaaaaaatacatagagcttagaaatgttgtaaagtaaaaaaagagttctttgtcatcctttcactttagagtttatgcttcaaatttttaaaaatgcctaattctataacctacttgattctttgctcagtttttaaatacttcagaaatgcttgtttattgaattgtgttattctttattttaatactgtttgaaattgatgaaaaactttaaaatttttgcctttcaaagtggtgattgctaagaaaaactcccagtgatttttcttaaaaattactttgccctcttcatgggccagtggaacttctgagcaactatagaaatgtacatacttcaagacctggaactgtttatcatcaaagaaggccacaatccttaaaaaggcttcctcctttagagcggcttttatagaaaggcttcaggacccaatgacttccaaagtcacatctgtgtcttttcagg

SEQ ID NO: 109287 - DNA, 1589 bp, Homo sapiens
gagaatcctacatttattttaggttacaagtatctaaaaagaatataatttatgtgaattgttatttaaacatgttggatttcactattgccagaacctaataatggctttaacatctttgaaagtgcaacgatgttttcattcttctaggttaacttgtagcaatttaataattttaatgtacttcataatgctatacttgcttttaaaaaaagcgtacctatctatattcacagatatatactgatacctatatgtgtatatattttcactgtttcactatatgtgtatatatttaaaccatttaaaatggtttaatactgttctaatctaccatactgtttcattcacatatagtatcatttactagagttgtgtggtttttggaatgtgacttgatattgataatggactggaaaagttgtaaagagccaagcaaatcatcttctaccatatgaatagttaatcaggaataagagtttcttgcagaaaactggagctttaatggatattagatagcactcactgttgaaagagaaaatggaaagaaaaaaagccacacaatgtaaaatgaggtcgggttacccatactgcttttgcaataaaacagagaagaatttgtaggctttaaagtttaccttgtgagtttaacaatctacaaaaggctggacttaatacttattaaatgtcttttaaaaaatggttttgtttttctctccctacatgctctctcactcaaagacaaacccatttcctatgtaatcactctatcaaacattaatttatctcaacattccttattatgctccataagcactgaattttgtatcaatcagtggtcagttggttagttgaaaggaaagtacttttatttgtcccagataaaccttatttaagggaaggttgaaggaggggaggttgaagaaaaaatgtgctgatcaacaagctaggattggaaagacaaaagtggtgattgtttgggaaagagtatgtcaggaaactactctgaccagtctatctggctctgtggttgttctgagggtgactggaaactttctaagcctttggcacacccagtaaattgttgctcatatttgaagactagcactggggagtgtgtttagttttatccagtccatttttttccttatctccttcaacaaggatttatacagtgtttgcttactctgctagccactgtgctaggtgttaaacactgtggttagactgttagaagtgtgcttcacagtctaagtatccacatttttatagaaaagaattttaaagttcatttcttagaatattttgagttttctatacatttttaagtgttgtataagaaataataaattattttatttagttaaaaagaaaatagtttattatttaaaaagaaagattgattttgttactaaagtaccataaatctgaaagcaaaatgaaggatgtattactttttataacttaaaatgctcaaactaaacatttcaaacagcataaaaatgctcaataaaaaacttaaattttcttctactctggatctctaaaacccctccccagaagtaactgtcattatctgttttctgttg

SEQ ID NO: 109288 - DNA, 1042 bp, Homo sapiens
gtgcaaatatatctatgtgattctagcttccttttcatataaatagaagcatgttatgtaaactcttctgcactgtggacttcttcacttcatgtatttaagagatgaacttagacacatctgcattccttttactggctgctcagtattccattgtgtgagtgaaccattcattatgtaaccatcccttgctgatggacatgtaagttgttccttcatttttgtttgttcccttcattttgttcttacaagacagcggtgcactgtttttttttttttttttacatatgtctttcccacatgtgtatatttttagaagtaaaattgctgggtgaaagagcatgtatagttctaattttaatagatattgccaaattccatttgatagatactgccaaactccatttggcaatatctataaaaaaaaatctaaagggggttgaccaatttatacttccattagtgctatgtgagagttcctaaatcccactttcatgccagagcactgtatctttaaactttttgatttttgcaagttggataaagatggaatctcatttttctctctctctctctctctctctctctctctgtgtgtgtgtgtgtgtgtgtgtgtgtgtgtatatatatatatatatatattttttttttttttttttttttttttttaagacagagtctcactctgttgcccaggctggagtgcagagacatgatcttggctcactgcaacctctgcctctcgagttcaagcgattcttgtgcctcagcctcccaagtagctgggattacaggtgtgagccaccatgttcagttaatttttgtatttttggtagagacaaggttttaccatgttggcccggctggtctcgaactcctgacctcgggttatccacctgcctctgcctcccaaagtgctgggattacaggtgtgagccactgcgcctggcctaattttgttttttaattacgagtaaagttgaacatcttcttatggaataaaagccatttgggtttttttttttttccttccaacttttat

SEQ ID NO: 109289 - DNA, 1079 bp, Homo sapiens
cttagaaattaagcatgcttctttaattgtaatgtataaaagtattttatcagggtataaatgcagcacagtttttgcaaatatgttgtatgtaaatatataacaagagaaaataagctggggaaggcaaactggcctggcagagaagcagcaaattcagggagatgaacaccttttttatactgggggctctactaatagagagagtcatatttgggaacactgattttggaaagcagagggacaggagggagagcctgtgttgtagtggagatactctgagggtaggatgtattattgtcatgaaaacttgacttgctgaggttacattacttaggaatgctctgtgcaattgtatcttttttttggaggtagaacagagtgacagagtcaggcagcagagaagtcacagagggatggcagagattaccatgggaagaccagcaatatctgggtcatttaagagttggcatttagatttatatgtagaacaattttcatattttctcattcatgttaatctcaaagtatgtatgtttgacgtgggaaggaaattgttgaggattatgttagtcagatttaagctgatctgttaagagttattttcaggttgtatttgtacagtgttcatgggaggaggattctgaggggggttaagtcatcctttagtttaaagagagatccagaaggtcttttgacttgtaaacattctcactggctcccagtattttcattcattgtgccaaactcgattagcactactctgtcttctggtctctcactagttttataaggctaaggtcacaatgacagtcactgcactaggcatcccagttttcatgagaccatttaaagagagacataaaatgaacagtgggtttatatgtcaaagaaggagtggaaaaggcataggcttagagtcagtcagatgcaaaatcatgtcacttttgccattgaactccttattaaacctttcctagtctctgtttctcatctgaaaatagtaagtagggataataatatatcctttacagagttttgttaagctttaatgagatatgtacccaaagaactggagc

SEQ ID NO: 109290 - DNA, 1078 bp, Homo sapiens
cctgggagaagataaacctagtatggcatgactgagcccatatttgcctgaggaagataaaagctgctgctttaacttcaggtgagcctcacccccatacagggaataagatttccaggaaggaagaaatgttacttaaggactgggaaagatgaaaatgggaaagtgccacatacatagcagattgtataatatattggtatgtcttttcttcaaaattccgatccaccaataagcatttttttcaaaataatttttcaaagtttgtcatttttaaaaaagacagtccccccttttctaagtaactctagaccagggtttagatctggtcttaacacggttagcatttggggctggatatttgtttattgtcgtggaggctgtcttgtgtactgtaggacatccctggcttctgtcctttagatgatagtggcaaccaagcttcccacccccacaaacaaaactgactgcagacattgccaagtaccctgctgggggcaaaattgcccctgggtgagaaccgctgccctagggttagcaaaacaaccctcagaccccagttgtgactgtgatccgtaagttgggtgcagtgcctcatcaccaacctcattttctctagctgtaaaatgggagactttatgggtgcctttttatcatgtttctagaaccggtttagaagataaaacattaatagtaactttatatggcaaatttatcttgatacaatatcgaacaatttaaaagtaatacagatcatatttacacgttaagtacatttccccaggtgagtaaattgtcttcaatcactgcttaattttattcttgtttaccttttcacttttaggaagactgcaaacttacccccacttacctcttcgtgaagcctcacagggctcccccaggttttctctgtagctctttgatctcatagtggctttgcaaaccagtgctcagtgctactgatttcaactagttattttcccagagaaagccctaataaggttgatcttagggaaatcccttaactgatttcccctaaatctgaatcatggaaccaaccagcaaccagagagttcct

SEQ ID NO: 109291 - DNA, 1038 bp, Homo sapiens
cttagagtgtgtggaggatgcacatttgtggttagcccctatagtactgatgactgatcatcacatgtaagggatctgcctccttcctcacgtttgggaaattgaccttggggaggagtttgaggtgggactcaaatggaggaagggaaatactctctggagacagtgtgaccttctcctggcatctgggttctccacctcctgctgtcaggctgccctgcttgggaagctggctatgttcccagcctacagaggattgctgctcagggcctagagccctagcccagctaggcagatcatctgtgattttttattactacctctgtattccactggcgtatgtaattcagtactgagtgtaatttatatcactttgaagtctaataagtgtgctttttatctgcatcttaatatttgccaaattgtttttttcttctattattgaaagtaataattcctgtattaaatttgagaagtgaaaaagtaggggacgaacttcagaacagtggtacctccactaggattactggggaaaactttgtactattatgcttattacactgctgtctgccacactgctgttcaactttacatttaaaaatgtacttgaggccgggtgcagtggctcatgcctgtaatcccaggactttgggaagccgaggcaggtggatcacttgaggtcaggagttcaagaccagcttggtcaatatggtgatatcctgtctctgctaaaaatacaaaaattagtcaggtgtggtggcaggtgcctgtaatcccagctactcgggaggctgaggcagcagattcgcttgaacccaggagacggaggttgcagtgagccgagatcatgccgttgcactccagcctgggcgacagagtgagactccacctcaaaaataaaataaaataaaaatgaacttgaatctaaattggattctacctcccccacctttaaatctgtcagtagttaaaggtgtagcccatacctgtagcccataggcagaatctggcctgcagacttatttgttctgctcagca

SEQ ID NO: 109292 - DNA, 1034 bp, Homo sapiens
tggtatctgatgtggataacgcacctggaagaaaagccactatcacttagtgaaagctgtcagcagctgcattgtccaataaatgatcagtcctgagctcatggttagtttggagggagtttcaggaaaaaaaatgaaaatagtgaaagagttgaggaaacatttatgaattgggattgcttttattttggagaataatagattgaggtaaaagaattcctgcttgggcacttttttttttttttgtgaatgatgacttgactttgtttctactgagaataagggtagtagacatttggtttagaattaagggagttttagaaattaatgtctaaagaattttttttgtttataaagactatgagatgataatatcaatcatgtgatctgttttctgggagagtgttatgacgaggattgactactgtctgatcagaaaacttctttggatttatttttaactcttctattggaaaatctcttttagttaatcttttgtatctgaaacaattgatctttttcacattgcctgtttatcttactgagaaagctgatttatctacactgaattggcagcagtgccttgttggtgtagtaatttagattttctaagattttctgcttaatcaactctgttttcccctttgagctaactgaggctaagagggaagaatctggttgttccaactgccctttgccaggattttcctctgtgtgtgtgtgtgtgtgtgtgtgtgtgtgtgcgtgcatgtgtggtgggtgagggaagctgggcttcataagagctgcagtgccaggattttcctgtgtgtgtgtgtgtgtgtgtgtgtgtgtgtgtgtgtgtggtgggtgagggaagctgggcttcataagagctgcagtgcaggtaacatggtagagtcctgatagtggcagcctgaggagccctggcctatagctggggggcctccctttccaaccctgctctttgaccccagctggctcattttcagactgggagcagtggcatcacttgacctgggaggagaagcagc

SEQ ID NO: 109293 - DNA, 1101 bp, Homo sapiens
actgccaggcagggaagggctgccaggtgctaatgtcactgtgcctggcaccagcaagcgtcccagaatctgctcccgaggtccagctctgccagcatgaggctgctgtttggaaatgtaaagttctgatctaattctggcaaaatatatttttttttcttgaattgcttagattattatcctgatttcctcttcctttgattggcctgaagtgaaggccattaacagtgccatgatggcaattttatagatgaagaaatgccaaggaaattgattatatttggcatggctctgaagtaaaaaaaattcccatccctacctcataagtcctgcctttacctccctcttcctccctacatggagtttcttaactgaaggctcaactttagttttcaggccaatttggagccaagacaatgtctggctccaaatggtatttaaatagcttcaacccctccgttgtgggagttcagagtatatttccagacagatgacctcctggactctcatggtgcccacggagcctcagctctccccactctctactttgtgccctgacttctagcttcactttgatagcagtgggccttgggagctgactttgtgaaggttattggtaccaagtatgacatcattactagatatagcacttgtgtccttgcttgctcttaccatctctccagtgggacagtagagtcctggcttgagcttagagccctgctgcttaccaatgccacctgcttatctgacttctgaatgttatttactccatcctgtgttttggtacttttttgaggggcatgaagcctggtggaatgaaaaaggcaaatttgatccctgacagacctagctgtaatgctaggcctggcacatcttacttctaatcttaggtatgtttctctccaatcctcagttcttcagaggtaaaaagagggtactgtttcttatcttacaagtttgtaatggttatatgatatactgtatgtaaaatatctagcgtgcttctgagcccttaggaggaattcacatcttaattcctttcctttatctgccatccctgcttggtgtcttgcatcatgactgatattactatgcccttca

SEQ ID NO: 109294 - DNA, 1074 bp, Homo sapiens
gaccattattctaagtgaagtaactcaggaatggagaaccaaacatcgtatgctctcacttataaatgggagctaagctatgaggatgcaaaggcataagaatgatacaatggactttcgggattcagggggtagggtagaaggagggtgagggataaaagactacacattgggtgcagtgtacactgctcagttgcaccacaatgggtgcaccagaatctcagaaatcaccactaaggaacttatctatataatgaaataccacctgttccccaaaaactattgaaattaaaaaagagagagagagagaaaaaagtgagggacttgagacacatttggcatcctttttgcctttcttcttatttctgcacagttaaattttacctatccttcagtacctggctcaaatactcttttacgaggctatatttaattcttccactccagcataaatgctgtctacctgctctgaattctccaagcacaactgttctcagattattttgtggagtactaaatagatgttcattgaaagtagtgctggtcaagtaagtttgggaattcctgtatgtcagggctgctttttagggagcaggtacaggggagggggagggtggtggtacttattagcatattaaaggtgctgaggagcctgcttcatccagtgttaaaaaacttttgattacagaatttttttctccaggaacaatgattagcatttcaaggaaggttcaaattgtctataatggtgcttaataaacattatttcaagaaataactccttattccatcataatatagtatctatcattctaccattagaaattattcccaaggactgtgcagagtgccagatttctgcgacatataatcaaagagaaggggaagggtgaagaacataaagagaaaatagatttttgccaacataaaccaaacattttacattttgcttagggcagggctctgaataagggcacacatccagttctctggactggtactgaacagtgaaaggttataaatgttttgagttctttttccctaggaaggattggtatgtttaagttagatgcc

SEQ ID NO: 109295 - DNA, 1202 bp, Homo sapiens
tccagaactccatcatttgaataaacaagatatcttgtcttctcttatctttgctcctttagttattactgtaccttataggacacctctcatgattacggtccttgaagaaaaagttcctaaggatattttatgttttatatgtattaaaataaaaaatatgtataacaagagtgtttctgggtccaaaattttgatatgtgtatttgttatttaatattatgtcattgtctttaggttctttaaaagtctgtgtcttttaaaaaacattgcatatttattttttgtagataaacttctttcctaactctgttgagcattatgatagtaagtatacatgagcgatatagattagaaggcatatttcaattctgaaatatggtcaatagaaatggtgaaaatatattagtagcaatgacaactagcatgcatccatttgtaagaatgttgcaaatggctgggctgaccacaggtgctttgttacatttatttaacaaatagtggagtatctattatgttcaaggcagtgtcctaggccctgatgcataaaattggatgtgaaattaagaaaagttgaataagaatatctaaaaggaagagctagttaaacgaccatctgtaagaaaaataaaatgagatcaaaaggggaaaacatataaacaaaaaccatgaaagaaaaaagcaatatgaaaagtgaatcttagaagacaaagtaaaaaataaaaggtccctgctcacaaagagatagaactatcttctgttatctcaagaggaaaaaaaagaagcctgctttacataaattattatgcataatttgtacaggcactggactcctggaaggttgccagggtagcttttgttgagatgaaattcaggggacttcttatttataggaaactggttaatgttgtttcctattctttatttactttctttgatttttcttaatgttcttcttgatcactgatgactagagtagtgagagaattttcaaaaatagttgatatatgatatattagtacaaaataatgttaagtttcttaatatattgtgcaaatgtataaatgattttttttttttttttgtatttttagtagagatcgggtttcgccatgttggccaggctggtctcaaattcctgacctcaagtgatctgcccactttggcctcccaaagtgctggcattacaggcatgaaccact

SEQ ID NO: 109296 - DNA, 1004 bp, Homo sapiens
ctctggtcctttgaccagagactaatgttgctgaggtcgatagggaagtaatggaattttgcatctgcaaatgtgatcagcctctgcaagcctggcttccagcagaaatcctcctgttgtcctctgagatacttttttactggctgattttttaaaaaaattaaagagccttctttaaattgaccaataatatttcttgttaccttctcttttccccctcttgtaggggtggcatgcgttgatttacaaaatgaacattgggaaagtgttttgatataagtttgtgtgtgtgtgtgtgtgtgtgtgtgtgtgtgtgtgtatgtatgtgtgtgttttaagctccaagggtaagagttacagaactggggaaaacgtgtgcatactctaatatccagaaagactgctacttttaaagatgacacttggagagttaagatagaaagtataaaaacatgtggccaaatcataatgcctgacaaagtgatagctattagactgtgtttttatgcaggcctctgcatactctatctaattgactaatgactgaaacagattcatgtgtgtagaaaccagatgggtcagtgggtatattaggccattcttgcattgtgataaaggaatactggaggctaggtaatttataaagaaagaggtttaattggcttacagttctacaggctgtataagcatggcactgcatctgcttggcttctagggaggcctcatggaacttttactcaaggcagaaggtgaggcgggagcaggcatgtcacaaagtgagagaaagagcaagagaggtaggggagaggcaccacacacttttaaacaaccagatctcacaagaattcacttgctattttgaggagagtacccagcctccctcatgagggatccaccctcatgacgcaaacacctcccaccaggccgcacctccagcattggtgattacatttcagcatgagatttgaggggtggggagtggggagtcatccaagctctcagta

SEQ ID NO: 109297 - DNA, 1965 bp, Homo sapiens
tattttcagtttgtaatgacaacattaggaggaaaattgattagtacttttaaaacagtaggaaaattatttctgcccaaacattgattagcctttgaatggactttcttataattcttttcttccacagactgcagggtgcagcacagtcatattttaggcagagtcaagcagagaaacctacttgccgctattaaacttattactgccttttccagtgggtgcaaataactttgtctccagtagttacactctcctggcttgataacacataaggacttctttgtttattttgattaaagagactaaagatacttttgtcttatgtgaaatgtgaatacagtgaaatattgaaattttttgatgacatatattcctccttttggcttataaatgtcaacttgtttagcttccttgcatgagtgctttaaaatttattagctgaagctcaggtaatattaatttgttcctggttaaatgttatataaaatataggaataaagaaaactgaggtccttaccctcaggtaacttatatatttgaggagttaagacatagaaataagataaataggagagtttatgatgagccccagatgagtgggttggaatattacataaccaatacagggtttcagaaggagagagattttgtgtgcgtgcatcctgaaatagttggggaggactcatgcaggagctggaacttggagataggaagaattcatgcaggtggaagagggtaggagggatgctggtgccattagcagagagggctagaccagaacatgcctgctttttcaacagtgagtagatctgtttggctctaatagaggactcatgatggggggtaatgaataatgggaaataaaactagagaggtaggttgaattcaaattgggaggggctttgaatgccaggcaagggaatttggactttattctgtagaaaatggatgaacagtgaaggttcttagccaggaataagaagaaaattgaagaaattgctttgtagtttagttagagcagaagcagcgtacagctctgaacccaagtgccttagatggaagataagggcaaaaagaactgtatgcaagctctgtcttcacttctgatgagatgcaggaagaagttagctgcttaattctctttatttttccttctctcatttaaggcttgtattaaatctctttttcagtcttaaaatgcattaattcaaatttgaccttccttactgtctgatagttgaatatccaaagctattttcagttgttccagattgtcacagattttgatgtctaggtgccaactggaagggccaaacctggcctgcggaggattgtttttaaaatctgattctaaattaagcactttgagacagaagaaatgagatgtggcctagttctaactcaccatttagctaaatgtatatgtatttttttctctgcctaaatatttgtcttattcttttagacccaaaaatctcagagccaagaatatttagattccctttcactctttcactttttccaatagtttttggcttttactattcttaataagttacacttataaaggaatgtctccaaatctaattcttttttttaaaaaaaattgttttaaattcctggccctcctcctatcctgtatctcacaaattattaaaatggaattgaatttatttcttgaaggagaagctactgataggatttagacttttaaatatctaaaattaagttctaaacaatagtgttcctattagcaatagaaattgtggttatagagaaacatagtatagtgtaagctttagagcacgcctgtccaacccgcggtccatgtgccatatgcagcccaggacggctttgaatgaggcccaacaaaaattcgtaaactttcttaaaacattatgattttttttttgtgtgtgtatggcaattcttttatatatatatatatatatatatatatat

SEQ ID NO: 109298 - DNA, 1098 bp, Homo sapiens
tattatttatttattttttactagttttttatgtgtagcttacttcaaaatatatttgaggtaatttacagtaagagactcattataacagggccactatgatataagaggtcaaaaacagtagtagaaaggaaagaataccaaaaactcaaactgaaattaatgtagtattgctattaggcaaagcatataaatccagaactctgaatctggtagcatttttttcttctatcatggtgcaaaatttatttctcctaagaacttgcttttcttaaacaagtcaaatcacactgtttcttccctctttaaagttccctcttgattctcacagccaaaagtcatgtttcatattaatgtttgagacttattcaaggtcacatatatttggggggcaaacatggcatatcttcttgtagtatcaatttttcctaaaaaatttagagaagaaccaatattttatattaattttaaaacattgcttaatgtaaaaaatagatatagagtggaatgaagaatttgcctgaaatcaatgcaagatttcaaatagatatgctcaattgtgatctcagctgagaaaaaatgaagtgaaaatagagtagaataacgaatttgcctgaaaggaatgcaagacttcaaataaatgttgtgctcaattgtgatctcaactggtaagtgtgatctcaggaacccttctgcccttcctagtacatattttctctttgccagtagtgatgctgccttggaaatacctgcaaaaactgcaaagttctggcttaccaaaccaaacacacacacccagggacataccaaaaacaaaacaaaacaaaacaaagcaaaaacctcagaaacaaaacaacccaacaaatgcccaagccttatttccaaatcctaagattggtataaaaccactcacaatatgctaaacttctctcagattgggaccaatattgggccttttccagattcttcttgcctggaacaccaccatgcttcctgcccagactatcagatcaccactccttcctcgggtctcagctgtgaaatttctgtacaagttgctatgttccctaggcattgtgtttctgactctgtcctctg

SEQ ID NO: 109299 - DNA, 1002 bp, Homo sapiens
agcatgtaaggtcaaactttaattaacttttctttgcctatactggactttccctacacaagtaggtacttatattctgatcacaagtccccacacgtcggttgtagatagcaatgtcaagttagtgcatacccagctactaaagtttactggactttcaggtgttcttggcatgccaggcaggtggtacccagttatttagagagatctttctttcagaccttagacatgtcttttacatataaattacttaggtactttgaccgcatcatgtggttcagtttgttttacaatgaagactagagcttggggaagggtggtttttgttgcccatgcttacctgaaattcagaaaacttatcttgaaggagccagagccagttggtatatctctgagaactgtccttagactcttagctgggtggtgttttcctagtccttgtgtaaaaggataaagatggtggaatgtataaggtaaagtgtttttaggatatacgtatctgggtgccacaaagggcatgagtagggaacagtgaaggataagggtgaaaccattcattgatcctaatcatggaaagccttgaataccaggcttagaagtttggattttctcaatgtgcaaaaatcggtagcatttctatataccaacaatatccaagctgagtgccaaatcaagaacacaattcaattcacagtagagacacatacacacacacacacatacacacacatacacccctaggaatacggcagatcagggaggtaaaagatttcaatgagaattacaaaacactgttgaaagaaatcagagataacaaacaaatgaaaaaaacattccatgctcatggataggaagtaccagtattgttaaaatggccatattgcccaaagcaatttacagattcaatgctatttctatcaaactaccaatgacattgttcaaagaattagaaaaaaactattctaaaattcatgtggaaccaaaaaaaaaaaaaaaaaagag

SEQ ID NO: 109300 - DNA, 1264 bp, Homo sapiens
tttaaaagaaagaagttaatattcttgatgttacacttctttttaaaaaaatgccttttgtttccaggaaaaatacggaaattttttttgcttccaaaaggtcatggtttcttccttctaattacattctttaaaattctgacagtgtgggctttgcaaattataccatcataactcttgaatgtgcttttcataaaattcaacacattttatctttagcctccgaagtccttatgacttataccattattcatacaaactacaggtttagaatcaagtaaacaaaattcctgctttaatatacaactacagttgttttttggttgtgtttctggttggataatccagatcagactttgtgactaggagctgtaagtaaggtggctgccttaaaatgtaatgcaaaaacagtcctttttagtctttttgtcttgtggctgggaccatatggttttctgaagttcatatgtataatagtccttttttgtgtgggctccattcatttatattctactgtttattgtttattcattctttcattttgagtatctattctatattagtcttgtgaatatagaaatgcaaggcatggtgcctgctcttaaagaggttaaaggcttatgggagaggcaggcatataaacaaataattacagcctaaaataataaatgctattgtagcggtaagacaaagtccttcttgtggcttaaactctctagcccacattccccagctaattattttcttctgtggattttcatccttgtctctcaatctctttttcagatatatgcatatccatattgcttacttaatcttttctgcttccaggttcccattttgggtgtggaagccttttgcagtgactgtgtcctgtcatgactcttttggtagccctctccagtattccagctttgcctttaaattttaacggagagaaaaataatgtatctcattcttggtgaaacatttaggctgtttagttgacatttgaaatggcagagtctattgttctaaaaggaaaattatccatactgtgtaatgtggactattgatagaatatggaatcaggcatatctttttatgtatttatgaaagtaaagcagtgcttccattttagcacaaataactttcaaagcaaagttatttaaaatttctcttttcttttcttttttttcttttttctttcttctcgctctgtcatccaggctggagtgcaatagcatggtcttggctcactgcaagaaccgcctcccagattcaa

SEQ ID NO: 109301 - DNA, 1026 bp, Homo sapiens
gtgtagccaccttctagcaatggcatcagttcaacttttgcttccattgctagatttcctctggctgatattcctgcttctttctcataaagacctctgtgcccacctaatacattgggaccacctaagtaatgcaggaaaatattcccatctcaagactcttacctttatcacatctgcagagtcccgtttgccatgtaaggtaatgtattcacaggtgttagggactagggcgtggacatatttgagggggggccatgattctgcctaccacactgatgatgatgatgctaatgaagatgatgaggaaaattagctgctgttagtatttcactcactcccaaaattacttttagtattttgtcaaagaaaataagttctatcccaaaacatgtaacaagagcaagcctggcctgatcaggggattgagcttctgatttgataaaagcttcctcaccccttcagttgaaagtggtttccttcagatagcttcctggaaacttctgggctgtgcacattagtccctttcaattcaggcactgaaatgctagcaaaatgaaggtatgttttctggaaaccagctatcaatctagcacaagcgactattaggaaaatcaaggaggtgctgcggggatgtggaataggacacctgggttttgatttaaagtaacttaaaggaattgcttatagcagagagttaacattcatatgggaaattttgagcaacctgtttgactcaggtcccggtgagagggcagtcttacataggagatgtacagaaagttttagtctccattcctaatcctaggcacacgcacacacacacacacacacacacacacacacacacacacacaaaattctgaaaccctaatactgtcaaatccccagtgagtttcaattttcaatgacaactatggataaaaatggtcatatttaggagagtaggggggaaaaaagctttaataaagtggcagcagaataaaatgattatcagttttttaaaagcactagtgtaaagaatac

SEQ ID NO: 109302 - DNA, 1069 bp, Homo sapiens
tttctttgaaaacacaaatcagacaaattgttacacagcaggatcctttgctaattttgacagccacttattcatttactagcctttgtccgacacaatacctgtgtggcttttatttttccagactttccactgacacattttcacaatttgggtgtttttgtccaaaacgtgtcatgtattttgtcatatatatgacaaatataaattggaatttttaaacttcaaataaaataccacattaaactagtgattttaaactgaagatgatagaatttttaaaatacagacttggagaccacattcaaaacacttcatagcaaatgagaggccctcagttatctggtcttacctcagctttctagtcgtctttgtcactttttcagcccctggggtactactcagtgctgtctgccagcctgctaagttcactttttcctgcttagcacttgttattcctctttttccactaaatgcctttagttattaaattattgtttcctacagaaatttaacttcatcatttttgttgtctggagaaagctttgttgtcatcactcagtggtgagaaggttgactttctcatgaaagctccaaccctaggtcttaggtttgatgtaagtcatgtgctgctgtggaaactgtctagtgcctgtacagtgtgatccgaagttactggactgtgagggggcagtctatcaagtatggacagctatcaagtatgttgtacagtttgatctttaacaatttaaaatcaatattgggttccttggtcacacaaatagcctagttcttcaagtaagcagttctttctgcctgaaacctcatgtcccactgttctacttgagcacccttccaggtatcaagggcttaattatagggtatacatagtcccctgcaagccccttatgcatctgaaaatgcaggtatgaaccttcattctgagagtaagttagctagtctaaatgaatatttgagatggaaaaaaacatctagatggatataggtagatgaagtaaccctgggtaggtaaagaagctgattttagcagtgcctgaaagactcttga

SEQ ID NO: 109303 - DNA, 1055 bp, Homo sapiens
ttaaatagataacttcaaagtaattggcttgaaatccaaggatctattctgggatgctttagaaatttttattcccttttcacctcagctttaaaatatatataaatgtcaaggcttcagactttaaaactgttgctgttgtactccaaactattttcttataattggcactgttcaaatcctttttggaacaggatttgagcttgagtgagaagagaaggtagtttggaagaatcaagaagtatgtaacagtgggatctaaaaatctaaacaaaaagaggttaaagggacagatctgatgtatttcagaggagcaagagtagaaaggtgatacattatcaaaaaggtcttcatgcacatgaagtgttctattccagacttaggggattagctgttcttcatctctgctaagggcaaaataaaaggaaattattttgagacagaagcatgaagagattaagattagagaaggaatactttaaaaatacatgtttgttaaaccaagaacctcagccatctaaacaagagtaaatatgccaataattctaccatcttcgtctgattaggctatgaaatcttgaatcttccttggatagcttttaaactgatatggaatggttagtatgttttatggttatttccagttctaagattgagtgatccacttcatttcagcaggctctgtacgtattatggacttgtttccctctgttttttcctctgttgtctccttccttttttttttcttattttgtataatatttaagagtattttacatgtaggtgtcatttataattttttccttactaaagtattccttttttattatggttcacattgtaattcaagtagcataattataacatttttattgagcagaaaatgaccacttttgtattttaattaaagcatcttttttttaattatttatcttatccagcagtcattgaacactaaagctgtgttatgtgcaacacagatcttctctcattttacccagaacaatcttttcctgagaaataagtctttgcccaaagcaagacactcctgcagt

SEQ ID NO: 109304 - DNA, 1025 bp, Homo sapiens
aattggaccttgctctagtagaattattattattattattattatttgaggcagattctcactctatcgcccaggttagagtgcagtggtgcagtcttggctcactccaacctctgtcccccgggttcaagcaattctcctgcctcagcctcctgagaagctgggactacaggcacatgccaccaagcctggctaatttttgtatttttgtagagagagggtttcaccatgttggctaggctggtcttgaactcctgacctcaagcaattcacccccctcagcctcccagagttctagtagaattgtgatcctaattaatttaatacacgtcactatgagaaaatggacttgcatcatggattgaggatttggcctttattccaaattaaaacctgattattaaccaggctctagtcttatcctttgctgacagaaaatggtatggtcttttatatcaaaattgtagagggctattaattttctgtctatatcagacatttcctaggtttttggctacccagagtctgaacctctgtttttatctggcatgaattctttgttatgtggggttttgtgggaggcggggttccttttccagaaggggtcagattttcttgtctttagaagctaggctgcagccatgtgaattaggttcagccaatcactattactcacccagaactttgaatcttgagtgcataactcaaagatgcagagacagtttattctttttagcagtggtggtgttgagagtccagcgacatcattgtctagttgcagcagtggtgatgagaaaggtgtgttaaccagactcttttgtggctgagtccctgtgtcctagcctcccttcagcctcccttgattctagctcacttccaggtcaggcttctagcttttccttcaagatatttctgtatccttcaaatatactttttccctttaagtctgccaaaatggatttctattgcttgtaaccaagaactctgactgatacactgcgtgaaaactaagctaactgtggcag

SEQ ID NO: 109305 - DNA, 1036 bp, Homo sapiens
atgtggatgaatagaatgtgtagaattaataatgatgtgtgggttccaaggcaaggccctaaaaggtgatacaacctcctcctggtcctctttctttcctgtgacatgtgccttggaaactgagtccaggtaccctgaatatgccatattagagagagcacatggaaagactatatagaattagaggggtatgccagaggaaccccagctgttctagccctcagctgtttgagttttcccagtgtaggcaataggacagacatgtgatcaagcaagctgtcccatgacttctcagccccagccttccagctggcccaggtgacatagggtagagcagaaataaactctgagcccttctccaaactgcagattcatgaacaaaatgaacattgttattattttaagcccctttgcattcattttgcatatattatatggcatatatatatttccagaatgatggctattataaatattcaaactgtaacacctaaattctaatctctagcatagaattatgccttcagactcttacaaggcaggattattgatatggaatgtacttatttatttagtttcacatttttgcatcttacagtttaagagagtgtcatttgggctattgtaaaattacttggctggaataacattacagagctttattgctgttagaaacaaggctatcttccatatcaagatgtttaaaatactagttttctgaatatttatagttgtgtgacagctaaatccattaattctaagatgttgcttggtagtcccctgtgcaaataagtctctaaatgtaagttcattccttctattaggatcctaacacatcttttgggaagcaggatgaaaattctacttttcttttggatttgatattccacctaataaggggatttggagagagctttagaaattaaataaaatagctagaagttattgaggatttactatgtgcaaggcactatgctaagtgcctgcaggtcttctcatttaatcattataacaattgtatgaggtagatttttat

SEQ ID NO: 109306 - DNA, 1047 bp, Homo sapiens
taataggatttctgctgggtgctaacagaacacatctgaacacatttcatttatttatgcctgattgaagaatgtccctgttgttaggtcctccctaggaaccatgactaagctccaaacatttattaaactcagaacctgaattattagcaactgagcaactagttctactttgcttgaggatagtgaggacaccttgtgtgcaaggagaaacatttgccttttatgctttgaatgtagcaaagaaagagaaggcaaacagaacattttcatattaaaagtttgaaggttatatcctgccacaggggtaactaagaaactttcccatgtatatggcccctactgggtgcttctgagaaagaaatgctacctttttttttccactctctgttcaaagtcaccaagcatttgggggaaatattttatagaacttttaatttgttttcaattggattactcaaattctgaagttgagcagttccatcccaggaatgaagagtcctctgtaaataggattaaggtctttttaccctagattataattaagggaatagatacctcaagtggagggaagtgtcattaaaaaaagactttctccaaggtccccctccccagttgctatcattataaatgctcattatgttttctttttagcgctgcatgaggtactggtgggtgatggacagcaaagaggacaagggaagagaaagaatttttgtcccaaaggatcctgtgaattagtgagaatatatacacatgaaaatttttagtaataatttgggtgacatatggttaaaagccagaataaattggcagataacaaattcctttaggacattggtcaatcaaatcagaatcccagggcatgcctgttaaaacacagatttctatgtcccacacctagagtttctgattttgtaagtctagggtgtgtgcagcttgataatttggatttctaataagttttcagctggtgcttatgctgctgatctgtccttttctccagtctctcacagtgatacaaattgagaactgctcctgtaggag

SEQ ID NO: 109307 - DNA, 1025 bp, Homo sapiens
gttcaagtgattcgcctgcctcagcctcccgagcagccaggattacaggcgcctgccaccacacccagctaatatttgtatttttagtagagatggggtttcaccatgttggccaggatggtctcgatctcttgacctcgtgatccacccgacttggcctcccaaagtgctgggattacaggtgtgagccaccgtgcctggccaactactgactcttataaagatttattaccagatgatgacattgctcctgatgtctctaactaggtggtcccccttcacttttcttagtcttctgccatgacccctccctgtacctctatagtggaagtggttcacattagttcgtccttaaccttaattctaacataaatgaatgtggaataccgcaaagagaccaaaagagctagctgtatgctagcactggctctgacagctaacaagctttaaggctttgagcaaaggacttctcctctccagatttctttttcctgatttgtaatatgtgcattggattaggtgatctcaaagatacctctcccttctaagattttatattcatcaaaattcatctgccagaatggcactgtgataattagatagactgccagctggatgcagggaaatagcagagctaaaagctccagtctaaactatccctggtgaatattcatttttgcatattttaataacaatactctcagtgtctcacctccacccagtcactcttgcaccctgtcactcacttagcaagaccctttcttttccttcacgttttacaactctgtaatttaacaaaatccattagtaccaacaaaatggagtaacagtgatgttttaatatatggcatgtacccttaatatcattactagtatttgagaaactaaatgaaagatttttaactttgacttttaaggaagaaaaaaaaatcacctttctttatttaatgagtaaaaaggacctccagtaaagagtaatgcaccataattgttattcacttcacactcattcctttttttggcat

SEQ ID NO: 109308 - DNA, 1061 bp, Homo sapiens
ttttaattctttgtattgtctgtgtttggctattagcctatttgaatgtatccactgtctaactgtaaaagttttgagttttggttagtctttctactcaaatggccccataatggttacaatcaagtcttcaagaaactttgttgttggttttcttttttaagtagtaggctatatttatattatgttttatttatgatcacaagcatggtgtaagagtgcttttactgtggaagtttgactttaaaatggcctaccaagaaggaatatgcatcctcgttacatttggaactataaaaataaatacagtgttgttcacacaaacaaataatttttgctggatagttgtttatcagtttcctggagccttgttttataaatactcataaacttggagaaaaagtctacttgagagaagttgacactatatgtagtctgcttattactactttctttttttttaaagtgtatcttacatttagaaacagatactataacatagaagcaaagatgactgatgagattttttcaccaaatatttatggaaaccttccacttaatatgaacacacagagataaatagtgtaggcgtatggtgattaccaagacagagtccttgctctaaaacagtttaccaccaagtagggtatttaagtgcataaacaactaactgtaatgatgagtagtgtcccataaatactgtcttacagggacaggtaatagtataggagtgcacagagtgatttcagagaagctagtgtttgagctaaaccttgagtggtgaatacaattatggtagaggagaggagaattcattttgggcttagggaatggcatgaataaggcacaactcaataaaaatacaaatatgaaggtggggtaagaattattcaagaccgaaccttggtgaacaacatatacaagcaatggcaagagtgaagggtgttcagaaacatggtagaagattaggttgccaagagagaacagggctaaattgtcaaggtcctgagtgctttgctaataattttatgttttctacatagaccttagaaacgtttttg

SEQ ID NO: 109309 - DNA, 1885 bp, Homo sapiens
tctgatggagattttgaggggtagccagacaggtcaccaatcctcaaccatagctgtctagcactgccataggttctgcagagagttctgcagagcagaccttcttagcaaatgcaccttcttccttgtgctgggctttgaccccagagccttccatggaagctataggtctagtgggttggcctcaaccacttgtgagtgagtattccctttatccttctggcctatgacttagactaaaagaagtctgcctgggctccttttactgaggtctaatttttatccttggattcctgccattcctatgcaatgagaaaaacaaaccccagggggagagaaagagagtgtactagcattgccttctagcctagaccctcacaagacaggagtcctgccaagcaagacacagccttttcacatatgggagtaggcaattcaaaggaggaccagtaacttctagtgatgcagatagaggaatccaaaaggagcacacagagtggatccaagaaatttaactgtaccacttcctaacatgtaaaccatttggcattggttccatactaatgccaattcatctgcttctcggagtgatggaggaggagtgttgaaccctgagagtagtttgtatctctgcattcaagagagaaaacaagagaagctggtagaaaaggcttctcaatttgtgagattaatctgtgttacatcagaagtagtgagaaaggagagttaggatttagaaggcttgggaagacctgaataatgtggataatggtatgtgcaaagccataaaatgtgtggttttgatgaggttagaatcatgcctgaaagctgaatggggatttagacatcatgtggggtatgtaatctgcaagctccgtcctgggcccagtgaaaacctttctgtgagctttccctaaggctgtacttcaggcaaattattatacaagggggaatctatttgccatctctgagcaaatccatgcctccctacctactataggttaggaaataatcttttatatctgttggtgttgcatttacaaagggcttccccgtatattatcacatctaactctgcctgttaatcacagaggaataaatcatggcatctgcagagtagagcctctaccagggtgtgtactcttcatacaaccatggacctgccctctgttaacaggattctgtattgggagagcaaacccttaaaagcagggataaagatattaagaggtcttcctgtcttttactaaggtctgaaatgccaccaattctagcaattgatttatctggatcccctaagaccttctattagagtgtgaatatccatgcaaaagagttatgggctcagattgaagtgtgtcatgtagaaattgatgaagaagcgataattatagcagattcattgatagttttatgtatgtactaatttacttgatgttattaagaaattatgaagtttagagcattgctatagtcactgtgaggattaaaatgctgaaaaataaatgatcccttccccaaagattttacagtgtagtaggaggtcctccagtgaagaaagggggagactttggaaacagaatggctgtaggaagtgatgaagaatgatgtagataaccctaagctttcttttgtaaaagttacatttgataacctctttgagttgttcatttggtggcattacatactgtgatggggtaagatgaatatgaaacaggttatcatgggatagatgggatgccctgtggacaaaatccatgaagatggtatatgaatttttgaaaatagatgaggtgttcctggagacatgattaaaaggaagaagaacagaggctcaagtaatagctcaaagagttttaggccccccaacaggtagaagagttgg

SEQ ID NO: 109310 - DNA, 1058 bp, Homo sapiens
tggcggtgcatttgaagccttaagagtaataaagtctcaggacagtcctctccttgggctctgggactcctgataccttcacaaaatgttttttatttttcttctcaggggaagcagatggaatgaacaacttctgtctattatctgctatttttaggcaaggtaaaccatcatctgtgtgccccctttagagaagttgagctaatttagcaaaaacaaacaacaaacaaaaacagtacaacaaatgtcctgttaaaagtctgttttcattagaaattatattcacttgtttctgtttgttttagaaaagaggtaaatgctgaaagagggtgcgatttggtgttgccattgagccacaatttctgtcccagggaaataattatcctctttggaattgtcagtcagttgctcccacagagcttggctatgggctgtgagcaaaacccagctataccagcttgaagcctagaaattttggatacattgaagaatccaatcttctgcaaagggtcggaagcagtgtgggtaatagttaaatattgtattggatagggacattaaaacgtttggctgttctctctctttttatctgaaacttccagaatcaaaaggtctagccaagaaaggaaatcattcctaattttggcaggttctgtaataggaagaaagaatcaagtctagctagccaaatctagcctaataaccaatgggacaacttccaaatgtggaagtcagtgcctacctaccattgttctccaggacaatataaaatagttcaataagccatttagcttaggtgttagaaaaacgcagcatccttagtatagttggtacctgaaaaacatttgctatttcaaggcttgatagagatactggcatatgccttcctcaatctcaatgtaatatatagtacctcatggcctatcaaagagaaaaatctccagagtaaagggagcacttgtgtaatagggtattcttctccatataggacagagataggtcagttatggtacttttgcaaagtgaacctgaaattacaagctaaattctgacttata

SEQ ID NO: 109311 - DNA, 1044 bp, Homo sapiens
ggctttgtttagtattagggctcctagatgagcaatacagcaagagaagagtgtctggcacatagtgtgtagtaggtacccagtaaatgtgtattgaatgaattaattaaatagagaatgaatgactccagatcataccacaaagcctggactaaaccagttagtgaacaattttagaatgttagaggtaagtgacattagaagtcacttaatctactttcctgttgggagatatcaaatgaattagatctatttgctctagaaaatattttaaaggagagatttagagtattggaaaggataccagatttatagttcgatgatctggcttccatagacagctaaactcttgcttttttgtatgaccttggatacgttccttagtttttcgcttctaaagtatggataaaatgagataatggatgtaaaattgtggggtggggttcaagtatttaatctgcctagcacccttcttcacttctagcaacagactgcacacccatcctgaccacagggcatatggcctggtacctcacctcatctgaacacagtgattggctcaggaggtggtcacatgattgaaacagggccaactagagtcttcctgtgggatttttcaatgccatcctgacaggcgtttttctctagtatggtattgctgtaaggatcagcgtttggagctactggtagccaattgctaccttccgactccctctattggagagaatatgatagcatacaaagagtatcagtgctatgtttgaatatttatgtactcaccacagtttgtgttgaaacttaatccccagtgaacagtattatgaggtagggcctttaggagatgattaagtcaccagggcagagccctcaagaatgggactagtgaccttataagagggctggagggaactagctaggtccttttgtccctctttctctcctaccatgcgaggacacctagatggtgccatctatgagaacaggccttcgccggagactgaacctgcgaatacctcgatgttgggcctcccagtttccagaact

SEQ ID NO: 109312 - DNA, 1030 bp, Homo sapiens
atttggggatggggatccttttggggttactcacatcacgctaaataaggcagttaccagctctcaggacagaaagaccaggccttctccataccccaactacacatacaaggagccttaatctaatacaggttttgaaggcacttcttaaagtcatgtcagatgggagacagaagcccaactggcattcgtctggagcttccctgccaccctggccacacctgcctcctggaggtccactctaaagagccttgtaggtagctgcagggcagaagccaaataaggcccagtaggagatctctggtgctactcctatataaatagtggttgccggccaaagaacagttttatctgaccatgttttggctaccttctaagcagctgctctactgtcatagcttcagagttctttttgattaataactcatgagtgttttagagttcacttctaccagttccactggcttcctgaattcccaagggcattttcagttagcattccacagggaactttctggaatacatttggatagcactaatggaagttaatatttctccaagctctatagcccaagattcagaaagggaagggaattttatcagtaattaaccataattttctctgatttatgaaacatagttctctctgtaaacaaatattacttttcatttttcttctatggatctcaagtgcatagaatgtgaaacatcttctttctgtaactgcagaaaagacaggaactcactcataacaaaatttagccagattgctttggctgagtgccgcttgttttctcaacagattgatgagaaagtccgacattaggctgtttttatgttgccatccctcaggggaacatagatgtgtatttgtgctttaaaacaaaaacatcatgaaactagtacaaactattccccctgaatcccttaacctatccctggaatatgtgtaatattgaggggcaaagaattcatcatcactgtggcagtagggaagtaaggtcaactttttgttagactgtaaagcaga

SEQ ID NO: 109313 - DNA, 1031 bp, Homo sapiens
gttgtttgaaagtaccgaaacatgtaatttacaagccccagcctaggtttttgtctatggtgggacgttgcatctctctgcatggtttcttcaactgtaaaataaaggtattggattagatattttcttaaatctcttccagtcgtaacaatgtgtgatttttgtctgtttatttaacagttattggttcattcatttattcactctgtaaacactgactgaatgagcatctttgagccagacacagtacccaccactagaaatgctcagatgaccacgtggcccttaactccaggtgcacagtgtgtgcatttgtatgtgtgctcatgtgggagggcagagagatagccagtaaaaacagacaactagagtgtagtggaattggtgttataggggacggtagatgtgcagaggaggaagaaattaggtttggaattggtaaagagttcttaaatcagaaaatcatgagagaacccgtaaatcttgtgaactgttcatgttgaactttactgccagttgcgtttttaaagacaggctttgaataatgccttgttttcttctttgcttctgtaactgtggttatatgttggtgccttatacagaccaattcttgccttctgccatggcaacacctaccacattcttttttttattgagacagggtctcaccctgttgcccaggctggagtgccgtggcatgatcttagctctctgcaaccttgaactcctgggctcaagggactctccagcctcagcctccagagtagctgatactacaggtttacaccaccatggctaattgttatttgtaaaatttttctgtagagacgggttcttactgtgttgtccaggctggtctcaaactcctggcctcaagtgatcctcccaccttggcctgttaaagtcctggaattacaggaatgagccaccactcacagactcaccaccacattctaactgcagctctccaactgatattaattagtttattttagtttatattaatatgctatcagcattgcctgtttgct

SEQ ID NO: 109314 - DNA, 1119 bp, Homo sapiens
aactgtgttctaaaatttatcacattttaaattatatctattaaataatttgatcactcattctgttaattttttaaatggatgagtaaagaaccacataaattgcttttatatttcactttaatgttcgacccagcagttgccctcagtacaagtttcctatcccttttttattgctcttggttgccttttgtattgtgtagagaaaaaggaatgcagcaaaaatgaggaagtcactgaggagcttgtctttttctttcactttttactatgccataatttcccttactgtggtcatctattttttcaccaaatctccacctctgattctctgttcctaaagaaaacaacagtaaacatgtaagcctctcattgtatctccattagtggaagaagactgtgatggaactgcaagtaactttcctagggactgctccactgtggctagattttttaaaaatgttatgaggaaagcattattttttaaagaactcatatttttaacttttttctcgtttcaaattgcttttttgatctatggtgaattcaatctgagattaagcattaaagaacttgggaaaaccaaaatgccttcacagaattagagatgcatttgatttttgtactcgagaatcagcttgtgagaagtattggcccctgtaaatagagataaactaagccaaatttgtctgtaggccttgcattttaaaatcacacctgaaagtgttatgagcctgatataattgcatttgcaaataaaatgcaagaaggtctagggctcagagtacaattaaatgtattaaatttttctttttgctgtaatgacagtaactttaggcctcttcagttgactgtacctctttgtaaaccttcccctgcaggataatcagcattccacagccactaaagaaaatgagcttgtctaaaaatagttgcctgtttactagattttagcagattttttggggggtggtgggatagggggtgggtaatatgaaagctttacaaaatgaaatgaggtcaaatatgacagatgtgatcaaatgtacttctaatctgtaaatccctgactagctacagttgtgctatttttaaatgtatactttgaagttatactga

SEQ ID NO: 109315 - DNA, 1058 bp, Homo sapiens
cattgtcagatgtcaaatggtctggtttaatgactagcttgttgtcctcttaaagataaccttaggtaggataggcctaaataagactaagaaaattccaggtcttggtagctggcctcattctggctctaaaattcttttgaagagtgggtgtggtggggaagggtcagttggacaagcaggaagcaaagaagcacatatagtctgcagttttgtttttcgcattttataaatttcctcctttcttctagattaaataaggacagcctatcactaacaatctcaaaataaaattgtatatgtcctgaagaacctccaaaactttcaatagccaagaaccatatgaagcaggatccaagtaccacatgaagcaggatccaagtcttatacacaagtaaataggtttgaggaaaattttcagaagagcatatcacagaacatatttggaaaatataatagaaggaaaataatatagaactaaaagttcctattatgtaattactttatatatataagtagcttttgcattcaagacaaataacattactggaaaaatttctctcttggaagacatttccacattccaattttcacattaaaaatgacataatgaaagtgccccaagttgtattgaaatgaccacaagcaccatacttaggtataacaggagttcacctgggactcactaatccagttgtttacagccggactctgttctaattgattagcacctgtgtctcactagttgttaatgtttttattaacactcttgctagaatatgtatttacttgtcaagtagcaaaaattatgtacagaaccagaacaaaacacataaaaattagtttatctggtgtggttcttatccatgtcattcttgtccctctctcttccctcccttttttttccctttgcagcaaattgtaaaggtgactttatcattaccttcttcagggtcacagagttcaaaatgactttcctgagggagatttttgacaggcatctttgaaaagatgtctagggagacttggaactactggatgacattttgatgtcatgg

SEQ ID NO: 109316 - DNA, 1037 bp, Homo sapiens
gacccaaacagctgccagaatggagttactgtatactgagacagggaatgctacaagagaagaagatttgctggaatgatattaggagcttagtttgggacatgctaaatcagacatgcaaagttgggtcaagtaggcaattagatatatgagttttacgctcagtggacagatcaaagctgggaataaaagttaggacatcatcagcatagagatggtatttaaagccagtagactagatgagaccagctagagagtaaatgtaattaagaaagagttctgtggaaggagccctggggtgctttagggtggggacatagggaagaagccgcagacagggaagaaaagccagtgccagtgatgtgggagataattgttttctcagaaaatatccctttttgaatgactctgattatcaaataactttttgtttggtcaatgctaatatatatttctacagtgtttttaatcagttgccataatgctgtttactcctggttacatgagctgtgttgatcctggatcactcttgaatggtaaggccaattcactggatagagtgcccacagtgttttccctatagatgctttaaatgtctttttctttttggaatggaacacatgttattatataggcttacatatgaatagttaaaataaggtaatttatcaagaagttttttaaaaaatatgtgaccgtatttagagatgcagtgtttgttttttaataggatgcaaatcaactgtctataatgttttatctcaatgaaaatcatgtataagaatcccagtcatactatatttgttacctaaccttccttttcattcattactcatcctcagcaatcaataacagcctctctgcagcctcttaaaatgcagtgaacctattgatttcacttgttattgcatctccctcccctgccgctggctacaaattactcttaagtcagaaaaggtggtaagatagtaagactatatatagactgtcctcttctgttctctccaaaaagctttttttttctatttaactaggaa

SEQ ID NO: 109317 - DNA, 1088 bp, Homo sapiens
atatctctaaactggtcattatttacatgcttcagctgcactcactaattaaatccctggagttatttctgacacctaccacctgggacctgtttccagacaaaggctttcctgtggcacacagccgagataggtctgggcccttctgtttcatgtcagaataaatatttcagctctgaggctttttgtttaactggattcagtggttctcttgatttgcgttatttcttttaccaggaatcagtttactaagctagctgttgtttggatgggctaattaaaacctgctcagtgtgtgtgcaggcagcctctaagccaaatattgccctacccagaacttggataaaaacatggcatttgtatttattagaacagatgagccttgtgacttacccctagctaatctgactctagtgtttgcttttttcattgtatgcccttctgaatgtacatcccaccttaaaaagtgaggagtgcccacagttcccagcccttgagaaatcccatggaaaggagagatgtggcctgggtgttcctgagaacagtcctgctgtcaacttcatgggtggcaggtcaccaaaaggtgtgtctatatcacatatgatatttggtctcatgagacacttcggaattagttatttatactatttttatcaaggtttcatgcaaagtggataaccagttatagaagctttgctgatactgccgttcttttgagtggaggcattctatctaggcaactggtaaaaaaaaatccaaatattgtttcagatagttaaatgcattagactatgatctccatctacatcaaacatttattcatttctgtcatattgcatggtcctatattctaggagaggcctatcatattcccctaaggagcttgtagtcttgtgaatgaaacagatatgcaaacaaatatttccagtacaatgtgataaattgtctctcagatttctaaattgggtaagtatgtgtatgatgatgccctaaccaagatatggaacgctgaagaaggaacaggttgaaggaggagagatggagggagatgttaaattggatttcacacgctcacaggacattcaggc

SEQ ID NO: 109318 - DNA, 1061 bp, Homo sapiens
atgttggccaggctggtctcgaactcctaacctcaggtaatctgcctgcctcagcctccgaaagtgctgggattacaggcatgagccaccacacccagcccatcattttcattattactaaagtaacaattttggattcccaggttttttagtcatttagtcattcagtacatatgcattgagcaatgtaatcagggataagacacttggggtttcatggaaaagaaactttttatcatagtgctttgtatactatacaaactcataatgctgggggaggggctgaggattggggtgggcgtgaaggataagatatttgaggtttctgagtcccgttttcctcatctgcttagagggagaatacctgccctccccactctgaatgtttgaaaatcaattgcaagtatgtttgtgagccacttagtagagtttatagtactgaacaaatcgttattacaactttgttatgaatttaactgagaaagttttaaaagtatttataactaggaatctaaaagatgtctgagataccccaagttacataaccctcattaggatttacagttttctcaagctctacttgtcaaatgaattaattgtctaatattatctaagcaaaatacttagttaagcttagaataacttttttgtatactgttactttgtctgcattccagaaattaaatcagaggggagaatgttggtttacaggaatagactgatacataatttgcatttgtgtgtcttccctaaggaaaacaataattattagtccaacacaaaaacatgcccattttgctgaagtacatattgagttcagaagtggacacagattgtcctcataatgaccactgtaatgtacctttattgcttcacaaggtgccatggctttggatggtgtggtgaggatggaagccctacccatatgttatttgcactggaccagaatcttggatggaggaaagaactttggacatatctgggccagaagttctctccacctaccaggagtgagcatgggagcatgagctatacatgtacaggagggtcatcgtgttttc

SEQ ID NO: 109319 - DNA, 1159 bp, Homo sapiens
ctctgggatgctttcagcaatgaagaagcagttcgattcatcaaggagcgcttggatgaacctcactttggggccaagagcatagttttacagtcattttacagaggctgccctgacaatataacagtcatggtggtgaagttcagaaatagcagcaaaacagaagagcagtgaacccttcaggggtctcagctgccttagactaaaggactttcaacacactggtctcttttaatttagtgaaaagtgtgggagttgtaattaggatcatccaccccagacatggaatcccccctccctggtggtcttaggtctataatcagtgacgaacagagggtgcccttggccaatgtagttaagaaactggaaaatggtttcttcatgttttcccaactctttcatccagtgtccaaaatatataagtaaatagctgtagagtcacatatatgaagtgaatagcatatgtgtcatttagtctccctgaagattcttttcaagatcctgttcagggtcctccaggcatcagctgttgtgtcctctctttgtaacagtggacaggacagaccacccagtgctgcaggagacaggccactgcgtcacctgtgagtggtcaggggctgatgtggcaacaccctctgccaagagacagagctgtcctgagaatgctttgtccttctgagcccatgttttctgctcagtagcagcttggaagcagatttggaatggtttactattttggctgctcttggggactgcgagaagcagagagaatgagagaccagtggcaactgcctgcacagcagagataaccctcttcccttgcttcctttaatagttaaatagactttgtataccacctgaccagcctttgtgcatttatcctaatcatgcatgaccgttaaccttttgcttagtccttaccatatgtaataggcagctgttaaattcaccaacagataccctgatttttcatcttacgtgaccaagaaaccacgttaggggaaatgaaaaaagcaagccacaataccatgattccttccattttcaacagtagatgaaggaaatgatactgaatgagtcacagtgttccctggcaagtaagctgtttgcattgagaaaggagtgagctggtgaggttaccaccctgaattgagctcca

SEQ ID NO: 109320 - DNA, 1008 bp, Homo sapiens
gaaactactgggataagcttctccttgacaatggaaaggcagcagtcttcaacatttggttgcaaatctccatccacatcagggagctttccccaggcaaatacaaaccgccccgtggcctgcaggcctgcaggggaggcagcaaagggacctggcagttgcaacacagtaagtcaggaattcaagcgtgaacccatattgataagtgggccagaattatttaggggcctggcttgctgctctccatttcctgtatcgctaatttatcatttttccaaccttggtattttatattatttagagaaaatgctgggtcactctctttgcctaaggtgactcaaacagccaaacgaaacttccgttgcctcccagccctctgtatccacctggttttgttctttccctgtgagcatttgtggttatagcttcccatatgccacattcaccggccacctcctcgccgtggaaccctgccctctcccctcctgctgctgtagagttttcccaaagcagtgtccaggagagaatttgagagagtgaagaaattgccttgtagatgtggagggctgcaatctgtcttgatttctccaagcacttaactttctttgactgcactgagaattgctaatgatttcccatgagatttgcttacttttgtatactgtattttccagcattacagaaccttggttattgttttttagccatagaatcttctagtaaaaaatatctgccaccattttagatttaagcatttgcctatggggagacactgaatatgtggatgtgtgtattaatatttggggtggggacagggaagggaatgtggaaaacaaatgctggctgtgagcagtgctgagatggccaggccaggcggctgagtttgcttggaaattcaggacattctgactcctaagagttgcccccacccaccatcaaactgaaatcagcaccaatggtgtcagcactttacagcccatagccaactttctttatttttaacgtagc

SEQ ID NO: 109321 - DNA, 1067 bp, Homo sapiens
gcagacatcactcctgggggtgccctatggtacactggctgctccccagggacctgggaatgctgaatctagccattagggaaattgatttgagatgtttgcatgtgaagcttccctaagcagcactgccaaagctttggaattgtcacccaaggcttcctagactccctagctagctcgagttcgaattgccaatagtccccatggtgccaaattttgggatggttttacagtcttttagaaatgaagacaggaatggccatgtgcttctgagaccccagcacgatgccaggcccaggtctccattaatgcagtgctctgctgctgctccactggcaatttgtactcttaacataggttgggggagggacagctagggaaattttttttaattaattgtatctaaaattctttcatcataggaataaacaacacatatagaaagctccaaagctgttcccaagacctgtattatttattttatatgaccaacttgccccaaggcaattaactctgaattgctgttctaatgtgacatatctgtgtacatatgtacatagtactggtaaccagtggctgcattttattccttgctgtggactgaggtattggcttcttgaatcttgtatatgtcataagaatattatacagagagtgttatagtgaaggatgtaagctggataatttaaaacagaccttatttcatacaagtgtaattattacatcattttgggtaaatggcaaacaggattgcatgagagtgatggcatcatcatttcaattgaatctgaagtgattctaggaaattgattccactgttggattctaggaaattgagtccactgttttcctttgcgtttaatttcctttgtgtttaatttgaccacagaaacttttttgagtagcacctagtaacattgcaaggaacttgtgtatcaaggtgtatcttgattatcctgattttttttgttctctaagttgttgccagatctctcttgcaactgtgtcaatgaaaggtctgtgtttagaaaaggcagcatatcattgtatatttgaaactataggaa

SEQ ID NO: 109322 - DNA, 1874 bp, Homo sapiens
tccaatgatttcagaaattcttttttcctccttttgacccacaactagactgttcataccctaatagttccccaaaattgccttagcatgtcacaccagcatttgtcatccagctctggagaaatgacatgactgttagatactatgcctgtttaattgcctctggattaagtcattgatagctagacttttgagctagttagctgtagaaataatagaatccagtgtttcccaaagtgtgttccaaagaacacaagttccaaagatgctcttctaaatataggattctaggatgaaataagtttggaaaacacataccatcttagaaagttagtgaacatgagcacatcaaaggctctaatttaaatgtcctgtgaggagagaaaaacacaacaaatatctactgtcagttagcccagtgttttccagattaatttgaccacagaaacttttttgagtggcacctagtaacactgcaaggaacttgtgttctaaagaacaccctttgggaaattctggtatattgaaatattgctgtgttttcattcacgatgactcttagtagcagtacaatttgcaacttagaagcatgagcctttcatatatgaagctgacttgttaataaaagcagtgttaagaagtagtatgacttaatatgaccaacagcagcctcatattgatagcagaacaatcctacttaaagctctaaacatcatccccccctttttttttttaacggaatctcgctctgtcacccaggctggaatgccgtggcgcaatgtcaggtcactgcaagctccgcctcccaggttcacaccattctcctgcctcagcctcctgagcagctgggactacaggcggcctccaccacacctggctaattttttgtatttttagtagagacggggtttcaccatgttagccaggatggtcttgatatcctgaccttgtaatccaccagccttggcctcccaaagtgctgggattacaggtgtgagccactgcacccggccatccctttcttttatatgaataatgagcaagagccctgccatagctaaatatgtctcaaattcattccaagatctttccattgcttttttgcagttacctttgctttttgggttgaatcaaaatgaatatttttatatttcattactatatgatatttaaaaatatacagaaaatcacagaaaaggaaaaacagaaatttgattttaattcacttttgaaattttaacgatttttaaaactaatgatctgttatataataactgaaatgtaaactattaacagttatttactttctttcctttattgtcctctctggattcagtgaaataatttgaaatcaattagagctcataccttctaaaactcctgtcccatatcatcccacctttcatgttttatgtacatagttaagtttggcatgttatctcttgcctaaaatgtgaggccttcctgtagttccacagtagttactcttggctgcagaaataggtttgggaagctatgagagattaccccaaagtcatggatgaaacaaatctagtcgaaaacatggtacagagtgaattaaggcaaaagtcattaacttaaaattacatccaatatttaggaatagctcatcctctgcacattatccaaaatattttaaaaaactaaaagtaagatctcttaggctaggtggcggattgcaaagggcagggggcagttgataccatgaagcttccaatagatgcatttctaaacattttttctaatatgtaaatttgctgatccttagtaatgttaatgctttgtctatttgttatttttaccactgttgaacagcaaactgttgaggctagggttgattattgataattttt

SEQ ID NO: 109323 - DNA, 2509 bp, Homo sapiens
gtagatttattttttaacccatcattacccatctctttctgtccctatcatatctgcacctaggatagaattatatttaacagtaaactgttaatttaggtagagtaggataactactacaaaataatcaaaggatatgttttaaccttggtcttgatgtaagaagctaaaatagatttttggttattggtttctatttgcttacagttaaatgaagtagattcaagtcaggattttttgttttactctggagattctgttctcctactctttctccttgagtagatagtcagatgtcttttgaaaatgtgttttcggtgtggaatattaacccaatctttgataactcttccagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaatt

SEQ ID NO: 109324 - DNA, 1012 bp, Homo sapiens
atccttgtttcctgactgcccagttattcctttacttcaccaccttttatcatattggactcatactcagctaaactgtaaggtctgtttaggctgctgttaaaatggccccccatcctgcccttgtgcagctggtttttcgaactctgacataggacaataaatgtgttcccatcaaatttcatcttgctgtctttagctttttctcacctgttaaaaccttttggattgtaattacatcttttaatgaatttgtcattttttttcctgcctacaaaattgaataagcccacgttctttaattagaaatatgaaatgagaaaaggctaaagataggcctgtgatttttttccccagtttgacaaagatgctccagtcaaccttagaacatcagcaggaggacaagtctctggcacttttgtggaacactattcccagagtccagcacaagcccaagaaatgtttcttgaacaaatgactgcatgaaaaatacactggctatgatggatcagccaatttttaagccatctagctactattattactcacattttcccattttgttcagaaggactttaagtgtccagctctctttacagagaagcttgattcttaggtgttacctgcgagttaccttgatcttctattgaagaaccctattgaaaatggggcttaggatagtcaaacagagcattctcagtgaatctcttctagctcctgatggtcattgtgtttgtgtcataagtgttcactaatgtttacagagtctcagcaacttattcagggttatttggaatacagatgcattaacattagtcccttcaggaatttctccattgccaaaaagtgaacttgttggagaggacttgttgaaaactgggtgagcatgatttgcatggaaattggactaaacttccctttctttaaagttcctggtttagccactcgaatagctggcattacaggcatgcaccagtatgcctggctaatttttgtgtttttagtagagatg

SEQ ID NO: 109325 - DNA, 1849 bp, Homo sapiens
gcccctgtattacagggttattctttatctactgcatctttgaagattgctttgtttcttttttttgtttcttttttttgagacattgtcttggtctgtcacccaggctggagtgcagtggcgtgatctggctcactgcaacttccacctcctgggtttgatatgcatgcctcagcctcccaagtagctgggattacaggcgtgcgccaccatgcctggctaatttttgtatttttagtagagatggggtttcaccatgttggcgaggctggtcttgaactccttatctcaggtgatctacccgcctcagcctcccaaagtgctggaattacaggtgtgagccactggctggcccaggttgctttgtttctgttatttttttgaaaagggcaaagatgctgtggcctaacttgaaggcttttgtttgtttggcatctaaaaaaaaatttagtgtattttaaaaatctaatgtgaaaaatttatcctttatttattaaagcttgtgctgtgagtgtggtgttccgataagtccaaatcctgccaatatttgtgtggcctgtttgcgaagtaaagtggacatcagccaaggtattccgaaacaagtctcgatttcgttctgcaaacaatgtcaaaggtacagtgcggtacaattttgctctttttaaagttggaatttacatttagagaaccaccgagatatgctgagattacacgaaggtatatggagtaaagtgcatgcaattaaggtttaaattttctgttggtgtcgccaaagattttagaatttgcaattttatagtgtacttttctagtgtgtccttctaatctggtaaagatagtgtaaatgtatttgaatctgttcttctgttaaaggatctaatagatttgatgtatatagttaataggagttgatgtttgtaagggtgagagcagattattgaggacatattgttattatgaggtttttttttctttagttattagaagccatgtatgataaaaagcttatgtttggagtaatttagtaatatgttttaaaaactcataacattcacgtgtaattaaaataactattgttgatggaaaagaagctcaataaattatatctggaatggtctgaaataaagattggatttgaaggaagaagacttcttctgaatgttaatgtttcattcctcttgattttctttgtcagcataaacaacttacatctattaggccattgagtaacacaaaactgcctaatgagtgtaaaagtgtatgcctgttatttccaaaatggattaagacgctaactttttgagtgtgtatctctagaggggtggttcatggactcctttgagaatttgaaaactgtatctcttccccaaaatatttacatacatgtatatatatgtgtgtgtgtgtgtatatatgtaaaaatatatatgtgtgtgtgtgtatatatacatatatatacacaaacacatgaaactgtgtactgtttcagggagtttacagtgtataagcttagcaagtgtgaggcttaatcttttataaatatttgctattaaaagcctggtggagttagaaaagtactgataaagaactaaacagacttagtttgtcttggcttcctcacaaactagctgtttgaaactcttagctgtttatcatctctgggcctcaatttcctcatcagaatgaagggttttattaggtgatatgtgaagccctttctaactctaaacgtttactcataggccaggcttggtggctcacgcctgtaatccaagcacttgaggaggctgaggcgggtggatcacctgaggtcaggagttcgagaccagactggccaacatggtgaaac

SEQ ID NO: 109326 - DNA, 1058 bp, Homo sapiens
tgtctctactaaaaatacaaaaattagccaggcgtggtggggcacgcatgtaatcctagctactcgagaggcaggagaatcgcttgaacccgagaggcagaggttgcagtgagccgagatcatacactgcactccatcctgggggatggagcgagactctgtctcaaaagaaaaaaggaaaaaaaaatacgaaataaatatgtacttataaacaaagggagacctgtgtaatgtttttgattgaaccttgaaaagtgaaagtcaaaactttctgttatgtaacaagtatggcaaaaagacattcacataacatgtttggaagtattttatatttagcaagcatttattgaacacctactataagatgtatgtggcatagtgctaagtcctgggtaggcaggactaaaaaccttaaagcacatatgtaagagatttaagttttgttttagtctggttttacccaagattttaaatgttgttttacaatttacaatttgaaaaggacttgaaatgtagatgaatagactgaactattgctgatttatagtgttgtgaggtactaatgtaccttttttttgtgaaaaataagcagttctcaggcattttagaagtacataataaaccattttaatgccattttgagatgattctcacctgtttttcagagcatagctttaagagactcttggacattttagtggtgatttggtgattaaagtaataagatcactttagtaggttatttcagattgactttctcagtcagaattttacctttttaattaaagctgctagtctagttgaaagttttggaaccattaaaatatgtttgagttaagtgcttcatatcatccttgggttttattatgcctggttaataatttgggttatatctgtgtattcagatggaaatttctgtgtttcctgacagatgttggatttcagtatgttatcttctcttttaggtattttcaaccaccaggaacttggatacagtgtgctttagaatccagggaacttcttgctttgtgcttgaaaaaaatcaaagcccctctgag

SEQ ID NO: 109327 - DNA, 1881 bp, Homo sapiens
ttggaattgatagtttggagggtttgcagttactggtaatagaggcatatgagtgactgagataggaaggtggataatattttgggagaagaagaactcaaagaatggagtgagaggtcagggtattgtggggatcacctgtgtggatattgaaatcgctaggtattaatattgttggaaagtgtgatggtgagccagaagctaaaatcttttgagaaatgaaaacaagtgatacaaagatgaatagattactataaaaaagagagttgcgggtggtagagtctaatgactttagacttagagctgggtatatttgaggaggagacaaggagaatggtctgtaattagcaatgaagagcaaggacgatagctgtctggtgcctggtccagtgataggaagaatcagttatcactttatatagctgcaggggagagagaaatcaggagatctagaaggtgaagggaatgttcagcaaagttgaggatttaggagatttcattgttaatgaatgttgagctccggagggcacagtagaagggttttaggattcggggaggagtgttagatggggacagaatagggaatatgcataaccatatggaaattggagtatgggaaataggggtgactgaggtgtctgggactatggtaaagaaagaaagggactaataaagttgattagtcatggttgtctgaggacacatagtgcagtggttgtgttggggaatgccgagcaggatgtcaaggagactctccattcctgcaggtggaggttggagcttgaggggaagatcagtcttattcagtgcctttggggctttttttttttttttttttttaaccactgctgatggagattgaaggaataggaatctgcctatcaccctgtgtacctggcatcacttgttaactactaggctttgttttagggaggccagctatatgaggagggttttactctggtgtgttgaatctttgcatctacactaaaagtggccagtctactttttaccagacagtgcttgataaaagtataatctgctgctgatacctctcaaatctgttaactgcagcccaaatttttttatagatctccagaccaattgtatcttactgttcactgaaaagtcctcttgggtatctcacagatactgtcttaaactgaaatgtctgaaatcaaatgtaacatctttttctcattatatccattgtttatttcggtataggtagtcacaaaaagtgtactgcctagttgtctaagcaaatacttgagcatcattctggagtctgttctcttcctcttttccatatccagttaccattaaatcttacagattttttttctgcatcacttggactgtgcagataaatcttacagatttttatctcctaactagcccttgcatctgcttttgttatttccagtgcctctcagttcagatcatctacaatctggcccaggttattacagcagcctccattcttgttctcccacccaccccttctccccaaacacccattctggccattcttgagttatattcagatcttcacatatagcaaactgttttggcctatgcagatgctgcagatttagtagtgagttatagttgtggatttagtattcagtgcatgcaacttctctaatcaatgtcacttcttaaaaaaagtcacagaatatagagagaataatccaagtggaaacttttgttcatgaggttactaataaataatgaggtcacaaggtctttgctttcctccaaaaaatataatttccttttaaaggacaatgtactttttttttttttttaagggaaaagaatttttttcctatgcaaatactttaatttttgcttaaattatatcagttgcattaatat

SEQ ID NO: 109328 - DNA, 1074 bp, Homo sapiens
ctctactaaaaatacaaaagttagctggacgtggtggtgtgtgctacttgggaggctgaggtggagaatcacttgagcccaggaggcagaagttgcagtgaaccaagatcgtgccactgtactccaggctgggcaacaggcagagtgagaccctgtctcaaaaaaaattatatatatatatatatatgtaaaatatacacagaatattctcacaaccacttcagctaaaggaaaatttgaaatgctaatctaataaatcttaggaattaaatctgtataccgttcttgaaatagtataacttgtttttatgactttaaatttgaggacatttgattgatgtcctcaaagcattaatggaaaaagttttaaattaaatattaaaggttcttctttaaagaaaatatttgttattaaacaaaaccaaaagaatgaaggagtgtaattgttttatcaggtgatgaatggtgctatccttcaacaagtgtttgtggtggattatgttgttcagtcccaaatgtgtggagattgccatagagtagaagctaaggatttctggaaggctgtgattcaagtgaggcaaaaggtaatgagagaagatgatgagtgagtcctacatcttatatttcgtctttgttaattataacttttccttctttctaaatccagggatagtctgggtccctgaagcattcacctttggaaatagatcattattacattttagataatctttaaagattgttattgtttgaaaaatcagtatgctctatctgtagatagtatgtgtgtcctatacctataaatggcttttttgtggggcatttattgatcaaataatttatattttagactttgcataaaaaaactttctactatctggaacagttaattctgaaatatggaatgcatcagaatacacttcgtatcaaagagattcatggtgagttaaaactcaaaagcatttgaaattatgtcagatttttatttcaacatacctaagtaatcttatatttactgataatatctggattagtactgtccaaaagaactttctgttaggaaaaaaaaaaaaa

SEQ ID NO: 109329 - DNA, 1466 bp, Homo sapiens
ctacttttatctattatgttagttttttcaaaaaactatttttagttttaaacaatctttttattaattttgtttttaacactaattccctcaactctatttagttctgttttgttttaattaattgaaagcttagtttatttttaatttctaatacatatatttaagatcataaattttcttctgagtactataatgggtctgtagctggtacttatagctacctttttccactgcccattgcatattttatttgccctcagcaagcacctcagctgtttcattcttttgggtacatacttaggtgtggaattaccaagtcatatggtaaatttatgtttatatataaaaaactaccaaactgcttcaaagtggctgtaccattttacattcctgccgccaatatttctctgtatcctcctcaacacttgttcttatatttttgtttatagccattctagagggtggtatgaagtggtatctcattgtggttttaatttccattttgctaatgactaacgatgttgagcatattctggatacaagtctcttactgcatatatggtttgcacatattttctcctagtgtgtaggagaaaattcacactctatattcttaatggtgtcctttgaattgcaaaagttttaaattttgttgaagtccagtttatcaagttttttcttttaattgtggttttggggttatgcttaaaaactgtttgtctaatcaaggtcacaaagattttctcctatagtttctttcaagtgttttatagttttaggtcttatatatttaggtctaactcttgagttaatttttgtgcagagtgtgagataagtgtctaaattcatatttttctatgtggatattcttcatcccagtgaaaactctgtcctttcctcagtgaatgccttgggtcttctgtcaaagatctattgactgtaaatgtaatggtttatttctagaatctgaagtctgctcccattgatctatatatctatccttatattagtaccatgctatcttgcatacttactaaagttagtgagttttgacattaaatgtgtaatgttcattttcttcaaaattgttttggctattctgggtaattttagtattggctgttttggtaattatatttagttatttgcaagaatatctttaatatttctcagctaggtaggtttgcttttggctattcctttcttgatttctagtgctactgttttatgatgagataatgttgtctttagtaatttctactgtttaggatttattgaaattctttttctttttaaaatcttaatacatgatttttaaatgaatgttttatgaatgtttgataaaatatgtattctttcttagaactgtgttctataatctcagttaactcgaccttgatagttggttattcaagttctgtgaattgttactattttttgtcaatatgattattttggttttg

SEQ ID NO: 109330 - DNA, 1623 bp, Homo sapiens
ttttattttcatttgctgatttattttgtctgtctttttgccaaagaagtcttaagtgatatctctaatctgttgtgactacaatagagttttctaataatttgattttgtttaaaacagatgtaatttataatatagtcatgttagtagaggagaatcctattttgcataattattttcatagggctttttttttttttttaagatggtctggatttttattattcctcaaaacaacatgctcagaagatggtcgaatttcttcagtgtacagttccctgtaggtatgttctgaaccttgaatgtgactaaatctaaggacttgggaatggatgcggatcacatatattcttcaggctcagacaacttctctttatttaaaatcgtagtagaaatacttacacaatcaggaagcatatattgggttaaccacccactcacagaggtggtaggacttgtgctccaaagatcgggaaattttcatagctggagtttatattgaaaggtactattagtgtgaacaaagatttgcagtgggcgttagtatggcttttaataatgctatatagaaagtagattggtctgagccaacagcatgttctagaggtttggtggaaaaggttcaaaataggtagggcttagttagaatggtgaaggttttgacatgcaagtgcaggacagtaggttttaccagaggaggcatcatgaagccattttagaccttggacaatgatggtttgatttaatgaaaattgatattcctgagtccatacaggttaatgatctttgtctttatattactactaacttttttcttaatagatacaaagcatcacaaagactgatctctcaagatatccatagtaacacatacaattacaaaagcactttttctgtggaaattgttccaatatgcaaggtacttttctttttcatttaatccatatctgtaaaagagtacaagtaattaattggcttatatgtaatttgtagctcctggttttcctctagggttggttaaaaatttagaataagttccttaagtgacttctaacacattcagccatgttaaaagatatatatttttaaaaaagtcatgcttataattatgaattgacatgccttttattttggtgtattaaaatgaaaagacctggttatagttgataaaagtccgtattctttgaaatttgtgatcctatgagcctgtatcatatagttcagtgaaattgaataaaagaaatgacattaaaatcaatattagtgagccactttgtggaatatgtacaaacaaaattttggcaagaaatgaaagaatattgtgataatgtgaaaatgagatcatagaatcatttttatgattttaaaacataagctgaataaaacatttaaaatgtagattatttcatttaattgtactaagataaaactctgcttcagaaaaatatgaattaaaattcaataaatagttattgagtatctatagtatagaaggctgtgtactgaggattgtataactacaggtctctgccatgtaagaatttatatgtcagtattaaatcactaagaatgataactgccattattgtgaccattctacataaagttaatctagatacttta

SEQ ID NO: 109331 - DNA, 1011 bp, Homo sapiens
gacattctttacctatctggtagaactaggctttatttcccataaactaagcagctaaggtgacagatacgtttctaaaataaagtgccagcacgtgaaacagctgtaccactgattggctctgatcttacttaagaggcacttagccctgtggcattctggttatagtaactatttaagatatgtttgacatctgatatatttttcttgtgctttgagaagtttgggattggtttataggagtaattgatgaccctaaggagtgagttgacactagttctgttgacctgccacttcccagttggtatctaccagtttattcttagttaatacatttgataattgaaatatataatttttcttatgtttttgtgttctatccttatttttagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaaggtaagctacatcctgcctgccagtgtatttttttttcccctcagttattattgtttcagtccctcttttaaaaaaaatttgttggtgtttccacagtatggaatccaaacttagcaccacattaggaaaaaaattctttttttttttgtctttttaatatgtggtcattgtggaaattgttagacttagactgttaagttaatttattctcttttgtgtaggaaaaatcttttaaatgtttattccattatatttaaaaaaggcatttctttgctttatttttatagaggaggacctttatttttgtagtggttatcttgacttttaaaaagtcatcaccaaatactaaatacttcagtgtgcatctctcacacacaggaatatttttctacataatgaaaatgttgttaccatacctataaaacatacagtctacacagtattctgctcttatccatggggatacattccaa

SEQ ID NO: 109332 - DNA, 1023 bp, Homo sapiens
tgtgtcaagcaagagtttgcttggaatacgttcttgctttaagattcccctaccttttcagttattttgttcactctgcctatgttggcccatcttcctgtgaaaacatttcttttgaaaattctacatatatatatttttagggacattattaatgttttataaaagtcttgaataaaatcttagaaaaagtcaatgatttatttttatgaattgtttgtgagtctttctatactcatgattcagtaatttgttaattttgacagtgtttcatacatcagaaaaatacaaaaaattttctgtctttaaaaattagaaaaccaaaaatcaatattgtatttaacttttctctgagatgcttttagagttatgtttagattattgaagagtacattttctttcctcttaagcataccctcggggaagtctgggtacagaagacatctgaaatgaatacagataaacagtatttttgtcgtactcatttgggacatcttctaaatcccggagacctggtgttagggtttgtattatttcatattttaaactgccaattaggattgcaaattttctttgggaaccagcaaaactacctaaaaatactaacattgtttattctaaaaagatcgaagggttcttaggagccttataactcattttattgttgataactaaattaaactgggttggacagaagcccatagttactccattttggttataatcttaaagagtaatttgttgtaagattttgttaattgagccttgaagttatatggttgtatccatatttagaactgcttttgcagattgggtcttttttattgtgcagttgctactgctcagataactcacttttaagatatgacaactatatatatacaaagggcttgtaaaggcatagatcagttctttctgaatcagagtttttcagtgagtgtgtgattaaaccctcaaatattgcttttgcttttaggatttcagtttcttttactacagaatgaggtgttttttttttgtttg

SEQ ID NO: 109333 - DNA, 1272 bp, Homo sapiens
taagtctaaataggtatttctaacaaggtcataagaggagatcatggcaatcttacaatattttgtattttgtaaaattattttcattctataatttattaaacaagcgttctaagatacattgttgtgaaagttatatatagttctgtaaatgcttattggtgggtataagagaaaaaaagtatctacttgtgatattcagaatgatttatatgaatggtagctgaaaactgaagtttgagttaaaagaaaactacagtttttgttattaagaaaaacagtattcagtcactgaaaaattttagcaaattttaacaattgtacaaataatgcttgaatccattctcataaaaagttaaatacatggagaaaaattttaaaagtcctcttgacactgtctctccatcccttctcctttctcctgaggtgtaaccagtgtcattagtttggtcattttttagctttattgaattttgtggcctcactgtatagttcccattctttgtaactttacaaatatttatcttgcaggtattaatcaagaagagctatgaccggaccaaacgtcagcgtcgtagaaactggaaattgaaagagcttgcaagagagagagaaaacatggatacagatgatgaaaggtctcgcttttctttaaatctcttatgttgtctcaaaggaaatatttatgataaatactttttatgttgtaaagaaataggcatcacacaattgatccttgcactcaattataatcttggattcttatcaaggtattaatggaatcagtataagatgatgtaaagacatttaacacagatttagtaattatttcctggtttatgacctaataattgtagtgttaatgtaaacaattcatttgaaaagttaaaatataatcatactttgcttaacaatgggcataccttctgagaaatgcatcattaggtgattttgttgtgtgagcatcatagaatatgtggcacatgactttataataaataattacattatgaatatcacaaatagcagatgagtacttatggcttgagataaaaaggaaacagctcattgatgccaagtgtgttattcctcaaataatttaagcagaaatgaagacagtgttctaaaacagtttattggatgattcaaaaagtggctttaatgatggtgaagacaccgatgtctaaaaaaactgagagtttatataaaattgtttcatgaaatgtgagttggaaacagcagtatgtctacatagtccttaaaatgaaagtc

SEQ ID NO: 109334 - DNA, 1966 bp, Homo sapiens
aagtcatttgttctgtatataagtatagttcctagtatgaatattttggtatcttaagctttgattctcataaatgtctttaattgttttttcaactactctagtcacacttctacaaaaaaacttgcaaaacaataaataaaacttaacaaaatactgttttgtatattacagttagtattatttgcattctagcttgatcccttaagttgctcactcctatagtggtggaagtatattcttacagttactcagttcatttgttcagtgaatgtaatttgaatgactgctgtaagagacaagagcttctgatacaatgtagttacataataataatgataaggtagatatttgtatattttcaaatatatttaatactttgtatacatataaatactttgtatttattttattctctttgtatttttttagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccatacatgggcttaagaagttggacagagttaccttaagtgtctctactatctttgcctccagatttcaagaggagaaatttagttttaaacctgaataaacatgtttgttttcagtgctcactcaaaccactaaaacagatggatagctttgaggttttagataaggaaagattatggagaatgtagttgttattgatttttggcaattttacatttggaattttatcactgtgcttttttatatgaggcactgtagtattttcacatagtatagtactctggatgtaaaagctcaaaaattgtgattccttgaacgttcactaaatcttcaagcaaaaacacatttttacattatttttacgttgattattttagtgaaagaccatatgaagaagcatttttaatattaacttgttacatactttgatccactttacatcatttttatgttgttgaggtagggaaattagggttcagtttatcactggacattcaggaggcaagtcaatcttttttatttccttataaaattaactcttcaaaagccgttaaacagagagttatcttaatttttattgcagtaggaggaaatatatttaaaatatttgtagatttatagcaaatagagactcgttatttaaaggttaaataacaatttgttcttttgttgtttttgccagtttagggcagtagctgcttttgtcataaatatcttcctaccacatcaaaaatgctgcttttaaaatttttgtttataaattgagaaggaattttctctctataagtttctgtcattgaacagatcaccattaaaaagaatattagaatccagcatgaagataatggctaataaaaatgaggtacatactttataaaaccattaatcagatttgaatgaggaatgcttcccacatccttgaaagaaaaactgtggcttacgttttgaagtattctgagaatgaagtattaagatccaatttctataagcaagatcagacttgttaagtatgccgcaagtaagagctaattcattcattccatgtgtgccactaaataaagagattgagcaagtgccactgtgtggaacatttttcttttttttaatattggactttccaattttgaaattatggataaagtcctaaattttctatagtggcttcttttctgtctgcatattttgttaaaattgtggatctaaaagccatatcctgtctttggtggtggcctggtaggaatggcttgtcctagttcttcaaaggtaagattgaccaaagcaagttctcattggtggtctgtgtttacatcttccgtgtcaagatattttaaagcatgaaaataaagccattcttgccctttttcgtgtgtttgaaatggtcg

SEQ ID NO: 109335 - DNA, 1032 bp, Homo sapiens
tcctcaacatttaagagtaaaatgcagacatgatgcttctttatcctttaaatatttcagcattccccccccgctcaaaaaacaaggaattctcgaatcacagtgtagtgatcactatcagaaaattaacattgacacaaaactgttatctaattgataggccgtattaagatgtcagtaatctcaataaagtccttcataaaaatagtaaatctaagattctgtgttgtgttaggttttcatatctcttcagtcttctttaatctggactagttctgagtgtaatgttttatgtaattgacatttttgaagagtccaagccagttgttttgtagagtgacctcagtttgggtttgtctgatgttttctcaagattaattttaggttatgtccttttggcaggactatgccaggagtgatgccaaattctcaatgcatagtatcaggaagcgtgtgctgttgattagtccagatgttcccaaacttggttatttgttggttttctgttgtaaggaagagctatctcttttttcatatatttgcttattcagttgtttttcatgtcattgtggactcttgaatttttactttaatacagtgggatctagccctttgcaatagttatttttacttgattttttaaaaatttattttcagtgtacagtgaaatttctctttgatgtacagatctatgacttttaacacatagatcatgtaattaccacagtcgaattatagaacagttctatcacatccaccccaaaaaaattccatgttttttttttgttttgttttgttttcaaatcctcccatccctaacccctggcaacttctgatctgttttctaacttcatagtttgctttgtccaaaatatataaatgaaatcatgcagtatgtagccttttaagtctggtttctttcactcagcatggtgcacttgagattcatctaaggtgttgtgttcaaagtgggttcctttttgttactgagtaatgcattatcaatatcacagtttattcattcctatgttg

SEQ ID NO: 109336 - DNA, 1049 bp, Homo sapiens
aataaaacttgtgatttatttggaccaactgcattaggaattaacagtggtgatttaattccagtaatgcttgacctcttcttctgcattttgtctgtttcttcaagctgtgcccctgctataagtgactgataatcactaattctaaacttgcttaaagagtataaaaggggctgtgtgcagtggctcatgcctgtaatcccagcacttcaggaggctgagatgggtggatcgagaccagcctaaccaacgtagtgaaaccccgtctcttctaaaaatacaaaattagcctggtgaggtggcgcatgcctgtaatcccagctactttggaggctaaggcaggagaatcgcttgaacctgggaggcggaggttgcagtaccggagattgtgccattgcactccagcctgggcaacaagagtaaaactccatctcaaaaaaaaaagagtataaaagggtacatgtcacctgaaatctcaatagaattttatttgtcaccacataattttgtaagactttcaaaatatttcctgaattattaccacatgattgaaaagtccagacaactggctggctcattttttgactgactgacttacctttacaagtgttttgaggggaccttgcaattgtaaagtgatgagtttgttggtcaattaattaattattttaacacgtttattgagtatctattctgtcatgctctgttctagctgttgggaatagagcagtgtataatacggaaacctgccctcgtttaggggagacagataaatagaaaacaaaggaaagaaagtaactggtgatttgagcatgagaagtactgtggagaaaaatcagggaagggcatgtaggctgcttgtttgggaaagcaagtaggaaaaacatttcagttttgaatattgttgtatggaaaggcattgctgagaaaatgacattagagctgtcaacctaaataacagagaggctttctaagagaaaatggtatttatttgggaagagagcattgcaatgggaatataactgccatggtaaactatgtgtgcattc

SEQ ID NO: 109337 - DNA, 1027 bp, Homo sapiens
ggatagccttagtgacatctggtgattttgtaacctgaagtcaatttatcaagtcaagtagattttcctgggtaggaaatattattttctttttcattcacttgttgaacagagtcttcgagttatttggaatttctactaagttttgtggtttttttaaatagcaattttaaactctatagcttcccatagattgttccataatgctaaaatttataacttaatccactcaatatataacatttggccataagaaaatgatatgtaagttatgatacttagtgaaagtttttggaataaatagttctgggcacatctgtcctctctacaaagtaagagaaaacttgtttttcttctaacttgaacatatgctgtgtttttttttttatggtgaaaagatatatatatatatatattcagaattaggcagctggactcagtttagatgatcccaattttgttggcaacatccaaagcatcgtaatcaggagccagtcgaacatatgccttcttctctccatcaggccgaatcaggatgttgaccttggccacatcaatgtcatagagcttcttcacagcctgtttaatctggtgcttgttggctttaacatccacaatgaacacaagtgtgttgttgtcttctatcttcttcatggcagactcagtggtcagcggaaacttgatgatagcatagtggtcaagcttgtttctcctgggagcgctcttccgaggatatttgggctgtctccggagtcgcagtgtcttcggccgccggaaggtgggtgacgtgcggatcttcttctttttgtggctgtggacacctttcaacactgccttcttggcctttaaagccttcgctttggcttcagctttaggaggggcaggagcttccttcttcgctttcggcgccatgttgtgaaaagggtccatatgctgtgttttaaggtagatttttatttaaatgcaaaaccttgttattttaaatatcaaatgaaatcttatttgcttttatcttctcttatgcatt

SEQ ID NO: 109338 - DNA, 1046 bp, Homo sapiens
aatctctcagtaaatctgccttcttctttggtggccttgacccttgacctgtactctatcctctttaaggatctttaaacatttaaagatttaagacatctttaaggataatctctggatccatattagtaaatgtatgttctcctaagtctattgaagaatttattattcatttatttctccctacaaataaatatcacttgatgtatttcttctacaaagagcaaaatgaactgggtacaaaattaactttaactggtgttaaatatattgaattttcaaatttttcttggtatttaagaaagttgtatcctaatcatgagcactgtatttgtctacttgacaatatattaccctaatatttaagggttttattttttaagagactgaaaaaatatgatacttaaatgtattcacagtgtgtatctgtgactttcccaagatgattgaaccaatatttcaagtaaaaatatgaattaggtttatgaacatttaaagggacagtcttactattttattaagaccaataaagaaaataaaacttgattaacaacagtatgtagccataaaactttcaatttgttagttacaaagttacaatgaatagttcattcaaaaatcttaatgggatgtactattaaattggtcttcactataagttattactttgaggattaatatttagaataacctccttgaaaattttagtgactatgttaaaatttggttacatgatatatcattcaattaattaactccagagagataaagtttcttttattgtagaagtagtcccttttgaaagcaatgaaatttagtttataactaaattaaattcataccatatttgcttgaaatataaactcagcatactaatgacagacatgttgaagatacctgatgttaacaggtttaaatgtggcattgctatcatgttgatagatagtaaattctgtctgtacaatagctgatgatatctggcaattcacttatactaaaaattaggcatatttctctccagtaacgtgaaagtgcaaacatccttt

SEQ ID NO: 109339 - DNA, 1056 bp, Homo sapiens
aataacagacacttcaaaagagtgtttttatatgaatgaataagagaatacatggacagacaaatctgccattcattaagtcactgttttctctgacttgtttaaatctaccacacgctctaaatttgaacagagatagcctttgaataaagtacacagtttttaccccatcaaattctctgaaataatagcaatcttgcatctacaagaataaacaaccatcttcccctaaaaaaatatgctgaaaagaacagaaaagaaactataaagaaaataaaaccttctcagggctctaaatctttacctcattatccggtatgttccctttaactatcatatactatgaacccccacaacccacccccaatcccagccttacccatacctcaaccactatttgtcatttgaatcaacccattttactttcttttaagtactacacagtgtttaaaattattttgctactgttactatttatatatttattttgccttagtaatttgtctcccctccttacaactaaattacaagctccatcagagcatagattatgagatgcctatgaaaactttacctaaagtcctagaaaatattccagaatattggagataataagtgataaatgaattaagaaataaaggaaggaatcatcatgataaataaacatagcccccaaaaatatttaagtactttttacataacaggcataaatgagtgttaaataatatttaagaaagctttcatatattcttgctgttggagcactgcaaactcatttgcatttcaatgcaagttttctatagactcaatagaatttgcattgtaaatatgcagctattttttaggagaattacaaccatatttaataatgtctagatttgaaatacataggcacaatctatgaaataattgttcattaaataaagtcttactttgaatttgtaaaaatgctggtctaatgcaaataacaccaggtctccttaatgcctcccaatgccaaaccatcttcagagagtttcaccatcaatttaccagattacaactgtagatgaaata

SEQ ID NO: 109340 - DNA, 1040 bp, Homo sapiens
agtgacaaaatttttcgtaactttatttatatataccgaaagttgagtgaataaaataaatattttcttttttaactgagctagtttaatgattgatattaatcactctttctaattgagctattaacatatttaattatataagctcctaatatgaatccacctattttaacgcttgtggaataagttacttttcctgttgctactgcatgttggataaagtgtagacagtgtctaacgatttcaaataatttttgtagtaaccctttgatcatcctcaggtgatgtccttttactagttataatagctactatttagaggctctgtgagttccaggatcaaaataataatttatggtacagttccaagaaaaatattttctattacttaaatatattttcttctcctacttttatagttgttatcagaaatcctaattatattggaaaatgtaaaaaattaggttacatgcggaacgaaagcttgtctcacaataatagattgatcttccaagtctacatgctaattatatgttacctttaatattattgattgaattttttcagtaatttatttgtaactaaggcaagttgaacattgctatagctaagattgtttatgcaaaattgatctttttaatgtctttatagccttcccattattacttgaattatttcctgtaaggggatcacatatgctttttattttattattattattgcatcttacatttagattatatttttcagcctggaagaagattatagagattcaacttgtgttttatcctttgcacagcattatggccttaggaagattgcttagcttcttatttgtcgtgttaatcataaatagaagacaatttttcagaccaaaaatctttccaggttttcttagagacatacacttaggttttaaaaataatgaactggagtgctagtttaattaactgcaaaaagactgttaacatttatgagactcatataagattggaggaactcaatatattgaaatggcctatttcatcaatttatattaa

SEQ ID NO: 109341 - DNA, 1150 bp, Homo sapiens
atctgtattgttaactatactcatctggtaggattactataataaaaaaataaatgtggcaaggatgtagagaaattgaaactcttgtatactattggtgaaaatgtaggatgatacagccactgtaaaagacagtatctgagtttctttgaaaattaaaaatagacttgccatgtgatccagcaatcccactactgagtacatttctattataaaataattgaaatcagactctggaagagatatctgtatccccatgtttattgaagcagcattcacagtggcgataatatggaaacaaaccaaatgcccataaacagacggttaaagaaaatgtagtgtacatacacagtagaatgttgtttagactttagaaaagaaggaaaaatgctgcgatttgtgacaatatagatgaacctagaggatactgtgataagtgaaataagccaaaaacagtgatttaaatgcttttgtttttattgttagagactcacattgacaatctaaggcttgtaaagaagcaccataacattacaggtcagttaatttctatatttactttttgccatcatggctttgatctccagtgtgatctcatttttcagatggttgctgaagctctggcgatcttatctacatattgggtaggaactgaagaggaagggcaaaaagaacatactttccagctaaagcagccatctttaaagggtttttctaaagttctttacaaatgtatgtgaagtgtataaagaaaaattaaataaagtcacaatctttttgtgaccagaattgttatatttatggggtgcaagtatgtttttatattgttatcaaaacactgaaaatgaaaatatttggatgacatcaaaatgctctgccaaagactgatattgcaagaaaaaataaaaatgagcttaagaaacagactgacttgttttgagattaaatagtgacaaaaaatgtcagttttataaaaatatatttcaaaaattatattattttagatggcagagtgatttattgctttattttctttatctcacctatctcatcttaccagttgggacttccatttctgcactggagaatatgtttaaacatatgtatatataaaattgaatttaaatttaatggtatataaatttttata

SEQ ID NO: 109342 - DNA, 1043 bp, Homo sapiens
ctataaagaaatatgtaagactgggtaatttataaagaaaagaggtttaattggctcacagttccacaagctgtacaggaagaatgatggcttctggaaaggatgcagaaaattttcagtcatggtgcaaagtgaaggggaagcaggcacgtcctacatggatggagcaggaggaagagagaacaaggggcaagtgccacacatttttaaataaccagattttgtgtgaactcactcactatacagtaccaagggggatgttactaaatcagttacaagaacttcactcccatgatccagtcacctcccaccaggcctcacttccaacactggggattacaatttcacatgagatttgggtgggcacacagatccaaacaatattgaagagaataatttttaaaattaaggtaattaatttctggccaatacaaaactaaatttcatagataaattttaacataattttaattatgacatttatgaataatattctaataaatagaactttcctgacattgctgaagaggggtgaaaaactcgatacttagtacaatttcttgttgcagctgtagtcatactggattcaatattctctataatgtaaacagtgtgttttaaaatgagacgatcaagaaaaaaatagggtttattttttgactaaacatacttaatgtaaatgtaaatctgaagcactatttatcaacaccatcttggtgataccttcggactgtaaaagaataaagctaggacaccagttttataaatgtatacatgcatatgtacatgtatacttacataagtttatacatacaggagcctgctgatgtccaacataagattacagtgatgaaaatttcattttatttttaaggagccattcaataaatgtctccacaagtaggaaaaaagaaggatattttgaatcctaggaaaggacagtctgtggtgatcttatggaggtcatctaattaagtattaaaaagtaatataaaataatataaaatatttatatacatacataattttaaaattaaaatata

SEQ ID NO: 109343 - DNA, 2399 bp, Homo sapiens
atttagacaaatgccctcaggttcccgtagaactcatcaacacaatgccaagactgtgaactaaaactcacattcataaattagctttttaagtagcatggtgtttttaatggactccatgtggcttttgagagaacactgacttgtagcataactttgatttttagcttaaacaaaactcagtaggatatgcaatttaaaaatcttctgtgatgtcaagttgatttacacagtttttttttagtacattaagattctgttatacaattgtacttatctttgaattaaaggtacagttacggtttcatcattaattttgtatactcattcatttgataaataaatcaagagcttgtctgggaaagtttcaggtaatatatttcagtctcttaattgcttctttcttattttgtagaactccacaagagcaactttttaaaatgctaccagatacgttcccacatccacatgaaaccactggtgatgcacagtgttctcaaaatgaaaacgatgaagatagtgatggttagttcatacttgattagatatttttaaaatgtattgtctcaagttatatacactaagcattaatcagaatctgcttttggttttctttaatatattattctcagttgtaccatgtaatcttttctctttagatgaaaatcatgtacactcacttctttccctttccctagatatactttgccttgatttagatagtttcatttaaaaattgaatgctaataaatgtgtatttcacttgaactgggaaaattgacagtatttgtatttttgtgtagatacacatgagaacactcttcttttttggtggctatcttatttgaagaaattataaagtaagatatattctttgatgatattatttgtgaatcttatttcctaggtgaggagaccaaagtacaacacacagctcttttattgccagtagaaacattaaacatagagagacctgaaccatctctaaagatagtcgaactggatgatgtaagtgcataagtgcataatgaccattcatgatttttaacagggaattcataatgtatacttacatctgcatattattttcaataagatttctcaaataactaacatagtttaataggaaatttacaagtgtttgggtttaaatatgcttataagaataaaacaatattattctgaatgtaaacagtaaatttgtgagctaaactggtattgtcaatttttttggatgaatatattatgggaggtaagaagacatttcactattttaacttatagatatgtagtttgatattttattagtttagttctctatgttatcaagtttttaaacaaatatcagtctcgttacatggtacctattaaaatataagtgtaaatttagtttcttgaatgtcatttaatattattttccgtttaaatgtagaaatagtgtgtaagacttaagaagttcagtcaaataacttgaacataacttgaacatatgtagaagacaccaatagcatcaactagagccagaccctgtcagagctagagctctggactgaaggtttagggtgtgatacactcagtgcatttctgactttctagtaatatagtagctgaatgtgccacttgtcctagatatttctcttactgtggttgttaagaaaatgactagaatggagaacttacctcttttaaatactgctttcttcctttcttctttaggttgaaagcttctgctatttttgttatttgtgttttttggctaacaacatttttatttctcctctggataaatttgagagactggacaaaaacacacacactacatacatgtgggcatgccattcattacattgttgatacacagcgtaagtttatgatgagccagtcagagaactgacaacttcctagtcactaatctacttggcaggtagtagctacatacttaaatataagttattattgttggattggggtattataatagtgataaagtaattgacatatcaaccaatgtcagttgaatttgtttagttctcctagaacttatgtgttataaaatataattagagctctcataacatcatttgtaggaaaaatgtactccaaatatcacccataagtaagttggttaatgtgtaataaatttttatgaacttactaatattatataacattaatttaataagacttatgaagaggaatttgaagaagcagaaaatattgtgccttacaaagttaaattagctgatgcagacagtcaacgaaggtaaaacctttctaattaactttgtgtgcatattgagccccctcctgacacacacacaaaatcatctgtctttttaaatgtgaaatatgtggtgtgaaaaaacatgtgacattaatgtcagagtatattttactta

SEQ ID NO: 109344 - DNA, 1063 bp, Homo sapiens
atgctcaagtaaacaaagctcaagtgctttaaaaactgtacagctaaagtatgccttctttgtaatctctgttatgtttcaatgtgggagatcattagaggttttaacaaggaattcatcacttactagatccactgaatattttggggtattggtttgcttgcttttcttctttacatttgtggacatttagcttttaaaatttcataaagacctgtaaagtttcctacaaatcaataaagctatctttagtcattgtgaatatcaaggaaatagaattcttcatttgtgtttggacatttcattttattcatttctccacaaaggtcataaatatgataaagctacattttaaaattactgaggatattgtgacattattgatatttatttttcatgttttgcttgtttactgcatgttaacaactgaatttccattttctgaaacaggaacactgtatttcttttcattaaagggagaaatgtgtttagtgattacattttatcttgtttatatatattaaaggtcaagcgagtattactggaaatctggaaaagtgggcaaattggtcaatcaatcatatatgatgtcacaaaataaaggaaatgttgttaaggtaagaagatactatttgattcttatgcattttgctaagcaagaagatattcttttttaggtcttgcattttcttctatactcaggaatatactcttcttattttaacaactttgcatattattcacttgttgatttattttgcagggtaatatgcaactttcattattcaattatgtttttgtttttcagctacaaactgatttcaaaattttaccttgcagtgaattttcccacatcccaaactgaatttttccattcagtgtggatctggtttaaagtatataaaatagaactaaatacttctaaactaaggtgaaagctattgttatttaatataacaaatgagagactttattcctacttttatatcacattagtttaatgttttatattctgcttcaataataatttattattcatatactgttgattccatgtgtaaag

SEQ ID NO: 109345 - DNA, 1092 bp, Homo sapiens
ctagttacgtttacataattctcttaacagtcctatgatttagctatcttacaattgaggaaactgacagagcttagggtacacagctggtaactgctagggcctcagtttaaatttgtgtccagattccatgttctttccactgaactgtactccctctattactgaaaatacgtcttgtttgggatattagttcccaaacaccaatttgagaaacctctccctggtccacaggaaaatgagagaaattagagcaatgtgattgttttttcataaatctaactgtactcattttaaaggatcatggagattattgctgttttagatgtttaaaatactgtctttccacacttgtaaaaaatgtagagtcagtttttttaaaatgacttttaaaagcctaatcaggcaaaacaggttgagaacttgttattgagctgtcttaattgatttaaacgttttatatggaaataatttcaaatttacagaaaatttgcaagcataagaatagtgcaaagaacatctgtatgtcctttaaaattcaactattattcagattttaccctcttcattttattgtttgctttttcatttgtccttccttaagtctcctttactgtggatcatttccatggccaccttggtcgtttatagcattgaatcggatttaaggtatgcattcttggcgagaacactctgttgatggtactatgtcatcatggtatgatattgggggcacacaatgtctgtcttattggtgatgctaattttgatcacctgatcaaggtagtgttcagtttctccaatgtatagttactgtgttttacattgcgattaataagcaacctgtgggagactctcttaagtccatgctaacaacattttcatccaggatttagcatgcattgatgattcttgattattcagtcttcaacttcagcattctttccacatgtaccagttggcaattaatattttattgtaagcaggagccctcctttctcccctgatccatccattcattcatccatctatatccatctcatttttacatctgttattgttataaactcatgctttttaatgtttttttta

SEQ ID NO: 109346 - DNA, 1030 bp, Homo sapiens
ttaacttctatgaaaccacagctggagaccacatctgaatcctccttttggccagttaacttgttccacctataaatgaactgggttgttgaggcactatcattagcagtcctccaacattttattaccagtcagaaccaccagggggcagtaattactagatagtttaaaatgatgcaagactattatatcctaaattggaataaaagttttaataatactaacttgtcttttttttttttctaaaattgattccattgctactgttaatagtataaatcttaaaagggtgaattttttggatgaaattaatgcttattcttttctttttaaacagggcaataaatgtgttcgtaagtgccaaccgactaattcatcaaaccaacttaatacttcagaccttcaaaactgtggcctgaaagttgtatatgttaagagatgtacttctcagtggcagtattgaactgcctttatctgtaaattttaaagtttgactgtataaattatcagtccctcctgaagggatctaatccaggatgttgaatgggattattgccatcttacaccatatttttgtaaaatgtagcttaatcataatctcacactgaagattttgcatcacttttgctattatcattcttttaagaattataagccaaaagaatttacgccttaatgtgtcattatataacattccttaaaagaattgtaaatattggtgtttgtttctgacattttaacttgaaagcgatatgctgcaagataatgtatttaacaatatttggtggcaaatattcaataaatagtttacatctgttaaacatttctttacttgaaaaaatgcatatatatatgtgtgtatatatatatatatatatatatatatgaacagaagaccaagacaacttggtgtaatgtctaaaaaacttctaatgggagcttatcagcagtttatcaaataataaagcaagaatttctatttttgtccttaatcactttggacacagagtagtcaatggaaatatttttg

SEQ ID NO: 109347 - DNA, 1430 bp, Homo sapiens
atatattgatgaattggtagagttgtaatgcttccaagtctgcaatgaatctagtgaagtctcctttccaaaattggtgttctgtgatcccagcctgtgtgttggatttgtgctggtgtttttgtttttaagtgagatttcaaaaatgtgtagaagattttattagattatttggggttttaatatgatgaagcaatgtatattaaatataggggttttaaatttttaatctttccagttggcaagtagatattacctttgcactagttatgacactcattatttaatttaaggtttccttgggaaatgtaatgtcagagtacggttgaacttaagcctcccttttaaatctgttttttttttgtgtgttttttttttttaagatttcatgggatgtccttttgtcccaaattgaaaatatttattctttctttttgtgatactttacttgaagggagccctgctgttgttactggactaagtcaaacgctaatgaattctgctttgcaaccttgtctttcctaattatctggcctttcacctccctcacctgcctttgaccaacattggaaattcttagatgtgatgaatttggcagagagtcgcaggatgttttttattatgtatttattttatcagagtatatgattgaacgaccagagccagaattccaagacctaaacgaaaaggcacgagcacttaaacaaattctcagtaagatcccagatgagatcaatgacagagtgaggtttctgcagacaatcaagtaagcaattatttgttttgtttcttcttttcttaaaagtacttccgaggaactactcatctacattttttaattttggtatgactaacttgaaatgcttatttgaaataaaatctcaaatttttaaataccacattttattaactttatggcgtttggtttcagagtacagcattttttagaatgtttaattttaaaacaacaatgaaatgtgcataaactggaatgtagtttgaactacataaatgatgggaagatataaatgtcagataaatgaatagagaaactggatatatcctagagattggtagtaagatataccaaaataatttttatttcagaaatagcagcagtcattaaggtaagtaacgtactcttaggcatgagtagtgttttctaagactgaccaaatagcctctaaatccttgcctttgggggatataggttaaataagaccaagaatactcatggggccagaaggctggctggtgagcagcagcaagaagggtcatcctagagcagtagttctcagaccagggacactcttctggagtacagtgaagggtgagagggtaggggattgagtgaaaacataatccctacataagtatctttaaactagaaagtctgataattttcttcagcctcagtggataaaaaacaa

SEQ ID NO: 109348 - DNA, 1064 bp, Homo sapiens
acagtgggacgtgatcatgccgctgtgatccagcctgggtaacagagcaagaccctgtctcaaaataaagtaaaaatttaaaagtatttgtaaaagtgtaacttgaaaaggtattctttctattgtttaattatagaacatgagtctaaaaaacgtttttcagtgggaaagtaataccttcaaatatggtgaattaaatatactttgaggatatacagttaagttactcaaaataaatgttttccttgtctttagacttgagctgttcagtgggttatcactagccacatgttgcttttgagcatttaaaaataagactaggtcagatcaagatatgttccaagttaaaatacacacagattttgaagacttcatataagaaaaagaaagtaaactagcttagtaataaatattttataatgattacatgttgaaataatattttggatgtactattaaaataattttacctgtgtctttttacttttttttaaatgtggccgcttaatattacataggtagctcatagttgttgctgatattacatttctgttgtacagccctactctagagacttactgtacatgttgaatgcattctttaatataaaacttttatctggtcctccatcccaaatatatattatggtgcccaaaactttaatttttatttttgcattccttcccatcagtagctcaaataacctgtgttttaggtaaagtattttaatgtttaaatgtggaatacatttatattttaattggagttgaaactataagcccattctgcttgatttcttccatgtcacacaagtttattgataacactcttttctggtagcacaagtcatgtcactaggtatctcatattactttaataatctacattacgtatgttagaatagagcttttttgatttaatattctgtgattcaaggtgagtacatatatatttagtagcttcattaaattgcatcctgccaaatcattgggttaatgaagcaacaccataatcattttctttttttttattgttgttttcttctttgagtgtcagtttggctt

SEQ ID NO: 109349 - DNA, 1552 bp, Homo sapiens
aaaacttaccagctcactctcttagcccctgcagggatttctcaccccagtatataagtactccgctctttgaaggttaccgctttaacctcatcaagaaatcaaataattttttaaaagttactttccatactcagtagcacttaaaacttttggctaccttcttcttgaaacttgtttcgtgatgctggttttctccagttctcctgtagcgatatagcagcctgacttctcccttttgtgcgcaccacagttgtatgttttctgactttccttttataaaacacgtttaatggggtcagagactgtcttgtcttgttcactgctctatatttaataccgtgcctctttgtgaccattgaaatatttattaaataaataattttttttctgtcacacaatgagagctcttcaaggtctgttcttggttttgttttgccatttcttacttgatttttcattgatgataccatgccttctgctgctgtctatattctgcattcattctgtccttttcattttaactgataccactgccttttagccatcctccttttccccaggttttttttattatgaagttttcccaatttattttgaagtggaaaagcagattaccaagtgacttaagtagctaaataggaacagcagggccacaattggtatttatctacttctttttgcttattattttggtcttgtttatttctgacataggtatactgagtctgttaagttttccttgtcgttattcttcctccattctctccatcatgctgtgaccaaagccatctacttaactaagttacataatcaggtaatggtattctttttccccatagaatgaaattcaggaattcgccttttgctctttttgttctgtcaagtcatggagtaggtttcaggtgagaaacaggaaaactctttgatgtttagaactgtcagaaatgggactaaacagtttccgtaggtgttgagttccctttcactggtagcgatatggtggaatactaagcagctttccaatggaacaggttattggagctttttgaagcgtcactgcaggcctttgattgtatctttcagtcttgttaggtcttacacattctggcacagataaatttttaatgattaggaactgcacttcatacctagcagtgttaaacatactctgaacatgttgagtgaataataaattctgggtacttttcttgagtagatgaggtggggttctttatttccacttcaaatttggttttgttatgtgagagtataagatctgtattcagagtcctgggatcaagtcttgggtctctacctgtgtgatcttgggcaagttatttattatctctgagcctgctttacacttgtaaaattagaattgcagttttttaaagcaagttattataggactaaatgcatgtgcaaaatgttttatactatgaaaatgctttacaagtagtagaaattaatcaaaaaatggctttttgtttaatatatgtatgtcactactgttattcacttcatgattaggatcatttttttaaaccat

SEQ ID NO: 109350 - DNA, 1056 bp, Homo sapiens
aagctactctttgtgagagctcactgtggctctcagtctggtgtggggagtggcagatccacgtttcttatctgtctcattctgggacttttgcatagggaatggaattatcacatactgcagtagttatttttagtgaagttatttttttgtttgttttcttcaaacaaatgttcaccatgtctgttgaacttgcatagggtaggagtatcatgtgaagcaggtacgctccctggagtgttaatgccaagtggcagtgtgacatgtcactgtatttctttactgtctctcttccctgccaagactacataccttcaagggtatgtgctgtttgacttttcatcaccatatctccaactaacactgttgctgacttagactgactatgcagaatactgtgttggatactaggaaatagagaaatggatacaacttctctttagggagtttatacttcagtagatacaaggggaaagggttgaaagaccattgtatggacatttagtctttctaatatactaagtacttccatgtgcatcagttcattttacaattttaggttagagctgatagaaaaataaatgattgtttctctaactgccatctggtccctggcactgaaatgggtctccctgtcttattcagtcattctctcttacttcaagatagactggaattcaactgagattgaagttatggaatgacaaaaccctaagatgttacacaccggctgcctcctcagacttatataaggttactacaacagaagccagttgggaatgttaaatgagtcagacctggcctctagacagcaactgcaccctatacgagtttagattgttgctaggctttttttcatttaattccaaagcatttggaatcctttttttttttttattgagaactgcacatctttctctatgtctttatccatattaaaatcggtatttatgcagtactgtcaaaatttgagagatttccaaggttctaccttatttttggtatgctcccttaaaaaataaatcacacttttgcgaagtgaaggttacaggagga

SEQ ID NO: 109351 - DNA, 1019 bp, Homo sapiens
ttgggggtgactcgggttatgccctttgagggaagaggagcactggaagaaggaagagacaaatgttggggtctacggattcagttccagtttaatgatgtggccctctaaggagataattttgccttaaacagaaagacttgaccctcttaggtgtcatacctaaggtatgtttttactcctttactgctttcagagcgctttcattttgggatgctgatgaggaaaccgagggattatatgacgtgcccaaggtcacacacgtagggacagactttctgaatctagttcggttcgagtccagctttagagtagggacgttggttgtgctttttgaaaagggtggaggaagttacaaagtaaatgtattttatatagtatatctaagaagccattgtgagataaaaagttgtttcttgaaccggagtgaaattcctcaataaaggaaagatccttttggaaaaaataaaaatggccagtttcaacttttacagatttttcccctttttttaggggtgtattaaatgatagactctactctcacagttcatttttacgggtaggtaataggatgggagaacaacagttaaacaatatatcccatccttagaagaatattcttttctttttctaccttaggactgtttttactctcattttgtaaaactgataatagtgggattggaattctttcacaaaactacacttttttcaaataatgtagcgttaggagagtttagtgtgcccattactagaaaagaaggtattttgcatttcttggaggtaacatcgtcttttttgagactttacttttcccccattttcttgactctgggctgtatttgtgtgtgtgtctgcaaataataaaattgggctcttgcatatttttatttttcttagcatcaactgtgactttcaattcattcttactttacattgaagaatgaaaaaacagtacacgtatagttcatatcttgcagaaagtagtgcctttatgcaagtcttatcctctataatga

SEQ ID NO: 109352 - DNA, 1038 bp, Homo sapiens
tgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggtgcgtagcctataaaaagcaaaaattttgctattgatatagaataacttctgaactatttcactaggaaaataactttgcattcttcttcagtgtctaccctttacgttggtttatcagattgtcctgctaccgacctgttatccagggtggttattttgcagtttcctagaattgcaagaaatccgtattaaagaagcaagtgcaggcaggaatagtcaggataggatgggctctgacttaatctatcaaaagtataacttttgccagcaataatgtaaaaatgaattttaatgaatggatagttagctttcttcccagtggctctggaatattggaacaaagacctggattcagcctacaatggaaacatatggtgtacctcactgctgctcgttagtttctcatttgtgtccgataatatgtgtacattttaaaaacgagtacatggaaagctgtgtgggaatcttttctctgggtagagagtatgtgctgaaggactacccttaatatgtgttatgatagtgggttcagtttaaaacacatgtagtgtcataaaataatagtttattctcggtattaaactatatgtgcattcaaagcaacgttaattgtaatacctatggatggaaataagttgtaatgctgggtaaagatgaaagtctcacctacctttgtgtaattatgacaaaattacagccttttatttttagaga

SEQ ID NO: 109353 - DNA, 1054 bp, Homo sapiens
attggattcacactgtgtgcgctgcaaatacattacagatttgagtgccagcatttctaaattcatctcagagataggatatataggcgagggtaaaggagtctgcaactggtggcacttaaggtcttaatttcacagacagaaaaacccagggctcaaccaccatttaacctcaaggccctggagttatacctttgttgaagcttatctgtagaaaccatatttcattctataaaaactgaatttgctcttctgtttttctaattatttcttccaaaaaaaaaatagactgattttgtttaagcatgtgtggagttggtcattagttgttttttgcatttgacctagaaacaaattaatctgattggtgttagaattaagaatctaatgtaatttttacttcattatgataagacctatacaattctagttaattgtatatagttttttagtagtaaaattaattgtagcacatatttaactatcttctgtttacttttaccttcatgttgatttatataaattggcttgcttagaactgataattaacctgcctttttctttttttttttgccgcctttttttttttctgagacagggtctgactctgtcgcccaggctggaatgcagtgacctgatcatagttcactgtaaccttgaactcctgggctcaagcactcctcacaccgcagactccccagtagctaagactacaggcaagaaccaccatgctcagctaattttaactttttatagagataagggtctcactgtgttgcccaggttggtccaaactcctgacctcaaacaattctctcaccttggtctcccaaagaattgggattacaggtgtgaaccaccatgccttgctgatattattcttaatgattagcactgtgccttgtgtagagtaaacttagttcatactatctttctcaccagatacttagtatctttagagctaactctgagtttcattgacgtttgtattcattttgagaatccttttacatagttcatacttggtaagtagtaacaatttggataactattt

SEQ ID NO: 109354 - DNA, 1048 bp, Homo sapiens
agatcttcattctatttaactgtattttcgtacccactaactatcccaacataccccacctctatcactttcatgataggatagtattttccgaagtaaataagagcatagtagcctcaggcatcaagacagcttgaaatcttacatgtaatctggactttcttttgacaattaactatactgcagcaagtatatatcatcttataatgaggatctcaggggaatttagtagcccagtcataggatacctcgttgtatctctcactgttatattttccctttaatcactgccatcttgaccacttactagaaacctggtgacttcctatgtaaaaatacccgcttcagacaaaagaaataatgatttgaaaatatagagaaactctcttcagtttttgtttggggatttttttctttattctcccccttccttttactcaaaagtcattttagtaaagacacacatatttatgtgaggctgagaataaacatttcataacaagcagaataaattgtcctattatttttaatggagtagaaggaagaaattgtttgtttgttttgtttgtggtgtgtgtttgttttgtttcgttttgctttttaaaaagatcaagtagaaatgttaacacctttataatttttctccagttaagtctttaaaatcttgtttcctgtaaattgttgtctttgcattaggtggataggcatagatggttttgaggaattactcattagtctctgcacatccacagacatataattactttttatctgcactgtaggaatgattgcaattagtaggatggctgtgctgtatcctcaagttattgtcgaccatccatttttctttcttatcagaaacaggagaactggtaagtttattatgaaaacaaaattttatttaataggtcacaaagaacctcttttttaaatggagatttttttcctcagtactcatcatataatttcttttcacaattttatttatttattctctttccagagattgaccaactgaattatcagatagtttataatgttgaaatga

SEQ ID NO: 109355 - DNA, 1165 bp, Homo sapiens
attgactgatggccatacaaatgtagaaataatgtttaacaagtagtgatatggtaatgaagaatatcacaaactcataacaccaatactgaaacaacatcagttaacccaacctgtatatattacacatgaaaacaagagcacttttctataataacctatgaataaactataagtcttctgaaaatataagctgtaaaagattgtgctaagtactatgtccttgggcatccataaattcttttgtgaataatgcctataaatatcttcatatttttaaagaatatatttcaagtgctctaatatgcagaggaattacgcatttgtccatagcatgtaatagaaaaaaaaaaaactttagagtaaaactatttttccccattttggacaagtatattgcattttttcatgatactgtcaccccacacccccaaatccctccaaactctataaaaattatacagacattctattccatttataaaaatatcaaacatgcaaatattaagtagagttatgctaacaaagtgagaaacagcagtctgtggacaaacatgaaaggccttacttgggagtttgttagaaacacactccaggctattcagaccaccccctagacctactgaatgataaactgaatttttaataagatccccaggtgattccattacacaataaagtttgagaagcattgatttaatacacttgttgattgatctaagtttctataaattaaccatatctaaaaaactggttataagtgagtattccatatgtaccctttactttagcagtattcaagatttagcatgtaacagattcaccaagaaagcttgggggaaaaagtggattttcaagtttttgaatttagtacgtctaagatctggcctggttttcccaaactctcatgaactgaattaaagttaatgataattgataataacaattcttgtaaacaggtccaaatcagcacaatacctaatacataagaaagtaacatgcaaactgtttctgttaaattttgaaatgtgtcaaactttttctgaaactgttcatcatagaattacaaatttggcattaaacagaaatagttcatttcatgagatattatgaaatattttttttccaagaaatattaaaagataaagtaatttactggagatct

SEQ ID NO: 109356 - DNA, 1034 bp, Homo sapiens
attaaatcaatgcttctcaaactttattgtgtaatggaatcacctggggatcttattaaaaattcagtttatcattcagtaggtctagggggtggtctgaatagcctggagtgtgtttctaacaaactcccaagtaaggcctttcatgtttgtccacagactgctgtttctcactttgttagcataactctacttaatatttgcatgtttgatatttttataaatggaatagaatgtctgtataatttttatagagtttggagggatttgggggtgtggggtgacagtatcatgaaaaaatgcaatatacttgtccaaaatggggaaaaatagttttactctaaagttttttttttttctattacatgctatggacaaatgcgtaattcctctgcatattagagcacttgaaatatattctttaaaaatatgaagatatttataggcattattcacaaaagaatttatggatgcccaaggacatagtacttagcacaatcttttacagcttatattttcagaagacttatagtttattcataggttattatagaaaagtgctcttgttttcatgtgtaatatatacaggttgggttaactgatgttgtttcagtattggtgttatgagtttgtgatattcttcattaccatatcactacttgttaaacattatttctacatttgtatggccatcagtcaatgaaatgaattacctataaggaagagtaaatgtcattaggcaatcatgtggatttttttaattttttattttttgagacggagtttcactcttgttgcccaggctggagtgcaatggcgcgatattggctcactgcaaccaccgactcctgggttcaagcgattctcctgcctcagcctcctgagtggctggagttacaggcgcccgccaccacgcccagctggtttttgtattttttaatagagatggtgttttgccatgttggccaggctggtcccaaacccctgacctcaggcgatccacctgcctcggtcggcctcccaaagtgctggga

SEQ ID NO: 109357 - DNA, 1078 bp, Homo sapiens
ttactaaaatatgctagccattttatgccagaataaaataagaaaaataaggacaatgaatatggataaatctttcttcagtgacttgtgtcttgtgattacaaactccaacgatggttacacaatgaggggttgggttaatagaataacttggaagtctccctctaaagtatgagacatggttttatcttgcttatataatctccttaaagtaggacacaaggaaaataaagttcacataattacaagatctgataagaaagatccagttgattgggtttttattgtaccttcttgtgtagttttgcaagactaagcctaacaacctcaaggtaaaattaagttttaaagtagaagtgaaaattatctcatcatcttagtttacattagatttctttctggtttaaactagaactctttatggcattatcccagtaatgaccaggcatttattaataatagaaggtaattaaaactttagtaatacaagtaagtaggcagctaacacccttaccatctttctctctctgtctcttcctctccttcctcccctctctccctctctctctttcttctctctctctctctcaatgcatttcatttttttcagaatggacagaaaaatgaattgaagaatggttgtgtttcagctaagaaaattccaatcaatagacgactagtcggattgtctttgagtgtgaaatctgcttgtgggccccaaagtctggatccttttctcacattcttgtattactccagacaccacaccagggtacagtgataaagggcagtgtgctgggaggagcttgtgttaaaaacctctgggacattctcagaatcttagttctgtcacttctgttataaattccatatgggatttttcttcagtctgctcctttggagaaatctcagcaaaacaagatcatttctgatcatttagttttaaaaataaaacaaaacatagggtaccctccaggttaggttatataactcactcaaacttctccatctacaactgccttaatgtgcacatcattgaagtcaaaatggcaagaactgcaagtcctaggagtttgaa

SEQ ID NO: 109358 - DNA, 1077 bp, Homo sapiens
tttgtgaatcatgtctttttcttaatcctcttaaacagtacatgctggtagtgaaaaatgctcaagataatctgtttcctctctatcattttccctgtagtttaagctttttatatactaaatatttataatatttctgacaaattattataggattattatgctttgggaaacatctgcattttctccttaccttggaagtcctcacatcattgccttaaaatgttttcaaattaagtcaatagtagctttcatttatgataagcacttaatatgtaatttatcaaatattgcttactgttataatagaaccagaatgtaacttactgtctctctggcaccactaacacttagatgtgtatctttttctaaaaagtcagaaagaaagtgattacatacaacctccctcaatagcccgttgtgatatcttacagctcttacagtcaagaaattgttttccttatgtccgccatgtggcactttaagcttttttgttctcatatcagtaagactagagaatggcttgtcctcttctctatgtagtaaacccctttgtgcacttgaaggctgatggtaagttaccccgtatcatcattttctctaggcttagtacactccatatacttaaactttcctcttctatcttacttgttttaaaaagtgatttgttcttctctttttgtgctcatacaattctctttatctaaatattttttcaaaaagcagcaagtaaatgtctgagtatgaatgtgtgctgtttctgggctgtggcggtcatcatcattactgtgatgacatcagaaaacatgtgatgggctatatttgtttctgagctccacagatggggcagttcttccttgcatttcctgaaactatcaatttcttcttttggagcccagctacttcctctgatattatcaaacattagttgatttcttcagcagtgtccaatcaactgggctttcttttattgagagagttttgattgttgttgttttcttgcatatgggggaaaaattacagctcctgtgaaaaatatttattttagaagaaaagtgtctgacccatatcatctct

SEQ ID NO: 109359 - DNA, 1053 bp, Homo sapiens
agatattggttacttggaggttttattttccaggttatttactgtattcttcacagatgaagttttgcttatattatgtctattttataagtgagattacacagtaagaaacttaagtgactccattgcagccataaagccaggactatatatatttctagacaccttcttctgttgtagccccatgccccatagacatggaaatcaagaaattacatcattacttttgaaattggaagagtgtcattcccagtgatgtgcttggcctaggtgtctcgaaataatgatgtgtggcagaaccatgaagcagttcctggaagagcagaagacacaaaactctatgctcccacccataaggaggcagaatttcaggctcccccagagccaatccaacaagaagtggaacgcagagaacctgaggagcatcaggtggaagaggagcacagaaaggccctggaggaggaagaaatggagcaggtcgggcaagcagaacatcttgaggaggaacacgatccatcaccagaggagcaggatcgggagtggaaagagcagcatgagcaacgagaagcagccaacctcctggaagggcacgcgcgtgctgaggtatgaagtcacccgcttctggtatggtgtactgggatggaaaacctggctttatttttacatattaaggtaatatatcacaatctctaaaatagaaatgtgagtgattctactaaacattatatgctcatatttaagttttctcttgtaatgttaatagcatagctattcgcatacctcagaaagatgattggtgatgagagagcacagctgttgtatgtgtgcattcttctttttgtcagttgtacacagtcagagattcattctcacatcaccttaatagagtagaacaggtgagtacctgatggggcaccttcccagcttgtacccaagttttgtcttgagcatcttgaggcagagaaaaatctcattttctatgatcaggcgtcctcctctccctgttcatttattgtcagtatgttgccttttgtattcaccttcaaggtggtt

SEQ ID NO: 109360 - DNA, 1643 bp, Homo sapiens
tcttcttctctctatccattagggttttatgttcatttactttctcacagtggttttccttagacattttcttttatcttacacagattggaggctgtagaactattaaaatgcttccttcttgttactaatatttaataaatgtccttttacttaccacaggaacacaaattattatttaaagattctgcttccttggtccttgagtaaaactcattattctgtgtcaggaagaggatcattgtttctgtcaagctggaagagacgggcagcatgcagttatgcccttctcgcaggatgcagatcatgccggcatctccaccccaccgtgcctccccctcgctttctgtttgctattgtctttccctctgatatcagtagggcatgcactttttattgaaaccggaatcttttcttattatcaagagagcagtaaatgaattaaagcaaaccatgctttcacattaagcacttggagactgtagtgtttatctagatcatgattacattgtaggattataatcggaaataaggtaaataaaagtcaattctctaaacagttgattactattcccaaagggaaaagtctcatttactctctctcttttaaactgagttaccagaaaggctgaaataccaaagaaggaaaattaaatgcattgctgggaaaacatcagatcgaaagaggaaatccataatacccagggagggataattttgccattagctttaccttgtttccacagtaatatgtgtccctgggaattttcccacattttttccctttccatctctcatgctaacttcttaaaaattaaggggaaaattatttttggctgtgatcccaactgttcatttgaaatccaggggaaatggagggaagctgcacaaattaaagcaacttgagaaaaacaaagcctatttcttcatgtgtttgtgcttgcttgctttcatttgtttttgtttactgtgctgtcaagaaatagactctcatataattcagagaatgtatatttctactcaagttttcatctttgcagagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaaggtatttggaaatctgattagccagtttatctctaaataagtactgatattaatgtttcagtgcaactgtagactgttgttttgagtggtgatcgatttacatttatcatgtggtcctttaccagtcactttttctttgtaatgtttcacatgtatcttcatctatttgggttggtttagggaagcagaatagaatatgtcgtgtgttctgttgtatcgtagtgtattctcttgtatctcagtggggcacatggccctgttgggcaagacgattcttctcttaactgggttgcgagacagatagcatctctgatccttacctactaaatgctataatgcttctcagttattgccacaatcaaaaattgctccatatatttctaaaaatctccaagggagcagagacttgctgttgatcgccagtagtaactgaaaaaagctcaagttctatag

SEQ ID NO: 109361 - DNA, 1002 bp, Homo sapiens
taaatcacatcttctttacaaagttggtatacaaagtcaatgaatatgttaaaggctaggatgttacttggcagtctgtttccttccccagtcattcaccaggttgaattgacttcccaccccatcactgagtgaccagtgacaaatgccttggtgaacagcatccgtaatgaataccagtttcatagaaatgtcacagtatatctcctgcaatgtagggctggcccaagaccactcctgcaggcacttttgtttcctcagatcatcagtgcaatttggggcgtgatccacgttgagtttcaccacagagtggtaccagaatttggccctatgggaaatccagagtccaagactggccataaaattaaactttttctctaggtatccttccgagatttgacgcccagaagcagatttaagtgctatgttgtatttcactccctgcctggagttcacaacagggaaactccgtcacaggcgtttcagcctttgaaaagagtaagatgatgggagtttcatagggggatgtatcagttactgtggatacttaaagttaacaaaacattcagagtaaggaattttttaattaaagtaagttctacagcatccatgaattacctacatttttccactccctcacatactttctcaagttacccacccttgtgactcattcagtagcaaaatcagtgaagtcggcattctcttttagtcatcaagcaaaaatgggtcatctccctggcctactagattgtctggtttgccccagaaaatctcttttcagtttggccctctttctgttgccatgtttccttgcttttcctggaggtaggggggcgccggggaaagtgggggacagtttccacctatcatcaagaacttgccatgacagccagcttcttcactccaggttgctctcttcttaatgttatatttattgtattcattcatcattcctgcctagagagcagtgctaagattctgtccttgtcttcttttaaa

SEQ ID NO: 109362 - DNA, 1046 bp, Homo sapiens
gctgaggcgtcagagcacttggatttgattttctgctatcttattttgctagctgtgtggtcatgggcaagttatttaacctttctgtgactcaatctattcatatgtaataatcaggataatagtgcttacaaaaggttatcttgagaatcaatagtgttagctgatgtgcagtgcttagaagggtgtagcttgcattttggatgattgaggaaacatatacaacagagtggttcatagacctcagcaatttagaccacaagtgtgggcaatgtgtggtaggtgtactaattttcaagtgcagcgttagaacttaaaacatgaactagacattgtctattaaatggacatcttcactgaagtacaacttagagttaaatgaagagactatcatttttgcttgatcctgtaccatttagaatatggaacaaaaatactcttaagttcagtaatttttatttgtgtgtaaattccttccctgaataaaagataaaagcttccaaataccttttgaagctctaattcagtgaagcattcttttgaatatgtatgatttgcacataatctataatcgatttcacacgttgtgcccaccttagtcatccctctaatatgtaacatgccaactctaatgagagtactggtgtccaggtaaataattggttgctgtgtaagagaattacttgttatctgggagcctttagtttaagttccaagtagattggaagccttgccttgatttctttttattctttcttttcttaggaaggacagtttccaaaagggctggggtacaataccacattactgtggctgaaggaataagtgaattggagttggggaaatgaatactgactaaatatggtgtgaatcaaaaagcaaaggattggagagaaaccagaagagggcagggaaagaaaaggggacacatatcacctggtgacttttcaaagtactgaggaagagttttgttcacatctttatgtcctaaaagaaaagcagcaggaaatggtgactggagagctggttggggcatcagatgtggt

SEQ ID NO: 109363 - DNA, 1050 bp, Homo sapiens
tttccatattaagacaaagacctgtaattacccctcggattactcagataaataaaaagctacacaaaaggtcaaattgaccttgttttcttccttaattctctatttttttcttctggtcctctccatcttctcattcgaagaccacaatttgctatttatctctctgtttctctcaatatttcttctgtttatttcctcttctcctttacctttttcttcttttattttaatctcctgtattcccccatttcatcctgtttcttgctttttgaatcagggtaggagatatgctgacattaagtatattaatagttagagtcttggcattgtcaagaacttgctcaaaggaaaaaaggttgtcaggtattgagagagaattgcattccttaaaatagtgattatgtgattttcaattttttttattcggatcactcattttattacgggaatctaagtagatcccttcatttctcagcaattttttaattggtacaataaataagatagctataatggtatttgtgcaaagctttaaaaaataagttggtaactagaaaagaggacagagggaagcaaatgatagagcaaagtacaaattatatgagcactgcagattgctatacaagttagacagccccagtgtgcgtctaatttatgtagctgataacccaagttaacagagaccctggcactattatggaggtaatattttctcaaggatgtacagtcttaaacaacttcttcctgtattaggttcatacatgcttttctttaacataaagcaggtatgtctggtctcttgttccatttcattttcttggaaaaataaatttattgtaggccagctgaatggaaattctgcttactgtttacgacagaacttgctctccccctctcctgtattacccagggaattagtttaatatagagtcttattccacacccatttctttatttttcccctctccatcctactttttagggttctgttcagaaactatattgccacagagcagctggtagcatttagcaaccacctgcacaagt

SEQ ID NO: 109364 - DNA, 1074 bp, Homo sapiens
ttctatgtcaaatactaaactctctcactattttaaaaatggatatttagaactacaaattagagacaataatcgcagtacatactttagcaaataattgttgcactttcttgctatagagaaggatattgcaaatatattgattttcaagtaatggagtttctttggagcccatctctgtctgcccacacagcaaggtcggtcctctgtctgcattccatcatgcctgcctgccacatcttatcagtgcagagccctatgaagaaggttctatatattagccacaacatgacctatgtggacaagatcatccttagtaattactcactggtggagaagtgatttagaatgaataactcaacaatgccattatttaccatatatcatagccatggataaggttaaaaaaaatcttccttcaaattcgggttgatttatatatcaagaatattggcaactgagctttatctaacttttttttttttctgttttgctgctgcttaagaagatcttagttggtagagatcctgacagttccagttcctgactaatgtaactactcgaagcaacagttagccctgagcacagtccccagccaggatcttggcaagagtccatgggaataatctctttctcttggcagctgcctgaacagcagtttgtggaaaggactgctgtcagttggcaggatgagggtgggtctctacagcacattaattaatgcttactctttaggtagaaagcttcagaaacttgtataaaataaataaattaagacagtatagtatgtggtaatttggacagtgtatttgaagcggagatatgtctcatagttggaaggatgagagggtacaagagaaatggcccctgattatttatttcctaggtatgtcaacttctctgtatctgctttcttacctgattaacaagggtgttggattagaagaattctaaggctcccttccttctagcattctgtggctccatatggactagatagtctcagaaatgcaatatctgcacttgatacttcgcttttttttaattgatttataacactgctacttccacaaa

SEQ ID NO: 109365 - DNA, 1039 bp, Homo sapiens
atggataatgaattgaactagcccatgcaagtattgacaattgaggattagctcatttgatttatggattcaccacagataaaccacagaggccataatctctagcctctccctggcctgtaaataataaagattttaatgaaggcacatcgtaacaatggtctttcctgtttatccttcaaagaacaacataataaggtggctacccctgtggaattttgtctcttcaatatcagaaggaattcatgaagttcttatttattcacagataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggaggtaagaatgtattttgagttaacacatttatatattgcagctgtgtaaagaagagattgtttaagcatccacaaaataagcaaattatatttgttacaatatgttttcaacaggtttttaagaataaacttcctttacaatctcacttcttaatacaaacaatgtattgattaaaggtatagcgtgataggagggaacccaacctaatatatggttaaagaattgtactgatttgaaaaaatactaaaggaagaagatatgattttatagttaacgtttggaaacattggctatgaccatgtgtagcatgtggcattagcaaacaagcataatcatatgacatgtttattgcattttatcttttttggggtggggagttggaggattggaggaaaacatttgttttctctattttgtgactatgagttaattt

SEQ ID NO: 109366 - DNA, 1042 bp, Homo sapiens
tgcctaggctttcgcatcaagtgggacttggtgaggtggggatgtggatgcatattagttaaggtacaggctggcagcggcttagatagagggaggtaggcagttcagggaaagttggcccaggtttcagatccctctgtctgtggcttctccagctcctggagagttgtttctgcgttcaccagcaccaagtccctgttcctccttgagtgaaagagaaaggaaagaactggggacaacgacatttccctttcgggactaaatggagaggttgcccatgcaacttcctctcacagctgaaacttggtcacactccgaggtagcaggttcagagcacagattctggagtcagaccattggggttcacatcccagctcatcccagcacatcccacttgtacaagtggtctagcctttttgttcctcagtttcctcctctgtaaaatagggatggggagaatagcaccttgctcatgggatgaggattgcatgtgttagttggtagaggacctaagacagtggttggcaaatagtaagcactacgagtttgctcattatgtaaataattggccataccagactgcaggaaaaactggaaatgcagtttctacatgggtagccaagtgtcctgtcaaataaaagtcagtagggtttttttttaataaaaggaagaatggggggagtggatacaggacagtatgaccacataatttttatccaaaatgacacacttatgacagtgaaagatgccactaccactgattacactgggatactaagcgtaaacaggaactgtcctgggaaaatcagtatgtctgggtgctttatccagggggttattagctatctctaccagagcatatgtaattgaccaatttcccaaattttttatttaaaaatcttagtctgaaaagttgacttctatttttaggaatgagtagaaggacagatggaggggatgttaagtatttttcctatttgaattctaccacaaactacgtggcctcttggaaaagtatacagattaacaaaagaaaccttgg

SEQ ID NO: 109367 - DNA, 1344 bp, Homo sapiens
tgccagtcttcggagtgcctggtctttttcagtcccccagggtagagtttgttaaatgtatttctacccccgcagggcacaccttcccctgctggaaagacagatggcttagattgagaaagggagtcactgcttttagttgctccttttaaaaatcattttcttttctgcatgcagaaaacttattttgatggagccaatatttaaggcgaagctttcttatgggctgtgaaactgagggtctttaatgctttttatgtttgaaggttctattcgagaggtttttgtgaggacataaattacgggtagcaacaggtatatttttcccttagtacaaaggccaagtgtaagttttttactagttaagaagggtctgttcttttctttttgaccttgattttttagcgatattctgctttgcccctgcttcggttgtattattccctgacccatccaattaccatttctatcagcgcttcggaaagattatgctttttgggtgttctgtagatgtctttccagtggcttcacttgatgaatgtgacaagttttgtgttttctccctcccctcattgaattgaaaagttttttttttttttataaatacaggccaataagtgcccaaaggcagtgtttcaatggctgctaagtctttcaaggttaggacttaacctccgttctccctaattcaactccaaccttcagtctgaagccaatcaagaatatcagatgatacttaaacaatgaaggatttctgatattcaggtactgcctctgttcaataggattgcaaattctttgtgtgaagaaagtcggttttgctctaaagtaccgtcacaaaaagtgaaattaccatttgcttggaatgatgccattcatcattgtcagaatactaagcattgtaagtagctaggcctctccaaattaatgccttgttttgcatcggctaaatttcccaaatccttgaggatgggtcatacaaaactcatctcaccattttaatttatcaatccaatatgagttctgtgaaagggagcttccttcactcttagctcttttatttacagtctaattctaaaagaaaaggaaataagatatgaaaataagttggaaaataagataaatctctcggtgaaatcaccagatctcagtcctgtagcaaaacctccataattcatctgtaggtcagctcaagggattagccatgacgtatttggaaattcatttatttttattttattttgctgtttcttatgcataagggtaatgctgtccccaaggcttttcaggtagccctcaaatcttgacaacatttgctgtctctgaggcctaagccaaaattaa

SEQ ID NO: 109368 - DNA, 1032 bp, Homo sapiens
cttccacaaacttttatttttatagaattattttctctggagttttagagaaattaaatgctacacttatattgtatcatcatctcttcaatccttaaatcttcgattcagcactattcaattgcctgtcccattcccctgcattaaacttcagaggtaatgacatcaatctctgggataatagaaccatacatttggtaatgattcagtgtttggcctccaggcaggtaaagacacaaaccatttaagacagatggtcattgctcctattttaaaaagatttctaagacctctaatccataacctctattggtcatcttgtccaatatttaaaaatgttcttatatttattactgtcaagaagattttctttatgttctatccattttcccatttcatcttgcttgataatctgtggaaatgaaagacaactagtcagcatcattctcgtaagatcctttcgcacttgattcttgaacacttctagtgaaataactagaatttatattgtcttttccttttaggatctagttttcatcctcttagtactttttggtactgctcattttcagtgtcttcattctttaaaatgtgaatacagtgctgggcagcgtggaccactttatatatagtctttagcattattgattacagagaaaggatgatttctcagctgccaaatgtcatactcacttgttaagtcccactttctttagaaatacacagtagtttaccagtagtatactcaaattcaattggaaatgtactacaagtctaagtgtcctccttttgagccttcccagactttctctaactcattcttcattttcttctgtaatttttttttttttttttttgaggtggagtttcgctctttcgcccaggctggagtgcagcggcgccatctctgctcactgcaagctccacctcttgggttcacgccattctcctgcctcagcctcctgagtagctgggactacaggcgctcgccaccacgcccggctaattttttgtatttttagtagagacggg

SEQ ID NO: 109369 - DNA, 1087 bp, Homo sapiens
tcgatgaggtagtgttccatgtcattcttgtactgtgcctttccataggatcaagttggcatccttgtttctgatgacttgctagcagaaaactccccatctggcttaggaatttgctcaatttcactttgattagggaatctccatcaattctaaagcagattgctttctctaataggttctgcagaaggcctgctactagttgtccttgcttgcgttttgcattatgctgtgctggtagggacgctttctattttgctgtctttagtacagatagtaacttctagattagtatcttagctaaaactgatttcacatgatcacttccagtttaatacttgttaaatattttatctagctgcagcagcttaataatcttaatgtacaattatttcacatccaccatcaagtggcagtgcgtggactttaaaaatcccaaggttttcattatgtaatggggaaaaagtgagaatcacactgttgatttgttgagaaggttaaatgaaatatgcatatagaagtacctagcatggtgcctgacatacaacagagattttaaaaatacatcctcctttgtacctatgtgacaggcctgaattttcgagaaaaggattttattcttattctggttctccatttctagtcttaacaaattggcctctgacaaccatttagagaagaacattctgcactggccattcctctgtgggagcagattttgccaggtatgctcatgtatcggtgtgggcactctgattctaaggtagagcaaataacccaaaatatctcttgctgttgctattgttgctattatacctattttagcttccttagtcatcttattcatcttggtatttacctcatgcctataagagcaggcttcccaacttcatacttattcatcaaatcagtagatattttcccccagagatgtagcatgttagaaaaataaattggtaaaaactaatgcttacttagagtttgttttcccttcttgtttatagaaatccaaaacaaaaacaaactccacctgaacttgttgatgatctgttgttttcctgcctcttgtccagatgtggaacaaaat

SEQ ID NO: 109370 - DNA, 1044 bp, Homo sapiens
aactttatgaacttataaatggccccaaatcatcctaattacatatatgtgtatccagaaaatgtaaaccacaatcctccagataaaaatagttcaacaaatatttcagatgagattgggcatgttcaggatggtacggctgtagacagtggtatggccatagactcaacaaatatttcaaacattaatctatattttttataggatgagaatttgggttattactggctttttatttttatataaatcatagaactcctagaattgattaattgcttgttcagtgaaacttttgtagttttggaaaattatcattcttcgataatacttaatcatattattgtgaagtgttatcatttagtaagagagcacattgaactagaataaatgaataagagcaggttttgattgctgcaaccatgatacattttcagtattatttttgtcagtttgcacaaatcatcaatggtcattgggtttatatgcagattacgtaggttcaatgtagaatgagcaggtgttgagaatgcaaacagttaattaggatgacattgactgtaccatctgataatggagagtccaggtaaggggcttcacatctaatctgaattgtgacttgacaaatctcaatgatcccttctttgtgcgatttctctcctagttctgtgtcacagatgtatactaaagaagtgttctggcttacagaagttctgacttactcttttcatctgatcttcgtttcagtaaatctcaacctgaaagcagagctgagttgggaaaagattgtgaggtggaatttattttatttttttaatgaattacctgtctttcctccttctagcaaccatgacctgggcagtctgaccccagcgcctctgcacttaaccactatattatactatctgagagttctcaagagtatggcttcgtttcatgagagttttatcttatctttgaaactctggtgccaacacagtgccaggcacacaataaaagagaagttatttaatcagattaactcccactgatattagctaacttatg

SEQ ID NO: 109371 - DNA, 1078 bp, Homo sapiens
cagcagggttttgggaaggtcatagagggttgcttcactgtcagggcagatcagatttccaagcatctttggcttctggaggatcaagggtctaaaaccagagctaaggtatatctttctaaaatccactgtgatatatctgtgctatttcaagcttacaggattattccaggtcttatattatgccccatttctatttcttcctgctgcttggaacaggctgtagctgaaatcaatccatgtagcccaaactgggtaaggataagtaagttgtcagagtttcaggcctcaaggcttttttgttgttgttaagtgatttccttgtttgtgtgggacattattatcatactgccttatcctgtacatgtacctaaagccaactgatgctactagacccaccaaaacttttttgatgttctttaaaaaattacccacaataatttctagcttatgaattatgaagaccatttttatagaaaaatgtttttcactgggtaatcagactatgggaaaatttttataatggaaactatcttttacttttaactatagcataaaaaatatgacagtatagtgttacacactaaagcccatcagatgcaaaattccagtttttgattataagttataaaccaggatagagagacttctgaaaagtggttttctttggcaatgatgttgttgattaaatataaaaaattcagaaaaaattagttcagcccattcctttacacagaaggttacaaaaatggaataactgggttttggttctactggcaagaactattttgcttattaaaactcattggattatatcagattgcaaacatattggacattttagattggatttgaaaaggtaccattcaaggaattaaaattattcatataaatctttaagggattaatttactttgcaattttaattccttagagcacaatatttgtttcaaatgcgtacttttttggtgtggatgtttactggttgttccatgagggcattactctattaacatttttcaaagtatattttaagttagatcaatcaaattgaattaatgaatagttatcaagtacc

SEQ ID NO: 109372 - DNA, 1408 bp, Homo sapiens
aactcggacgcatcccactgagccgagacaagattctgctgtagtcagtgctgcctgggaatctattttcacaaagttctccaaaaaatgtgatgatcaaaactaggaattagtgttctgtgtcttaggccctaaaatcttcctgtgaattccatttttaaggtagtcgaggtgaaccgcgtctggtctgcagaggatagaaaaaaggccctctgatacctcaagttagtttcacctttaaagaaggtcggaagtaaagacgcaaagcctttcccggacgtgcggaagggcaacgtccttcctcatggccggaaatggaactttaatttcccgttccccccaaccagcccgcccgagagagtgactctcacgagagccgcgagagtcagcttggccaatccgtgcggtcggcggccgctccctttataagccgactcgcccggcagcgcaccgggttgcggagggtgggcctgggaggggtggtggccattttttgtctaaccctaactgagaagggcgtaggcgccgtgcttttgctccccgcgcgctgtttttctcgctgactttcagcgggcggaaaagcctcggcctgccgccttccaccgttcattctagagcaaacaaaaaatgtcagctgctggcccgttcgcccctcccggggacctgcggcgggtcgcctgcccagcccccgaaccccgcctggaggccgcggtcggcccggggcttctccggaggcacccactgccaccgcgaagagttgggctctgtcagccgcgggtctctcgggggcgagggcgaggttcaggcctttcaggccgcaggaagaggaacggagcgagtccccgcgcgcggcgcgattccctgagctgtgggacgtgcacccaggactcggctcacacatgcagttcgctttcctgttggtggggggaacgccgatcgtgcgcatccgtcacccctcgccggcaatgggggcttgtgaacccccaaacctgactgactgggccagtgtgctgcaaattggcaggagacgtgaaggcacctccaaagtcggccaaaatgaatgggcagtgagccggggttgcctggagccgttcctgcgtgggttctcccgtcttccgctttttgttgccttttatggttgtattacaacttagttcctgctctgcagattttgttgaggtttttgcttctcccaaggtagatctcgaccagtcccctcaacggggtgtgggagaacagtcatttttttttgagagatcatttaacatttaatgaatatttaattagaagatctaaatgaacattggaaattgtgttcctttaatggtcatcggtttatgccagaggttagaagtttcttttttgaaaaattagaccttggcgatgaccttgagcagtaggatataac

SEQ ID NO: 109373 - DNA, 1219 bp, Homo sapiens
aagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcaatatcccagtgacatcttagagaatgcatctgttgaattattcctagatgcaaataaactgcccacacctgtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagacgggtgtgtggggagatattatttttatactgtgactaatatagtgtatttttatagagagtacttagcacacactacttgtgaccagaatttggtatatttttctattcatcaaagtatttaacagtgttaaactgttgaaaatttatttgtaattgtaaccaagtatttaatggctgtttaagccctaatgcatcaactccttataccattttccctccaaataagtatgttgattctagcttaccaagtatttaacagagacaaagacattaaaactgataaagagaaaatgtaattacaattcaggccaattttcagatattgccaacacttctcattacatacttctagactctgttgacttctgaacatgttcattggaattacacatacagtgttccctaagcttctacagttacctttattttgcatgtcctctgcctggttgtaaagtatgagcacctattggtacgtttacattcgtacttt

SEQ ID NO: 109374 - DNA, 1543 bp, Homo sapiens
gcctgcagtattaggggcccactgacaaccatataaagatcatggaaaaactttttgaactgatctcagaactaatgttttgataataagaaatatttgtttttggcagtgtttacactgaaacaactactgattttaaatacatagtcttggcctgttaagatgacatgaaataaaatctataaaaaactttatgaattcttgctatatagactgacctccaaattgttttacttatttaactttatttactaacaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtaagtttgacagggagagactgcttaaaataaagttataaataaaagaaaaaggggacttgggccttttagcgaagtagatcggaaactttgtagttagatatctgtttatatttctataagctatgtttatgatttttgcacatatttgttaaatataaaagctgacttattttctagaataatacaaggtgggtgaaataaattatataacttacacattaaaatcagtgagataattttgatattatataaacttgcattgagatgcattttgtgactttataaaaaccttttcagcttcctaaagggtcatctcctatagttagggttggggagtgggtttgggttgaacatggatttttaaacttcttaggacctttcctacacagatattctgggattttcaaataaggtaattcagatgcaaaatagcagtttggaaacaaattgcttttttagggtacattttttaaaagacttccctacatacttttattctcctttattaatatagtagatagcaagaatagaaatgtgggtttatgaattgacatgttcttaatcatataaaaatcaaattccttgcccaaatcatctctattagaagggacattttgaggaataaagttttaatatatgaaaacttatgaacagtatacaataattactaatattcatttacttggatcactgaaaatacctctaaagtacaatatagagagattttaatttaaataatattccagaaaagcttactttagattatttgtaattgataaatattatattggtatagtacaccacttcgctatcttttattttccatctaggtgaaaaaccatacatatgtggtatttgtgggaaaagttttatttcctcaggagagctcaacaaacactttcggtcccatacaggtctgtgtttagggagaacgtattattttttgttctctcttaatttctttttatgtaaaccttgacttttaagccattatggactatatggtatttagtcatactgtacctatagcaatatcttaatgtataaatatcaacttatttgcttattttgttttttttttagttgtttggagtatgaattaa

SEQ ID NO: 109375 - DNA, 1086 bp, Homo sapiens
cctcaagcagcagtgtaggtcaggttacaggtttaccacctgcaccccactgtaagctcaaggtaagcctacttgcttctccttcagccatcttctgaatctccctttgggggaatatgggaacttgtgggtctcttctatagcacacaggaagagacagtagcctgggaaatcaaactctttccagaatctggtagacatcctactacccagcatgtgaggaatactacaaagcaatgaaaagtgaacagactactgctacatgaaacaacataaatgaatcatactaatataatgttgaacaaaagaagccagacacaaagagagtgtatactgtatgcttccatttatataaaggtcaagaacaggcaaaactactctgtggggttagaagtcaggatagtggttatgagaggagagtgggagagctggcagcactggcttgttgggaaaggggtatgtatatgtttatatatatttgcctgtatttatgaaattgttagtaacacctgtctgtaacacgtaaataggataggtagaatactttttcaacttctgaactttgaaaccctttgaaagtcactggtaattttctaccacaaacctttttattaatactacttaataactttcagttagatacctacaatgacctttacttgtacgctatttcactacttggttatattttcattataaaaagaaatttagtctagttccttggtctctttctccagggttagaattttagtctctatattgtaaaatttcttttaaaaaattaccctactcagtttttcacaatagacagttatacaaagtttaatacagtcattatcttttacacatttgaaaaaagtaacttgttttaatttataaaagaaaataggctatagaatattaatctctgtgaaacaataagacaagtgtatgaaaattattttacagctactttttcatggctgttgacctactggaacaagagcaaaacctgcattagatgagtggtcataagattctccataagttgatgtccaataataatgctttttaaggccattggagacttctgcaagatatacacgt

SEQ ID NO: 109376 - DNA, 1037 bp, Homo sapiens
gctaccttgatgtcagctggtaagtgataatttacacattaataattcaaagttaaataatgggaataatctatataaatattcatggtacttgggatacgttgttagacattatttccaatgattagaaactgcaaccaattgtcaatcctttgtcctaagctttaatatttaatactgctatcttttagtaacataaatgagcaatttagttgtgtaaacaagaatgaaagcaatattttatggtgaattttcattaactttcttggaaatcaagtggttaaaataaacctttactaaaacagaaagtactgtttaagttttcaagcatcttatcactatgaataaaaacactatttcatattttcaaatataactatttttcctttgccagcaacaaaataactcatgatggaatggtgtatttggctgatgtactgaaaagcaacactaccctggaagtaatagatctttcctttaacagaatagaaaatgcaggcgcaaactatctcagtgaaactcttacttcacacaacaggagtcttaaagcgttagtatggttttatatttaatcaaaataacagaaaagcaaatttttaaatactaacctcaatccccttaactcttaagattataatgaaatatgaaaactcagcttctaaactgacatagtattaagttacagtaaacatttacatttctatttttcaaatgtaatgtcttttacaattagactgattctattaacgattccttcaaattaatgagaaaatttgcattgcttatattacttatcctgaattctaatagaaaactcagaagcattcaatatgatcaagacttttaaaagtaagaatgaactaaagaataaaatacttggatgcatttatccagaaaaatatatctgctatccacccaaacatttactgaataatataaaacagaagactttcaaaatgtagttagctctactaagtaccttaaggatctaattagaaaactaagtttcttggattttaggaattaaatggtcagta

SEQ ID NO: 109377 - DNA, 1040 bp, Homo sapiens
gtgagaccctatctcaaaaaataaataaataaaaacaaaaatagtgttaaatattttgcatactgagatatggcaaaaatcacgagggaggtacatgaataataaaatagcaagtgtcacaggttttaagaactgagaagtcagaatggctgagcagacaaagttaagagtgccttgaagtaaaagtagagaagcttatggaggccagatatggcaaagttgtgtgggttgtgggtcacaggtaaggggaagaagtgggggttgtattataaatgaaaatcatggaaaaagcaaatcatggaaatctggaaaagctctgaggggtaatgatctgattggtggttttagatcactggtttctctgtgcagaagtaaagggtggcaagaagaagccatctgaccacttagtagtccaggtgagaggtgaggaggacttgggctggggtggtggccacagagatggacaggaacagactaatttgagacatcttttggaggcagcagaatctgtaagtcttagtgatcaactggatgggaaggtaagaggaatggcagagtgagaggaagcccatggtttccggcataccagctgggtgtacatggtggtgtccatcacggatatggggagactaggcccttccagtcagatagagcaagagaggcctatgggatctgtgaaaaatgtgattggtaaccttttcccaccgcacacacacttaaaagtactagtatgaatataaaagagtgcttgcacaatgatgtgtgttggataagtagtatgagctctagctgggatccacatagaagcttgaggggtgaggaaaaaaaacctagagggaaacacccaggaaatggacactgaaacattaagaaactccccatgccatgttttagatagattttagggccaggagagaagaatacagtaacaattcatttttgaatttgatcaacttacaattcaaagtccaaggaatgcttaaattttaaaaacaattttatcagaatgcagatagctgatcttgaaatatttatgtagc

SEQ ID NO: 109378 - DNA, 1026 bp, Homo sapiens
gctaatttttgtattttttagtagagacagggtttcaccatgttggccaggctggtctcgaacttctgacctcaggtgatcagcccgccttggcctcccaaagtgctgggattacaggcgtgaaccaccacgcctaacctgagctgggtgagtctaagcaaatcactgaagttttcagtgttatctataaagtggggatactgtttgtgtgagtgtgagtgtgtgtgagagagctaaatatatggaatcttttaaagcactttgcagtctgcagaatgttcagtagttttaagttacctggtataaatatactgtataagtctacttattatatgcttgcttccagtaaatgatatctgtgatatgactatttatacatgaaggaaacatacttttacttctttactgggtttctatttcaaaatcttttttttttttttttttttttgtattttaacaggctagcagcaggaatcacattaaacattgctggtaacaatcgcttagtgccagtagaaagagttacaggtgaagatttttggattctttccaaaattttaaagaattgtctgtatattaatggtatgtttccataagaatcaatacctcctgcttttcattgatctgattttaagtattctttataatgaatatccacttctattcatctgtgcttcaggtttggatgttggatataaccttctatgtgatgttggtgcatactatgctgcgaaactgcttcaggtattattttactacaaaatgtccttagttccatttacaatgaaaccaattagtctaatgacacacacataaaacactagttttacctgatgtcaagggtcctgactctgtgctagaacactcgaaatatactggaaacccattgtggatttggtctcaatggagccagtagctagagctcctaagttatcttttgcaaacttgtacaccatgattaaatatatacaccacacatctttcagattgatcaaaggtaaatatagttttttctttcatttatat

SEQ ID NO: 109379 - DNA, 1098 bp, Homo sapiens
tacaacattttttaaaagagaaaaagcgtgcacattgttttaacagttaggtcttgagaatattatgattaatgttgcgagacaggaagggagacacacactgacatgaacacctagagacagagtgcagctgttgtgtgcacgggtggctgagctctcaaattcactgtggaatcaaactgttggcaagtgaaagtgatggagttggagcatcctccttgatctgaaagccatgcgtgtgaggaaagactgaaagaccagggcatgttcagtcctacagggataaagtttaagggagacctggctgttgtccaacactgcagggctgccaggaggaagaaggagctgaatgttacagctgactgattggggcactgggtgaaagacaccagaagatagattggggccctgtgggagggcttcctcccgctaggagctgctccataatgctggggcaaacttgaaagaacagttcagccagaattgtggtggtcatgagtagagaggctgtgaaaaggatttctctctgattattgattaggaggttggataaggagacttccaagatcccttgcaacgctgagattctatacaacccacctgatctctgcaatccattcctgggtttggttgaaaagggaagcatgtcccattttccgtggttatctctcctgcctcctcttacagaagtctttatttcatcattaacttatttattttctgatcaaatagctcagattgtacattagtcatcatttttaagtgccattgtaggtagtactgatatgttctattcaaaaggaaaactgtcacatgtattggggtctctaaggtgaattggaaattatccaggtatgttctgcatatggaaaatgctcatttaaataattgctggatgaagaagtactgaatgaatgaaaatgaacaattaaagcagcaagatgattatttacaaatggtccttagttaaagccaatgagccatcactctttacatttaattagagaaaatctgtaggaagagctcggacttcagtggaacagagagcaggaacttgacaaaaaaaaattattgggttgagatttggaaaaagaaata

SEQ ID NO: 109380 - DNA, 1405 bp, Homo sapiens
atccatatccttttaggaaatgccttccactgtcatgtggttttagaattgccttcgctcattttaattagacctctcggcagatgttggtgagaagggaatctgcacagagggcttcaccccaggtctggtacctcccccacctccccacctggtgctttgcaggggccgcacccactgctctgtttgccaagaccgcttgggaacaagtagatacacacccaggagagccacatcctctgtcaccagggaacagctgctcagcctcagcacttgaagagacatggaaagctttagtgtttccagaagcagcttcaagttgccaccaacacacttgttccaagaaaggttgaatacttccagagcagagaggtgaacagaggcttcagctaaaagtgataacaatacgaacagcagtaatttaggatttcttacagatcataggctttggatttgaggaaactggtctaggacaacacatgaatataactggggttgagaaagttgtagagaccattttcttctgccttaaatttatggcctcaatttatgttgtctgttttttgttttttgttttgagacagagccttgctctgtcaccaggctggagtgcagtggcgcgatcttggctcactgcaacctccgcctcccgggttcaagtgattcccctgcctcagcctctcgagcagctggggctacatgtgcgtgccaccacacccagctaattatttttgtattttaatagagacgctgtttcaccatgttgcccaggatggtctcgatctcctgactcaggatccgccagccttggcctcccgaagtactgggattacaggcgtgaaccaccgcgcccagcctgttgtctgtttttatttggggaaatattggaaactttagcaatgcaaaacttgataaattggaattcactgtccaactggggtttctttccttcacttcacatgtaggaaggagaaagaggcaaagtgcttggacagctagtcaagatttccagaatgtgtcctggttggtacatatttcactgcacagtcactgctgagattcagatgggggcaagcctccctcagagtctgaaataccaaaacttatttgtatttacttcacgcaattactgcaggcaaggaaagtaactaatgtattttggaaagatttttaaagaaaagtaaaagattttctgcttaattctcagttgcccccaatgttaaaattaaccagaatatcttattcccaagttaattgcactttaatctattctgccttccttctagaaaataatgtgttcaaggggaaaatatatatccttttataatatctagtaagaaaatccttacagagatctacattaaggagaaatggaactttttcttctaaaagtgatgtagggaaa

SEQ ID NO: 109381 - DNA, 1029 bp, Homo sapiens
ggaagcgtgtgtgtgaaatcatggtcgggttcacagaaggccagatggtaggaagtctacacttattcctccttttgtcttttgtgaacacagtgtgttccctcaacctcccttactgcaccatggccccacccctgttccacaccttcttaccaccttgcgatatgtcagaatggtagcagagatggggtttcaccatcttggccaggctggtcttgaactcctgaccctgtgatccaccctctcagcctcccaaagtcctaggattacagatgggagtcatcacgcccagcccggtttttctttttttaagagatggatctcactatgctgcccaagctggactcgaactccggggctcaagcaatcctcctgccttggtctccctagcagctgggactataggtacaccactgtgtccagctaccagaatgggattctgactttctttgtagatgctgcttttaggtatttgggtgagctgaggaaattagatctttcctgcaataaggatctaggtggaggttttgaagactcgccggctcagttggtcatgctaaagcatctacaagtcctagatcttcaccagtgctcactaacagcagatgacgtgatgtcactgagtaagtatatattgcagagcaaaggaaagacttttggaatcttggcctatatttggaaacttggaaattttaatatgtacacttaaatttacttcttttgaagttattggaaagatcaattcataacagttctgtgagtgccccaatgtagtacttggcatgtattaaacgcccagtaaatgttagtgaatctcagttccacccatacatgtctgcaaatgatagatttggcacttagggaaaattttgaatttatgttgctgtttagaaataaatctcttagtgtcacaaagttgattacaaacaggttacatacctgtaaccaaacgtcaacacaaagggtatcgaggctttctgaataacaagtgaagtgaagccactcagatacaaatgaagttacagaaaa

SEQ ID NO: 109382 - DNA, 1035 bp, Homo sapiens
ttcccttcttcacctgtttggtttgaggaggcaagtatctctgcttcctccctagcagttgcatccaccaaagatatgcgtgcccttcaagtaagcaagcatctcaaaagccgggctgacaggtttacttctcacccaggaatgcagctctgtcttcatgctgagaagcccaggtcaggtcatgatagaaaagccactgcgttcctcaggctcctgaagcagtgtctgggcacctggcggcaggaacagtggttagttaagctttgtccctagtaaatggctctgcctctgagttgaggtttttataaaagagcaattcagagttatgcagtcttttcacttgtctgattgtggtcattatgcatctttaatacatccatcattaacagcaaattcttttttatgcttatcacacagctaagcctctcagttcagaaatggaatggagatccagtatggagaaaaatgagcatttcctgcagaagctgggcaaaaaggctgtcaacaagtgtctagatttgaataactgtggattaacaacagcggacatgaaagaaatgggtctgtatgcagcagactttgcatagaggaagatagggcctttccattgagataagcagataaaacatactcagctacccacctagtaaccccaagtctgctgagtggtcccagacaattgcagaaacagcatcgctttttttttttttttgagacggagtctcgctctgtcacccaggctggagtgcagtgacgcatctcagctcactgtaagctccgcctcccgggttcacgccattctcctgcctcagcctcccgagtaggttttttcttttttcttttttcttttttttttaagaaaaaggccaggcgcagtggctcacgcctgtaatcccagcactttgggaggccgaggcgggtgaatcacggggttaggagttgaagacgagcctggccaagatggtgaaaccccgtctctactaaaaatacaaaagttagccaggcgtggtggcgggtgcctgtaatcccagccac

SEQ ID NO: 109383 - DNA, 1047 bp, Homo sapiens
tgggtttggtggggctggaacttgaggatgattgtaggtcgagataaaaagcttaaaaacaaaagagagacagcaataagatgcaatgcagagaaattttttaaaatacaaaaataacacacacacacacacacacacacacactaggctttggaacaaactattctgggttcaaattcaggctctgcttcttcctaattaatcgtgtctctaagtttccaaatctatgaaatggtttgtgactcgtttagacaaaatgtcctgtacttgctggcacctaagaggcagtccctccctgtctcccatccacaattctgctctgccccacccaaaattagggttgccagagaaaatacatgcaacagttgaggcatacaataaaagaattccttgtcgatttaaaatttaaatttaactgggcaccctgttgttgtttttcctaaatctggcaactctacccaaaattaaatgccttgtgtccaatgtgccataaaaacggaaggcgagagtgaaaggttaaatggtggatgctgctgcctcctactggtgaaatgtggtaacaccaagcatcccaacaaggacgcgtatcctacgtgtggttttcttagaccaaacaggaagccacaagactgctgtggattacaggtgtagtttttattatcctgctaatcatttggtctaaatttattactactgcaaacctactatcttttaattttcacaggtaccaatgtatttcttcttagctatgttgtcttacacctttttgtcagggttaataaaatattactgctcattccagaacttattatttcctattggatttcaatatacataatctatatgtttaaaattgtatatttcacttacaaaatcactttaaaatcactgtcagtacatgtatattcatttttccttagaaaagtatgatgtgttttatgtatgtcttaaatgctggcacctggcctgccatggtgactcatgcctgtaatcccagcactttgggaggccgggtaggtggatcacctgaggtcaggagttcgagac

SEQ ID NO: 109384 - DNA, 1044 bp, Homo sapiens
tttctattctcctgttcctttcctctccttcacatcctcttctgttccttggttcttgtgtttcttggcttcctggctcccctgttccttagtgtactgatcttcacagagaactggctgggcctcagaagctgggtgtggtttcacctgggtaaattaccacatcctggagcaccctccagcactgttttcttaggacttggggagttggagtcagtgcatttggggggaggataaaaaagtgaaaccatttactgagctagctccccagagaatagccctgtctaaatctccaaatggtgaaattggctgaaaatgaccatggaggtgtcctgggtggggggccagaagagtagcaaattgagaaaggcctggggtgatggtggaatcagggtgaggcagccagggctgcaggtcatgtttagatttatgagttagcgcccctttccttcttcttttccacctaaccccctgagactctagtcagctgtgctgctgtgcatggagtaattgtttagttccactgctgtctgttgctgggtaaaccagggctgggccctgctctaatatgaaaggaagattttaaaagaaaaatggaatgtccaattgtgacttccaaagcagtgctccaagtgcatggaacattccagccctcacgagtggaggtgggctctgcaaggtccatttttaggattccctgtgtaaaatgtttcttggaccattctggaacataatgttacagaaagagctattttattagagaggagactatgaaaactgtaatttcaagaatacttctgctgggcatgatggttcacacctttaagcccagcactttgggaggtcgaggtgggcggatcacttgaggccagaaattcaagacgagcctggccaacatggtgaaaatccatctctatgtcaaaacaaaacaaaacacttctgtgtatccctttagtttaagtccttagccctcccataaaatataagcaaatttcaggagagataatagattgacctttacgaatcctttttagcttcaattca

SEQ ID NO: 109385 - DNA, 1585 bp, Homo sapiens
gctgcggaggcgcggctgtgggcctggagttcctgtggtcgcgctgtcccgggcctgagctggaaggtcagcctcccctggggcgcagacgctgacccttcccggggctcctcccctcccttcaccccatcctctggccttagctggcctgaaattaaggccacggtaataggggtagcaggaggcggcggactgacctaaagcagctggttctttgtgcgcatagaccgtaagggggaatgatctggacttggtcagctgcctcggggcctaggcagggatctgctcatccagatgttcagttgcgttgcccttctttcccttcaatattattaacttaatagtccacttgaagcttgccggcttttttccgggcgacgtggtgtaaacaaccacaacctcgttggtgctgcaacgagctggtggagcccagaaacctttcacatgccagtgtgtcatcctcgtagtaacgtacataacatctccccctaattccacatgcgtgtcatttgtgcatttcttccttgcgattttccctggttcttgttctttgccaagaggattaattatgtagaacatcttggactcaggatatttattagtcgtctcatcagctgatgtgctgagaaaccttcataagccctcaaattgatcacatgtagtaaattgttactataatcataaattgttacattcatcattgcctttctgttccttactatttcattgcttagaatgattttttctttcttccattttatcccttctttttttttttaagtttatcgatttattggcgtacaatacagatgttttgagctatgcaagttaaaattcttctgtaaactttttaagtgctgtgaaaaagacacacatgatcagtaaatttggaattttggaatttggcagaaataaagtagttccgaacagggtgcagaagggaattagaaagaggcagatttcgagttcagacagataagactaggtcttaagatcagtagaagtttctaattatactgttcttaatctttcaagagttagtgttattcctctgacgtgggtatacagtattttattagattgtatattgaaattgtctgtcagatttgtacttacagaactccttagatttacacttgacagtacaattttatgcccttcaatacacattgttttacaattccagttgctctttaatattgttgtaagggctatataattcaccttttgaatagctgctcttatttagttgtgatcttatattaaacagaggctgtggagtaatgtgacagtggcagagagctaaaacttgagccaaactgcctgtttgtaccccacctccaccaattattggctgagtaactttgagcaagttaatttttacctccctgtctgcatcggtaagaaaacatatttacctcaaaaaaaaaaaaagcaagaaaaaagaaaaactttaagattgctgtgaaaataataggtgagtcaacttatttattaaaagttattaaaagtgtttggcacgcagcccctcccttctattctactccttacccaggatgaaggatttagattggattgttatttt

SEQ ID NO: 109386 - DNA, 1018 bp, Homo sapiens
ctgtttactttctattatttgaggattgattattaaaatctactgggcatactgcaaaattaagtgacatttatttttctgtccttgaaattttctacatggctgtataaaatgtttgtgagagatcttagagtactactttcatgcagcctaacacacttatgaaaatatactagcctagaaagtacctcagttttatcattccagataatcagaaactataatacatcacttgtgataaaaagatcaaatgtaatgaaaagttcagagtttaacttacaaaaaagatcctgttgtagaatttttaggcaaaaggtctgtaataccaactgagtttctgtcatttgttgcttgatgttttatgtttagaaagatggttaatagattcagtgatctttaattatactttgcacattggggagaaatgtttgatacaaacaaataagttcagggttaaaaaaaaaagtagctaatttgctttttctttgtaattcagtataatttcagattctcgtgtcccatcgaagtttctagcaagaggactgttgtcacatttccttcttggactcattactggtcactgaaaaccagaagtgagctacatgtactcatacagtaactacatatagattaacaatgtgctgctgcatagtagaagttgatttacaatcctggtatcaagaaattttagagtttaaaaggatctagtagggtttgtttggaagcctttttcataaattcagtcttaacatgaaagcagagtggtgatcctacagctgactgatctcacccaacaccctcgtttttcagataaactgaggtccagtgaggttttgtgacttaatccaggatcgtcaatcaagatagtaaaaccagatttagaccaggtcttctgattcccaactgaatactctttctgtctcacaatagataaaaaataagttgctttgaaatactttaatcctgacttctttattattgaattatgcaacgtaaagacttaacatgacttgtcctt

SEQ ID NO: 109387 - DNA, 1036 bp, Homo sapiens
taagttattataagttaataaattgcaatactttaagaaagtatcagtaaacaagttaattctgtgtctagttgggagagattatccaagtccgtgttttctggtctcttcctttcattgcctcttgatagtgcctttacaaaggacagggtgcagttttagaagagtttggtgaacttgaaattaattgttagaatgagatttttaaattttgtgcatacatatcaggttccctattgcgtaatatgtaatcagcttctcaattttttatgtaccctaatatttaatcaggttttacatgtgatgcctctatcagcagtcagtagattagtatatttatgtctgtattcaggaatggtataactgagtgttagtatgagtatatttgtatcatgcctaaatttgatatggtcattctctacaattactttccttccacatttcctttctgttgataaagttggaaatctgacatctttacctagccattttatttatcctttatcattgagttctatgtgttctacatttgaaatgtttcagatatctaaatttctttcccatttatagtccagtatcacactacaatttacttgaatattacagtagtcttccatccatttccctgccttatgcatttttttccagttcatcctacacacagccaccaaaatcatgtctaaatcatttttctagttatgtcctattaagaaactactagtggtctttctgctgcttacagggtaaagtagaaatttccttgcctaccttgatgactattctgcttttacacacttaatctcccagtacttcctagcttgtctctactagagccaaattttgtgtcattctcagccacaatatttatggcttttcagtcagtttacccaaaacttgttcatctttcaaactttatcttcctcttccagtgttcccatccacattgataatctcactcctaatttgggtgctttcactttgttgccaaggctggagtgcagtggcatgatcttggttcactgcagcctcaacctac

SEQ ID NO: 109388 - DNA, 1683 bp, Homo sapiens
gggaataaagggaagatggggaatgagaaacaatgaagaaaataatagaaaatttgggaaaagatatagaagaaagaaagcagagaaggattaaaacggcctttccaaaacgactctttgtcagtgcacttccattaatcacctcttcaaatgagatagtaataactctttttgcatttttcatttttgcctcacccttactggagaagagaagatgagaaagacagtcccaggagtgtctggtatctgcagccacagggggaaaggaaagagaatacaaattgtcattgtgtcagtagttcttatggctaccacattgggggcagctgtcattgattaatttgagaactccttctgcgatctgttgtccattgttcaggatacatatctttggctgttattttaacatttatttatgacacttgtttctacttactttgacatttggatactcactattagcaacatcttatctttttaattactgttttgtggcttataaaaagagactataggccggtgacgatggctcacgcctgtaatcccagcactttgggaggcctaggctggcggatcacttgaggtcaggagttcaagaccaccctagccaacgtggcgaaaccctgtctctactaaaaatacaaaaattagctgggcatggtggcaggcacctgtaataccagctacttgggaggctgaggcaggagagtcacttgaactcaggaggcagaggttgcagtgagccgagatcgcaccactgcactctagcctaggcaacagagtgagactccatctcaaaaaaaaaaaaaaaaaagaccgtataagaatgaaagtgaactggtacaaagtagttaccattgtggaaaaaacaactcaaatgcctcatagttgaagccaagaagcagacaggctttgcctctatcaacttatatttgaaaaacgtagtttctttaaatctccatttttgtcttttgaatactttattaggtcgctccagagaaagcttgaaagcaaggcctgtactccacttgaaaagattcataaaatagatttgtaaattattattcagcgcatgaatttctcaagtatatgattatactaaattaatattcatatgttgcaggaagttggtgaaccatctaaagaagagaaggctgtggccaagtatcttcgattcaactgtccaacaaagtccaccaatatgatgggtcaccgggttgattattttattggtaggattatatcagtaaaatcgtattagtgtacatatgttatgaagttaacctacatttgggatatgtagaagttttaaaagtgctttccaaatgtgattgttctggtgatggacatatggcagttgattattctgttcttttcttttatgattgaaaatgtctataataaaaagataacatgttttctaataacaattgttggaaatttttttaaataggatttattttcagtgttttaaaatactaccttttgtttagatagtatgcgtacttggaactaagagcactggctttttttccccaaacaatgtcattataagctgatgtcatttataacaccagagcttataagtaggggttgagtttgcctttctcatcaattaaaagtgaattgcagctgggtgtcgtggctcacacctatagtaccaacactttgggaagccaaggc

SEQ ID NO: 109389 - DNA, 1201 bp, Homo sapiens
gatgataaaacaatcttttctaatgtgatctatacctttttatggcctatatcatgaatgaactcatacatactaggttaagtctccacaagactttgtatcactgacccccaatccagttatgtcgtcctcagtcttgtgcacatgccacactcattttttcttctagtctttttcctatcataacttgccactttccctaaacggttctgtttcctctgtcccacctgcctctcaaaatcacaaacaaatccctcaagtccttcctctaccgaatgtactcttccccaggccctccagccttcatcagcctttgtatctaaagttctactgagtttatcaagttagtacctcccagtttggcccttaactattttagaattgctacatatgtgtgagtttttttaaaatctcctgccagctaaatctgaaaacaattgtaagactgttttatactttattgtaactccatagcaattaccacagtgtgagcacttcataaaaactcacctttgccacattggtggaagtccccaacatgtctggcatttaataaatgtttgttaaatctgaaaaaaaaatggaagtgaaggaaaaaaatacagaagtaattttttaaatgttttagaagctgttttaaaaccacttactcaacaaatagtctaggctccaggaatacaataataactatgacttggtccctacatcaaaacatattctgatctgttagggaagatttataactaatcacaatgcagtgtgttgaataaggaagagagagatggtgaaactatgaagaatgacatcacacagaaaatgttttaagtaaattttgaaacataaataggtgattacccaacaaacaagagaagaaaggaaattcattccaagcaaagggcatagaacacaccgagataggaaagtatgagtagttgtgtaaaaatgtcagagagttttatgttagtaatgtgttctatgtcatgggtttaaagccaaacaaacggaggctctgatactatacaaatgttaaataatgtcagtctcatctttcaacctaattgtgaaattattttcaacacaatttgattgaaagttaataatctacttttctttcgtgggggtgggcagctgtgcaggaaaattgacagaagcagatgatcctgctggttctattgccttcagtatctactcatcagggaaa

SEQ ID NO: 109390 - DNA, 1017 bp, Homo sapiens
ataatttctcttatttagatttttaaaagtcagatttgactgtgagtgataggaaacctgaaataaaagcatcttaatacaaaatagatgcttatttcttttttatcagtgaaatctgtaggtaagctgtacagatacgtcagctccatggtggatcccagctcttcttttctcctctgtctgaggcttctagctaaggttaccttatggtccagaatgactgccaatcttatatctgcatcgaaaagaggaaaggagagtgaagaatatgtctcctctttaaggagaccagtttaaggacactgtccagaaagctggtaatttcatttctgcttgaattccattggccagaacatagtcacatggtcatgcatatgagaagtaaaatcttggaaatgcactttttatacaggatgattatttgcccagccgaaatgtagggtttccattattatcaaagaaaaaagagcagaataggagatagctacaagtctctatctcttacagaatgtaagtcagacacatcacttgaggggcttaaaatttttaacatttcttgatgctttatgcttatcatttgtaatggaagatttgtatggtggtagccttccataaagactgcttaattcagtcacttcaccagtacgtaaacatgagttatatactgggcattgaactgttgtgaatttcaggatatatcctttcctgttatacctatacaatagtaacatctataaagtcatggctcctagggttgtgtgtttgaaattcttacttgcatgagactatctagagtgggattgtgggggaggattatatatctataataaagtgtcctcaggtgactgatgtgaaccccttgttgagaaccactgtaatagaaatttttatttttataggcgttgggaatagcttgataagtaggataaaatctcttaatggtctagcaaagatacaggcacttaaacatgttaatatagtacagtgtggtaagcattaatggtgtgaaagcaccag

SEQ ID NO: 109391 - DNA, 1106 bp, Homo sapiens
agagattaacaaactgatagaaaaatggtcaaggtagttaacagataaagaaatacaatgaccaatcatcatgagtgatacttaatcacactcatatacaaattaaagctgtagtgattaagagtcttgcaaaccttaacattaaaggtcttagaaaaaaatcagctctctctaacagttgataggtatgtctattgttttaatttttgtaaagggcagtttgtcagtatctttgaaattttatgtgtctgcagtgacccagcaattctaggctgttcccatacagttgcacaaagtgtgtgcattgacacattatctgtttttttccaaatcccttagactatacttgagtataatctagcaaatatctttcaaattcaaaatgcttataccatttgatctaataaattccactttaaggaatttaccctatgccataatcacagttgcacaaacgtacatgtgcaaggatattatacctagaatagataaaaaaagaaaagaaagttacagacgagtaagaatagtataagctcatttacttatttagaaaaaaagtccctgtagctagttaattatatataggcagtctctgagaatacaggtaagcttaatagtacttaacctctgggaagtggaataagaattagatgaagacttaattttctctataccttttgatttgcttgtttgtgacagggtctcattcctgtcacccaggctggaatgcaatggcacaatcatggctcactgcagcccgacttgctggggtcaggtgatctcccacatcagcctactgagtagctggaactataggcacactccactacaccccgctaatttttgtatttttttgtagagatggggtttcgccatgttgcccaggctggtctcaaactcctgggcacttgcctcgttgtcccaaagtgctgggggtttgatttgtttttgatttgctttttaacgtgtgtattccaggaggttttatggggaaagaatgatttaacaaacagaaaaaaaaaaaataggtagcagttaaaataagcttggtcaatatggtatgataggatcccattcaaaataactctttaaggctgggctcagtg

SEQ ID NO: 109392 - DNA, 1027 bp, Homo sapiens
caacaacctttgaagaataggaagagacttattaaatataaggtaacttagcctcaaaagagttaagtaacttgcccagggttacatagcttataagtgatggagctagaattttaatcctggtcttattctaaagacctaataaccaggcttctaatttcttataattctttcttgtgtccccactttacttgcaaaaaaactggagacacttgtaaacagtttccctaagcaccaaaaaatacatctgtagcagaaatcacctggggaatctttcagtctgtggatgtcagagctccaccccagaagaagaatctccagagaggggtcttggaaatcattttttgttggctttgttgttctgttgtttcttttagctcccttacttagtaggcaaatatcttagtattttttaaataaagtagatatagcttgaaaaagggggcagttgataaattaaggaggcaacagttttgaatttctacatagcatttttttctaattatatgtaatttacactaataaaaactagtttaagaatagtataaaatgttaggttgaacaatatgaaattgctcataattgaccattttttacctataaaaatggcaattttatatttcactgtgtttatgtttctcagtttttcccccagggatatgtttctgttagtgcagccataccatttaagtttttattctaaaatttaacttttgtcatttcttgttccagtgattgcagtaatagcggccaccctcttccccctttggccagcagaaatgagagtaggtgtttattacctcagtgtgggtgcaggctgttttgtagccagtattcttctccttgctgttggtaagtattgttattataaaattgacctcaagaaggttggtattgagcagttggactgtaatttggagcttcagtaaagcttaagaaaaattaatggaggtaaatcaagaaatatatggtactactttctgagtcaaatctcaaaactcaggcttggtaagatgtgttctgtctg

SEQ ID NO: 109393 - DNA, 3343 bp, Homo sapiens
ctgattgctatgtgtattgaagcataatatcacaaagtacataaatcagaagtgtatatccatgtaagtgtacacccagatggaaaaaagaagtaatttttttcagtgacattattgcattgtgacctcaagttcagagcaacattctgtgcccctagaataccgtgatagctgctaaactagtcaggaattttttgttttcaggcatgcagtggtgtaattatagctcactgcagcctcgagctcctgggctcaagtgatcctcccaagtagcttggattagaggtttagccaccacgcccagcactaatcaggatttaaatattaatatttaaggtgtatgaaatgtgcagataataaaactgttttcccagctttttattaacaaatactcccttctgaggcagtgtttgaattactcaattagagaaatttttctccccacagctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaa

SEQ ID NO: 109394 - DNA, 1100 bp, Homo sapiens
gagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatgtaaagaaccatctgtttcttattggaatcaagaccaataccaaggagaaattcctagggaacaaaaattccaatgaggaattgacctctttgtcagatccttatcaccaaacattagaaaagatctcataactttatacagcatgttgtaagcattttgataactaaaatcctgttctagtgaatgtcatgcagataactacacaaggagattaatttaaatttgccttctttggcaagcccttaaaccaatggctaaagcagttagttgtgagtttctgagtaggtcccaatgcgtttatttcatttgtccaacctagcacagagatcctttgatactttaattgcatggcttttccaatcagacgaaatttcagtctgagagaggacatattttctgaggtttatagttttaggattgtccaaaaggcctatgatctcttcttagcatgacagaaagagggaaagataagttaaatttcaagggggtcatatcatcacactttggtcttatttcattttcaatgatttcctagatcactttaacttttttgtgtcatggactcctcagaataatgggttttttttgtttgtttgtttgtttgagatggagtctcactctgtcacccaggctggagtgcagtggcgaaatctcagctcactgcaacctccgcctcctgaggttcaagtgatcctcctgcctcagcctcccaagtagctgggattacaggcacatgccaccacacccagctaatttttgtattttttagtagagacagggtttcaccgtgttggcgagactgatcttgaactcctgacatcaggtgatccacctgcctcgg

SEQ ID NO: 109395 - DNA, 1058 bp, Homo sapiens
tgtgtaaacggacatggaataaacaagggctccaagtggaacagcttgttttggccaaaagaagtgagttcaggccgagcatggtggctcacacctgtaatcccagcactttgggaggccgaggtgggtggatagtgaggtcaggaaatcgagaccatcctggctaacacggtgaaaccctgtctctactaaaaatacaaaaaaaaaaaaaaaaaaaaaaaaaaaaaaaaaaaaaaaccaattagccaggggtggtggcactcgcctgtagtcccagctactcgggaggagactcgcttgaaccaggaggtggaggttgcagtgagccgagatcacgccactgcactctagcctgggcgacagagcaagattctgtctcaaaaaaaataaaaaataaaaaaagaaagaaaaaaaaagaagtgagttcagaggctgacatgttttgtgaatgccagaccagcggcttgatgggatcctttctggagaactctgcgattcaggtttgtggctgtgtgctccctcaggtgatgattaacccccttgtcaaggaagagtgggttaattggttattagccagagcaaacagggagaggccaagcagtcttgagtatggactcagccagatccctgggtttcatttctggttcttccaccacctgtgtgaccttgactcattttttaaaacctctttgtacctcagtttcccctatgtaagctagaagtaataataatacctacatcatagggcggtgaggattcagtggcacgtcaagtgcttgtaacagtgcctggcatggagtaggatggattgtgagttagctattattattgttgttgttagagccctgcttcctttactttcacttttactggggagaatttcccccacataatgttagaagaaagaccacagggaagaaatgcatctgagctctgacctctgttcgtggagtgagccatgggctgcccatctgggttcccacatggccttagggaaatgttctccatgacaaatgctaacagggtgtttggtgcagcagcagctttggaattgatga

SEQ ID NO: 109396 - DNA, 1039 bp, Homo sapiens
ggagtaggtacaaggacgtgtaggggaatttatcttaaataggcttgttcacttgtgttgtccagaaaccgacctttgatcatccgcatgcattactgctccctgaaaggggggacagtaatgttaattacccacagactgtgtttgctccaggctttcggcattatgtctgtactgaataaaagcaagcagctccagctgttcaaggctgctctcttcttcggccactagtgctgggcagccccctagctgctgttacactgcttatctgtgtctgagtactcctttcatccgttgctcgactagggtctgtgggacagacccggcatagatgaaaattcagctgtctgctattaagccagacactaaagcaagttgtgaaatgtgaaacaatgccactctgctcactaaattattgtttggtaaaatatagtaatttttaccatattatttaaataacattttaaaaatgttattgatgttaacatgcatcaagggtcaaagggtcctgaaaccaaacactttggaggacagctgctttatcctgtggctgaaaactataaagcaagattcctttaagtaaatgtggtgtatgcatcaatctctccatctttggtgtgctttcaatccaagtatcccctttcttccttttgcaagaaagaaactaagaatgtaagcagttacttcctggcttcagtcccacaaaaagctacaatttttctaagcagtgatctggaaccagtttaactggactcttgctattaagatagctcttaatgatgtttcattttgttttctatctttcacacagagcttactcacatagcatattggtatatcaaaatgaaatgcaaggaaccaaaaataacataattgaaggcagtaaaagtgaaattaaataggaagatcatcagtcaaggaagacccactggagagtaagtatgcaagttgttaataattaattgggttacaaagggaaaaacagagactgggtcagtgaaacgaaatcatggtttgtttccctgaggccctgctaata

SEQ ID NO: 109397 - DNA, 1031 bp, Homo sapiens
cttttttaagggttcattttatacttaataagcatccatttcttgggtcacctacagtctttgttctcctaaggattaaaatagaaaattcatacataacaagcaaatgatgacattttcctaaatgctccttattggttaaccactgaatatatgaacacatatgaatattgtcattcatgtacttaaattcatttagcaaactatttgaacacttacatgtgcagtgtttggtgaacatgacatgaggaactagtagtaagtaaaatcttccccccaaaattcattgtggcttaaataaatatgaacataatcattactacttaatatactgagagggaatcttaataaacttggaactgggagggaatatttgtatacattgggtaaagggttaggctagatgacatctaaggggtctgagtgaatcatatcataatttttataacacatttcacatactaaacatcagttggccccatacctgattaagttacaaaatttaggagacttaacattaaggacttacaggttgagacagcccgtatttcacaacattattttgacacttgactctattccagagttgttgctatacaaggcatgtggcagaacaaaaaaaaagctggtgttgatataagagctttttacccagtattgacagtgagcaactttctttctttttttttttttttcttttttttttttttgagatgggttcgctctgttgcccaggctggtgtgcagtggtgcgatctcagctcactgcaacctccacctcccgggttgaagcgattgtcttgcctcagccttccaagtagctggaattacaggtgcccgccgccacacctggctaatttttgtatttttagtagagacggggcttcaccatgttggccaggctagtctcgaactcttgacctcaagtgatccacctgccttggcctccctaagtgctgggattacaggcatgagccaccacacctgtccgacagtgtagcaactttctaaaactgaaaaatctcaaagga

SEQ ID NO: 109398 - DNA, 1051 bp, Homo sapiens
caaaaaaacaaaacaaaaaattatttgggaagatacgtcctcttttattagaagttcataaaatgtatcatatagttttgttcacagtagttatataagctttcttcaaataaatttaaaattagattaccttctttggaaaaagaatttcctaaatttttaagaattttcaaagttttacatattagtttttagaacctaatccgttttaaaattgtactatgagaaagcttttttttgaaagttgtaaagcattaatacaaataatacaaatataattattaccatcacattccagagaatatggctttttctaaactttcaatttagaaaacatacattaagggagaatctctgccctccttttcagctctgaagatcagcttttctactcagacacatgcacacaccccttccaagtgtcatgtttatgggaacatttgggaaatgttttccagatgttttattttttcccttttatagtttgttgacatttaattttacttaaagatgacaattttaatcggaaatgttagaggtacaacatagtgaggttctagctagctttatacttttgaaaaatatttttgtttctactgctttttacaagtactagtcctctcagtgatactggtggtgttcagtatgaatccatagaaagaaaacaaaatttgttgtttaaaaaaagcagagtaatgaatgaatttcagttttgaaaacaacataatttgaaaacactgttatactaacatggcaaggtgttaattaaatataagagtaaggtagtaagttcttttagagcacctgtttaaatttactccagtaatcatcttaaggattgatagtcaccatcacttattggcttaaaagttatatttcatggaatattatcagtgttaaatccaagctttgtggagctttaagtgatggtggtgaaaaagttggtgtttatgagagagtggtggggtgtctagtcattagtgaagttaaacatcaacctgttttagaaagaattttttagtcttgcctaaagtaaaccagaagtgtctag

SEQ ID NO: 109399 - DNA, 1106 bp, Homo sapiens
aaaccatgaaaacttctttcttggagagatctttgtctcagaatccttagagaggatttcgtatgggggctaactttaggaagggaggcagctggggcaggactttctgatacctgacagtcatgttccagagcaacctttgggcagtggaaactggcgcatctatgcaaaatgattgctcaatctctatcttgtgtactacatatgtaactagctgggccctaaggaaggttttctagggggaaggatagggaagtagaggaggagacaagtaggaggaacaaagcattctagacccaagaggatagaagatatttaggatagatatggctttcatccatagttcaaaataatgcgttttgttagatgccagttatagcagtaaataggttatagtttttatatgtcaagatttacctgtaatcagactcattctttcactctctatacccactgtctccatgcttgggagcatggatattaatagttccagtgatgtagaagttagtgatttttgatttctgaaaaaggtgagaaccttttattacagttggagaatatttgtcaaaaattcaaaggttgttgtaattgagttgccagaattacagagtttccattttcagatatcacagttgaatcacctctgtagattgttataaagagaggcattttaagatagtattttatttgctaggttgtgtctcagtctaagaattgggaaaagaagagctataggtttctctttcctagtctggatttcagtaaacacaagcctacctctgcttctttggttcacagcagtgtggatcatgaaatgaactgtttacccacattcatcaatattggtattttacaaatctacttggagcatttaatttcatctcaaagattgtgatccactttagataagcacaaatacagtattaggaaaagtaaatatgcaatcttactaaaatttcaacttgttaagctgtatatcttaaaagaaattatttggggctgggcatggtggctcacacctgtaatcccagcactttgggaggctgaggtgggtagatcacctgaggtcaggagttcgagaccagcctgaccaatatggtgaaacc

SEQ ID NO: 109400 - DNA, 2724 bp, Homo sapiens
ttcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggattaaagtatcaaggaaagctaggtactctataatgagttttcatttattagcagttaatcatcatgacagaattgtcatatgcttgacttttccctcttcttggaatttcagaacacaaatacaggctaagcattagtaagagatggcccacagtatgagagagagaggtgcaacggaaaatctcgcctggaattaaaacttttcatagattatccacggttaatacaaaatttattatatggggatagactgctccagcaataatgattacatcctataactgtattacctatggcctttaaggtatcaattttgaactgtgttgtaggctctccttttatttgttctctttcctaatagcagccattctgtacttattgaaagcccctgtgcctactgctgtcttaagtattcaggaggggcttacaagagggttttctattggagaataccgtataatcttaaatctagtccagatctctgttgtccccactcaaaacatacacaaaatatgcacttgcttttttcaagtgagtttttatttaaaaatggcttgtttgctatcacattggtgcagctgtttctttcaagatgagttaatcatcttaatttcaaagcttcagctatatataatggatatatagacaacactgagcatccacctctctcctgagctttaaagcagagtttcagtatgatataggtggggagagtaaattgttttcatatcctttcatactactactaatagttttaggattttgactggggagagataatgacaaacagaaagggaacatggaggttcttcctacttttgctacctaagtttgcattttctgacttccttgcagtgttgcactctttgtcccattgggataaaaagcataagtttgaaattttgctttaagccttgtgttcctggggaagttaaacaactaagagagctgatttgtaaaaattattttttatatgacattaatattcatcaagccttgtgtaggcatgtgtaagacacagctatgcagctttgagtagtcaatatagtatgagatagagtgttgtcccaaatcctcctgtcactttttaagtagcatattatttccctgatggtcctgttactttgctgttgaatgctctaaacagaactttttaaaaggtgtgttttaagagcagtcacctaggagtagacaaggtggaatgggaggagagaaatggtaatgcaaaagcttgagcatgggaagagtcagaggaggaggccatcatccttgttagcttagcctacttcaacactgagcacatttctgcacttttgaagtgaaattcatgttttacttagaagaaataattttctttcattagggatcccagttgatttttgtttcctggtgtatcaaaatacttagaactatgaaacaagtattattgtgatcatgcctttgaataatttttgacgtagcttatcttcatgtatcaagtataaaattataatgagacatctattcacaaatacaagtcttagattgaattgaaatgtgttatagtgccctgtctcccactgacttgttcagttaaatgtcttaaagtacattatgtacatcttcaggcttttggtaccacaatggcacaagtatggtagggaggcaatatagtcttaggctatatgcctatattaagtgtgtataaacaatttttgaaagaatacact

SEQ ID NO: 109401 - DNA, 1820 bp, Homo sapiens
cacacagctgtacacaggaaaaaatgtttgtattactcttacagatagctcttctatagcagattatatttttgtttattgtgtattcactaattcagtccttattgacaaatattatgtattcagtacctataatgctttgtgctttgtgctggggttgtaagacatcataatcttacataaacaagaggatgatacatttgcaagtagaaaggataattgaactagcaaaattgtggcatccaaaagtgtaatgtaactattttcatttttcattatctttttctttgtgttttcccttagaatgctgatttgaataaaatagaaaaacttaagctgtcagtttttatgtgtattcttaaattcatcttaaaattttactgtctctcaagaaagcttccatatttttatattctctcatctcagctacttaattgattacctttcctattggtttctttacccttaatgggtaagtttattgagtaatttggatgtgaaaatttggtagacagtaaaaacatttgagtttcaggtagatactagcattgttacctgctaaagcacctggtttagactgagagctaaaatattggttatatggcaggaaattcgccagcaagctcataatttcaatgagaattgttttcttaacaaaagtggagacaagcccagtgatagtcaagtcaagcagcgtaatacatttcagcagcattgcaatagattggtaatacagtcttgagaaatttgatatgtcccgagtgaacaataaaaatattttaaatgtacttttcaagtgaaggtcataaattaggataaggtacaaatgataatgaaagtggtacttacttgagaaaatatttctagattgttatttaaatgacaaaacatatttttgtttcctctttacctatatgtgaaggatatattatacagagataagtgcatgaggtataactagttaacccaaacctgttatgtggcatgctttgaggtaacaccatagtcctttttgtgaaggaagtattatatctagacttccctcttatgaattatttctataacattattttagagcaagaattccaagcaaattgctttacctggattttgaattcttattttcagaatgcaaatactctattcttcaagagtgaactcaagactaccataaataaatttcatttgtttctcagcctgtatttcagattctcagacccagtgagagcataactgtgactgttaggagtaatgtctaattgttgtatatttaattctaacttctgtcctctggtcaaattccaggctgccaggatatcgcagatgaattcagagcacaggagattgatggacaggcccttctcttgctgaaagaagaccatctcatgagtgcaatgaatatcaagctaggcccagccctgaagatctgtgcacgcatcaactctctgaaggaatcttaacaggaacatgaagccttgataaaacagcagttttacttttctcacaaaaacttgtaaggtaaaggcctaacttggtctagaatatgacacttattgtggtggatagccaagcacattgggatctccacatcaaatactgacatttcttctacaggtataataattcatcatgcattttcataattaataaacattggtaaaattaattttacaggttacatgaaacattgaaagacttgttacagagggccatgatatttttcaaagaaatgtgttatactagataatttttttaaaggtgatgtttatcattaatataaagaatccttttaaaagtaatttaatgatttacatttctcc

SEQ ID NO: 109402 - DNA, 1080 bp, Homo sapiens
tgagataggcttccttccctctttaaccagggcatttatatttactcctccagttttctcttctctttgtatatcgtcttgttaaccatcctgttcagactatgttagagcttgtatgcagtagaccagaatctcagagctgttaacagaatgaaaaattaccgccttctaattttctctgcattaaaaagttatctacaggaataattcttattttcaatttactgcgggttatcttctttaacctttccttgctatggtgaactgccttttgcagagatcagtttgtcctctgtttattgaagggtgaatccacagtagatttgatttttctgtaggcatataaactaggaatcattttttaaaacatgactatttactggtttttgtaatatcagtattgggacttgtttattctgtagtattgagtggcaggtgataccttttcaccaaccttactgtggtcaatttttgtgcagggtgttttattttgagtttagctggagaagtgatgccagacacttgaaagatcagttgggacccatgtgcagaggtccttgcctgtgctgagagctgcactacacttgcttctggtgaggtgaagctagctcagctgactggctgtgtcagttggtgtatgttttgtacacatccccgggatccaggcattttaccaaagtagatgttaatgtcagaaactcagaactttatctcagtataccttgagcacttaaaattgtttttaaaatatatttttctgtaatgagattctggaagcatacttgcttccaatttttctaagtcacttttttttaaatttctatactgatgtaactatactttttttgtggttagcttaagaaagttgtgatctaaaatgcattcctatttgatcgtgctaattcccaaaacactttttgttctatattattttgctaatacatttactgttcacctacaagaggatatttgaagaggaatctcacaatacagaggaacaggaatgtgctacatattttcctcatggagaactccttgtttctattcccaaatgtagctcttatagttctcattacttct

SEQ ID NO: 109403 - DNA, 1088 bp, Homo sapiens
ctctgtattttgcaggcagtttcccactgtcatgctgtaatcaggaaaaaatacaataccttgttatagatgtccagtattatattgagagatatattatggtatacacagagcctgttttttgacctttagcataagtaaatccattgaacagtgtagttactttatgaggtcttacattcattaatgatgtattgtggtacttactgattcacagttgcactttaaagtcacaattaaatactaaatggattgtcccatatatcattaaatattttttctttcttgaatttcttaggtacaatgttagctgttctaaaaaatttgcacttagtcgttggaatcgtaagcctgataatcaaagtcttgggcatcgtggccgtcgtccaagtggccctgatggggcagcgagagaacatatccttaggcaggtctgtataaaccttgcttcaatgtaaaatacccttttcagaaatgcaaggaaagtgcaatgctgtattttgcttgtactacattttccagcttccaattacttatccatctgcagaagaagacttggcttctcatgaagattctgtgccatctgctatgacaactcgtctgcgcaggcagagcgagcgggaaagagaacgtgagcttcgggatgtgagaattcggaaaatgcctgagaacagtgacttgctaccagttgcacaaacagagccatctatatggacagttgatgatgtctgggccttcatccattctttgcctggtatgtaattcatcactttggccttaatatttttcttgtgcattcacacacagcaatgttagatacatccacaccttttgcacaaaagggctagagaagtactgtgtatatgtataaataaaatgacatttgttattgaaatatgatctgtttcctcttgcttattccctcagcactactgggtattttctcataccccccaagtcgataaaaactgactagtcctgcttctgctgtgacacctcagccggtgaagatattaaaggtgctttcttctcttcagtctgatttctctcgagaggtcagtagagagattgaatcagacacttcttcc

SEQ ID NO: 109404 - DNA, 1652 bp, Homo sapiens
tttggatgccccaccaatgtcaaatattaattcacagtttgtttttttagtagttcttgctacttcacttaatttagcactttgccatctgcttccccagtaaaactgaggtaatgtgagtacctgagctcactgagtacatgccacccatgtctacatttctgagtccttgtatttatcttagtctttattaaatgagtaacatagaaagagcacacatatggagttcacagctaaaagctttagttagtaaaatgcttttcagtaaaatgcttttgttgctttttttaatatgacttggcagaggaattatgatgatgcaagaaaatggcaaaatgtggttgatttaagaatttaacaagttttaccaaagtatttcttgagcgctattacatgtcatactacccttttagttcttatgtggaaaataggaaatggaactatcacttttaatgcctactaccttttgggcacacatataattgccacttcaattctttgggaaatgtattataaaccccattttacagatgagaaaattgtgggtcatgaagatttagttgtttgcttatgggtgactcctgccgagtacccggggatttagcatggaagggtctttgcgctttgtgttactgcctgaagatagttacatatgtagggtggaagaaggacattctaacttagtagggagcacccattaagttaaagaaaagcatgatgaaaaaaagcatcagtggttgggaattatgaaactgatttttaagcctagtttttattttaatgcaatataactaaaaggaactgttttataattagatatatgcatctttttaaagaattttatgtatgtatatatatgtatgaatgagatggggtcttgctatgctgcccacactggtctcaaactccttgtctcaaacgattcttctgcctcagcctcctgatatatgcatctttatatattttatcatatactgcagatcttcgagagagttaattattttgcatgctcctgtaaaatcagacatatcacaatttcaccattttgaagccatctttattctctccagttagaattaagagttccctgctatgtatctccacagtgcaatttatcaaaattcatatcccaccctcagctttttgaaagtgttcctcctggaggataatgcctatgttattcatcttcatttctctcccagtgtttataaataatttttttttacattttagatggattgtaagcaagatgaaccttttaaaatgttatgcttatttatatagaaagaaactccttgtaatttttatgcagaagcaagagggaattagtagcagtggttgtgttttgaaggcttttgccctgccagagtggctgtggattgaaaagttaaagggccattggtttgctagcagtatccaaccaaagtatagacttaaagaaaatttgcataattaaatttttggaacctttttttcctttgtttccttcttttttagagacattagaagaaatggacagtgagttgctcaagtgtgaattctgtgggaaaatgggatatgctaatgaatttttgcggtcaaaacgattctgcactatgtcatgtgccaaaaggtatttctgtgctcttgaatttcccaaaggacagataaat

SEQ ID NO: 109405 - DNA, 1046 bp, Homo sapiens
tccacaaagaacttgagagagaattgcttaattgagtagactttttaaagttaaaaaaaaaacccaactcttaaatatactgacagttattgcctttgtttttcagtgttggactgagctaccaaaatatttgcagtgcaggataactggatgattagtattaattctgaagataaagaattgctgaatattaagacttttttttcaaaaactccttgcctaaactcagacaataggttccatttgacagagactttgaagcagctgtactgctggtgaccagaaataaaccattcatgtccactctgcctcatcttttcccaaggaataaggcacttactaaatggatctgatcagttgaactagtaaattatcacaaataggtttcattttaagagttttttaaaccaaagtatttctgaatgtctttttggagattgtttcattttattatttctccttttttaaaggtgagtcgttcctctttgctaatagaacagcctgtgaaaaaacggcctcttttggataatcaggtgataaattcagtgtgtgttcagccagagctacagaataatacaaaacatgcggataattcatctgacacagagatggaagacatgattgctgaaggtttgtgggtttcacttaagataccctttaatttaactttgacttttactgcttaaaacaggatgtggatttttattctgtacagaatttcactggaagtattcaacttttattttcatataatgcaccatttgactaaaataatgggaaagctaatcagactctcaatggtcacataactaaaatagcaagattagtgctaatttcttcaatgtcagtttgacttttgaaggagtgtgagtgggaaaagttccatcatatgtgagagaaggcaattcagaattttagtatcaaaacaatcaattttctttcttttttaaagcagacttaagtaacaaatgagtattttagtgagttagcttaaaattttagagcttctgggttgtttcgtttcagactttctgcatgctgatgtt

SEQ ID NO: 109406 - DNA, 1029 bp, Homo sapiens
cctgggctcaagtgattctcctgtctcagcctcccaagtagctgagatgacaggcgtgtgccaccatgctctgctaattttgttttttttttttttggttttttttttagtagagatggggtttcaccatgttggccaggatggtctcgaattctcctcaggtgatccacccaccttgacctcccaaagtgctggcattacaggcatgcgccattgtgcctggcccaatttgttaaaggtctgaataactttgagcaagctaccctcctctataaagtggaaataatagtcgcttctaccttagaagattattgtacagattaaatgaggtcttaaggttcttagaacagtttttgaaagtaccagatattaactgttgttattatttattccttaattctctttcatttgcttgggcaaaatgctaaaaaaatttttaaatgactttttggtttttttttcagagcaagtggaattacctgctgtggcatcagtcagtgcttcagtaattaaatctccatcagatccctcacatgtttctgttccaccacctccattgttacttccagctgccaccacaaggagtaacagtacatctatgcacagtagcattcccagtatagagaacaaacctccacaggctattgttaaaccacagatcctaacccatgttattgaaggctttgtgattcaggagggattggagccatttcctgtaagtagcaagcatatttgtgtgtgtgtttgtaatttatataacattattttaaaagttacatattactgttctctaataaaaagcttgtaattttatttcaagaaagttgtccattttaatctagcatttatctttctacttcctttatttccaaatgtttatgtagaattttatgccagctaagtttagatgcataaactaagggaaaaaatgaaaaaaatttcaggacatatttttataatttttagagaaaggtagttggaagtttattcagtgaaatcaacttttatattttttctttcttttttttt

SEQ ID NO: 109407 - DNA, 1692 bp, Homo sapiens
ttcatcagcatctccctttctataaacatgtgccaccagtttgcagaaaaggcatgatggggggctccctaccacttgactgtgctaattcttacatatatttattcctgttgagtggcttctttgtggagaaaacctcatactgtcacatcaattattgaagtttttttttggtgagggaaaagggttaacaaaatcccttatttaggtagcatgggcttctgattgtctcattctctgcaagcaaaactagtgttttcctagatttggaatggcccctaaatttgagttcttagttacagtgattaattaactgtgctacaggattcacacacgtcttttgcttaatcacattagattattatacaaaatattttctcttcctgggtcaaatgatatatataccctcatctcagctcaaaaatggaaactcatttgggaagctttataagtaattaccctattagttggaagcacgtttagatatggattagaaaggatgagatctttattttatgaattttaatatagtatttttatgattttgaagttatctttatatatgttatacttgttctatgatgatactcctcttttcctgcaaagaagaaattcaagtgtataaactttgctaaaagttaatgtagatattcaggtgacctataaaatataataagaacaaaccatgtatagattcagattattaagttttaggcagttttcttttagaacttatcacagtacagtgtattttatgatattttctagttttccaactataaattgtcattaaatattcaggccaggcgtgatggctcacgctagtaatcccagcactttgggaggctgagttgggaggatcacttcaggtcaggtttcaagaccagcctggccaacgtggtgaaaccccgtctctactaaaaatacagaagttagccgggtgtggtagcgggcacctgtaatcccagctactccggaggcagagacaggagaatcgcttgaaccagggaggtggaggttgcagtgagctgagatcatgccactgcaccccagcctgggtgacaagagcaagactctgtctcaaaaaaaaaaattttttttttttcaaattactcttgtttggaaaacttgtaatagaattctgatgattatgaccttctgataatgaacactttttcctttagagtgatttaaaaatttctgtatttttgaaatcagtactaattgtcatttttttctctcacagcttcatattctccaattcagcctcattctctaataaaacatcagcagattcctcttcattcaccaccttccaaagtttcccatcatcagctgatattacaacagcagcaacagcaaattcagccaatcacacttcagaattcaactcaagacccacccccatcccagcactgtataccactccagaaccatggccttcctccagctcccagtaatgcccagtcacagcattgttcaccgattcagagtcatccctctcctttaacagtgtctcctaatcagtcacagtcagcacagcagtctgtagtggtgtctcctccaccacctcattcaccaagtcagtctcctactataattattcatccacaagcacttattcagccacaccctcttgtgtcatcagctctccagccagggccaaatttgcagcagtccactgctaatcag

SEQ ID NO: 109408 - DNA, 1712 bp, Homo sapiens
tactaaaaatacaaaaattagcagggcatggtggtgcacacctgtagtcccagctacttgggaggctgaggtatgagagttacttgaacctaggaggcggaggttgcagtgagccaagattgcaccactgcactccagcctgggcgacagagcaagactctgtctcaaaaacaaacaaacaaacaaacaaacaaaaaacttcctttgttccagcaacctcatcgggtaagcatcttttttctgtccttttacaacgctgctttgctttttaaagacttgttttatacttaggtgtaagtgtaaaatattccacttaaacctatttcacttctcaagtttcctgtgttaatactgccagcattctctacatcactgaatctcaatactgtggcattgtctgattaccctagttagaaatttctcctccctctgaacttttatggtcccttctggttctctttcctttatagttacttatatactgatcttagcttgtctgctagatagtaagctccttgagggtaagataataatattgggcatttatgtatgtgtgaggcactgtgttagtactttacattaactctttaatccctttttggattcatcttttcatccttgtatcttgacagcactaagttgtatcttatacgtacttacgtatgttaggtaggaggtacatatttgttggattaatagttcatttttttttcccacttggattttgggaattattgcagtctttcttattggtactaattaggtatcactatacttagaattgttaaatctgaatcttatgtaagtaggctttgatataatgtataaattaataaatatattcaagctgggcgcggtagctcacatctataatcccagcactttgggaggctgaggagggcagatcacctcaggtcgggagttctagaccagcctgaccaacatggtgaaaccccgtctctactaaaaatacaaaaattagccgtgcgtagtggccggcacctgtagtcccagctacatgggaggctgaggcaggagaattacttgaaccggggaggtggaggttacagtgagccggaatcgccccattgcactccagcctgggtgacagagcaagactccgtctcaaaaatatatatatatatattcgtagtatagttagacacgaattcttattttttttttttaaacctctgtgtgctaggcgctgctctctgtatggcataaaagctgggtttttacactactgtacagagtattctcagcctcaaaccagcgtctggctagttttgacagtgtggagcaatggtgacccatggtccttaggatgactgctcagggacaatttctagtgattcctgcagttttgataaattataatgaaaggtagattgatttctttctaaagagaacgttactttcagagaaagccgggaactctttcagggttagttcaagcaaggaaatctagttttggatttttcagtcccccttaactctcaatatctggttctgaattgcagcttattctcccctctttcattaatagtgtgataatatgcttatagtttgcattcctctgatggtcaatatcttgtgtaagtatggaggaaaccagtaagccaaaaccaccagagtctcaggtcagttttaagtccaaattcagatcttacatatactccaattttccttgatgttgttgattataaaca

SEQ ID NO: 109409 - DNA, 1244 bp, Homo sapiens
taactaatagtgaagggagaaaagcaaccacttaaagaatttacaggccgggcgaggtagctcacacctgtaatcctagttctttgggaggcagaggctggtggattgcttgagctcaggagttcgagaccaacctggtcaacatggcaaaaccccatctatacaaaaaatttgcagggcgtggtggtgcgggcctgtagtcccagctacctggggggctgaggtgggaggattgcttgagcccaggaggtcgaggctgcagtgagccaagatcgagccactgcattccagactgggtagcaaagtgagaccctgtctcaaaaacaaaacaaaacaaaaaaagaatttatagtttccaaggtgaaacaaacaaaccagctgcttaggaaaacacagctgattttaacatgttctgaggagcacaatttttcttgctggtactcatgaagaaaacatcttacttcatatttaaaggtatttttaatgtgaatagagtcaaaataatttataaaagtggtctttggggtccagattgatgtgttctaattatgagcctctgtgatcggacttaattcaaagatagatttttgaggggctagaggaatggattgaactttaggaatttctctatggatattgtttctcttctctgtgcttttgaaatggcagtgagtgagtctggcattggtaggtgatgctcacacttatgcattccagtgataactttcgtcaagttcaagactgttttggaaaatttctgcataactttgttgagttttagaattatatttgcagttaaaatttttattttaattgtgaaataccaaatctgaagttgtattttaatattctttaagctatagaagtcagtacaacagttaatttttccttagtattaaacattcttataccatagtgtaaaaatgagaaatttggaatatctcacttttatttactatgttaaatgctccattccttctccccaccaggcacacccacataaaaaaagatttttggaaagatgttatagggcagagtgtgttaagagatgagccgggcataatggctcatgcctgtaatcccagcactttgggaggccaaggcaggcagatcacttgaggtcaggagtttgagagtagcctggccaacatggtgaaatcccgtctctactaaaaatacaaaaattagctaggtgtggtggtgggtatctgtaaacagcctggctaacttgcaaggctgaggca

SEQ ID NO: 109410 - DNA, 1034 bp, Homo sapiens
ttctcctgcctcaacctcccgagtagctgggattacaggcacgcactactacgcctggctaattttttttcttttttctttttttttttttttttaagtagaaacagggtttcaccatgttagccaggctggtcttgaatctcaggtgatctgcccgcctcagcctcccaaagtgctgggattgcaggcgtgagccaccacgcccggcctcgatatattcttacagtggaatactgctcagaaatactgatgaatcttaaaaaacatgatgtttagcaaaagaaccttggtataaggttcttggtataagggatacatactctatgattccattatatgaaattctagaacaggaaaaactatagtgaaaaacaatcagattagtggtatctggggtagaaagtaggaggagattgattgggaaggggcatgagtgaacttccatgattaaggtgatgttctgtatattggttggggtagtaattatatggtatatagatatgtcaaaactcattgttttgttttattgtatgtaagttacacctcaataaatttgacaagaatgaattagagtgagtacattttaaatgaaaacaattgagttagagtgttactttgcatgatattgctgtattctggtattcttcataatgaatattttagactgcatatggcagaaatgggtattttagggtcatctttggcttcttatttgtaatataatagttctcaatcttctggtaaaaaataaaaaatgaggtagtaataatattccttggtatttttgataaaacctctatatattatttcatttacaagtaaaggctaattttcatgtattaatttataaagatgatggtcggttaaatccagctttcttctaacttgccctggcattctctacagttaactttattggactttttttcccccgtatttataaaatgagaactttatctctgttaactttaagatttttcagctctaaactttttatgtctctgtggaatgaatatgttgaagtaatgatcatc

SEQ ID NO: 109411 - DNA, 1042 bp, Homo sapiens
ttttttgatgtgaagatttttttgcaggctcttttgttgttgaacttttacatgtgtggcatttacttttagaatgaatctttctttcttttctttttttttttttgagatggagtcttgctctgtcatccaggctggagttcagtggcatgatctcagctgactgcaacctccacctcctgggttcaagtgattctcctgcctcagcctctcgagtagctgggattacaggcatgagccaccacacccggctaatttttgtattattagtagagatggggtttcaccgtgttggccaggctggtcttgaactcctgacctccagtgatccacctgccttggccttccaaagtgctaggattacaggcatgagccaccacgcctggccatagaatgaatatttctttacaaatagttttaaaatgaaagggcaacctggatttgtcctttagatcctttgtagctaagtgaaatattggagtgtagtatgtggcatagttatccttatgataaagaggactgaaaagacttttttggtgtttctttttgtttctcactgaaatttaatttgtgtcccaaaatagtgactagttgtttacttcccattttaggaatcctgccacagtagttctgagctaggaaaaatttaactataatagcttatttgagacacaatttggtctgagaatttcatatcaccaaaatatattttcttttttgagtactgcttttttttgcactcatcagaatcatgagctgtttcaaaaatgtttatgattttttttgagttctctattatcagaaacttctctttgtcatgtagaaccttttgctgaggagataatcctaaactgcattgtctttctgtcacaaatttcagtctctcttgcctgctacacattgtgtgtgggacatgttcttttgtcttagggtatttttttggttttctgtctgtacagctgattttcacacccgctaccactgtggctgctgtacagtctgacattcctgttgtctcgtcgtcatcgtcatcttcctgtca

SEQ ID NO: 109412 - DNA, 1121 bp, Homo sapiens
tctctagatctaataacatttaatttttttctaatttttattttattttattttatttatttatttttttggagatggagtctcgctctgtcacctgggctggagtgcagtggcgtgatctcggctcattgcaacctccgcctcccaggttcaagggattctcctgcggctgcctcccgagtaggtgggactacaggcgcccaccaccacgcccagctaatttttgtattttagtagagacgggttttcaccatgttggccaggttggtctcccaacttctgacctcaagtgatccacccacctcggtctcccaaagtgttgggattacaggaatgagccatcttgcccagccaatttacatctagtttttaagcaagagattaatagcactgaaaattcaattttattggacaccacatcttacttagatgcctttctcatggcctgcacccgtcttttcctagcaaggaagcttttcagtgaggggccttcagttattacctagtgctagtagtttggaggaagagaaacaggtttcattaattagtgataaactgtcaatgtatgtgcttatccttatataaaattacttgctattatgggatagactttaacaaggcaacatctggactgctcatttctttacattatatatgtatggaaatttttgcagaaagcttgtgaaagttctttttaaaccgctgctgtcaagtagtaataacaatacagaggattccttctgtgcacatctagaaataaaagattaactctttgcatatttggaatagctgcttcagtgaagaagtatgtaggatttttcttactgtgaacaagtcttggcaagacttgtttttgaaagaaatgcaagattattttagcaatatactttagtaatggttctgaggaaatacaagtggtatcttgagggttggggggatgttagctaattggtcttagagcttcagccatggcacctaatcctagggcagctgatccatagcttggccaaagagagaaaaaaatagagcatgctagcctggtgccaaaaaacccaaaccaaacacaaaaaaccctcagaaatttgaatgagaaaatatggagataaaattggtcagcactg

SEQ ID NO: 109413 - DNA, 1016 bp, Homo sapiens
ggcgtgagccaccgcgcccggcctaaactttcaattctgtattaagctatcctgagatttctaattgagagcattgcaactggtctttagtatcttaattttaaatagtaaacccattgctatatttgctttaaaatatgactttgggaacctgttgtaatctttctatggtattaactattactgttattaccattactgtgggatgttattattaatgactaatagacaatatataaaataatgatggacttaaaaatatgaaggtggactagatttgatcgtttggaacctctttctctaactatatttgagaaacatattaatataaagaccactggatgaaaagttgttggggaaaaagatatgcttctggtacaaaatatcactttacagattagttacaaagactgaaatgtacctttacaatgaagagatctagcagtcactacctttaatggttattgaacatcagtagtgggagttgataatccgacatttgtgtacctcatgaaaagtaatgagataagaaatacacaacactacctatgtgttatttttgccaaaggtatttaatactgcctctaatcgtaagtaaacagacaaatccagaatgtgggatataatatgaaacaactaaccagactctttaaaaaaaaaaaaaagtcaacataatgaaaaggaagtaacaacaaataaggcagagtgaatgttttaaaatgttaaggagaccaaaaaaagcatgatcaaatgcagtccctgaatcttgattgcatcctggatagaaaaagtgagctttgaaagtcactttggggcctggcatggtggcccatgcctgtaatcccagcgctttgggaggctgaggcagacagatcacctgaggtcagtagtttgagaccagcctggccaacgtggcaaaaccccatctttactaaaaatacaaaaattagccgggtgtggtggtgtgtacctgcaatcccagctactcgggtggccgaggcaggagaattgcttaa

SEQ ID NO: 109414 - DNA, 1048 bp, Homo sapiens
tgtgctctcactagcttacattctatgtatcaagcttccagcagactctttcatcttgatgtctcattataacttctgaatttatcatgaaaaacccaatcgttctctccagtaactttgtcaatcttatcctagccacacacttgacgttccctgtcagtggtacccccaatctcttggtcaccaaggttaatgtgtttttttaattcctgcatctctattgcctctgtacccaaaagttatcgtatcctttttaagacatccttcgatgtttttgtgatttcaactccctccccattcttattaccatccctcttatctcaaaattcatccatataatctggatagttagattatttggtttggaatgacatttgaaaaatattaagaacttaaaatatttttatgttaggaaaatatctttaaatcgttataggtacaactaggtgttagaaatataatgtactacgcaaagcatttcccattataactctgatacaaatgttctcaacaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggtaagcactgcatattttattgcttctaaactgcttgagaatactattcttttttttttttgaaacggagtttcgctcttgtcacccagcctggagtgctagtggtgcaatcttggctcactgcaacctctgcctcccaggttcaagtgattctcctgcctcagcctcccaagtagctgggattacaggcatgcaccactatgcccagctaatttttgtatttttagtagagatggggtttcaccatgttggccaggctgctcttgaactcctgacctcaagtgatccacccgcctcagcctcccaaagttgctaggaatataggcgtgagccaccgcacccagccaagagtactat

SEQ ID NO: 109415 - DNA, 1035 bp, Homo sapiens
gcttgtagtattctttctattctcgaccccattagtggttcttagccttctcggaggatcacgggtcccttagagaagtgatgaaagctttgaggactctgtagatactgtgcatgtacatacgggcatacacctttgcccccagttgtagaagtatggactgcctgaagttcacccaaggacccagattgagaacccctgtttgagactatcaaattaatagctttatgaaaaatgtgagtttaagttagacaggaacttttacaattgtgtcttgggctcagatgttttaaagtggtacttcagttcatttttcaaatttgttcctaaaatcactgggagaaaaaaatatgttttaatatgaatttttgtgtttccagttgtaaatgtagaacttaaatatggttgaatcaaatgacttattttttatttaattttagattttactctgcagaaatcagtctagcattaaattatcttcatgagcgagggataatttatagagatttgaaactggacaatgtattactggactctgaaggccacattaaactcactgactacggcatgtgtaaggtgaggaaaattttctagttattttaaaaggtcttcagcagctagtagtctttgtaaaataacttcatgtttaaagatgaggaaatgattactaattttgctaatttacttaagctttgtggaattctagcacaaagacaaatgtactttttttctaaccatttgcaaaatttgtatcttctgtgttatgtgtactacaataagagctaatttctttttattatacataactttttatcttgaaagttgaaatacaattgaagacaatttggaaataaaaattgtctgcaattccactacttaacacaaccatttgcatatgaccttccaatttttgccatttagtagtgaatcttatataatgcattcaggattttcctcagaagtcaaacattttttatatttaaattttaaacatctgacataaagcataataggataaaacaagaatttcagtta

SEQ ID NO: 109416 - DNA, 1011 bp, Homo sapiens
aggctggagtacaatggcacaatctcggctcactgcaacctccacctcccaggttcaagcaattctcctgcctcagcctcctgagtagctgggattacaggcacctgccaccatgcccggctaatttttttgtatttttagtagagacggggtttcaccatgttggccaggctggtcgcgaactcctgacctcaggtgatccacccgcctcagcctcccaaagtgctgggattacagatgtgagccaccatgcccggcccttacgtatttatattatacaagttttcaatcataaacaattagaaagcttagcgagtggaacccctatgtacctatcacttatatttgtggtacctttttgatctctgtgtcattttttttcctaagggatttttttctcatttcagaaaaaagtgacagtgatagaggagtcttatccccaagaataaatgaaactgaacaaaaaacatggagagtattacccttcatacgaagtgcacaaattaaaacaatgaggcttttttttttttttttttttttgcctgtgagatacgggttttaaagttagaatagcctgtatgtacaagagtttaaagaaatgggcatatgtcactggtgtgtatataaattgttacaaaccttttgagaagcagtttgatgggggaattatcaggaatcctaaagatggccatgttctttgatccggtaattctgcccttggatattctgagtaaatattttggtttatgaggagagatttctgaccaaaacttttattgtagtttatgatcaatattataaagtcatttaagaagatctttatttttattttatttttactttcttttttttttttttaaatagagacgaggtctcgctgtgttgcccaggctcgtctcaaacccaagagttcataatgttagcatttagataatctccaggctctggaggcactttcctcaggtgaatggggaatgcagttcatacatttacatatttgtcatgttacta

SEQ ID NO: 109417 - DNA, 2060 bp, Homo sapiens
cctaataattttgtccttttttactctttgtattttgaggccatgttgttgagtgtatgcaagtgtatatttgttacaatttcttggtgattgtcccattaattattgggtagttcctttactctgcctgttagtgtgttttgccttattttttttccatcctacagctattaaaatacaggcccggcatggtggcttatgcctgtaatcccagcactttgggaggccgaggtgggcagatcatctggtcaggagtttgagaccagcctgagcaacatggagaaaccccattttctactaaaaatacaaaattagttgggtgtggtggcacacgcctataatctcagctactctggaggctgaggcaggagaattgcttgaatccgggaggcggaggttgcagtgagctgacattgtgccattgcactccagcctgggcaacaaagtgaaactctgtctccaaaaaaaaaaaagtgttcttaggaaaaataaacagaaggaaaatattgtagtcttatcaatggttgtattaggaggtgagatttaaagtgcttcttttcttcatgaaatatgccttattctactaatattaaaattttgttattaaattttaacttgtatgtaaattattttaaattcaagtcgtaccttaattgaatcaactctagcaacatctaatgaggacaggttttcttcaagctatttagtggtgatctgtgattttaataataaaggcagttgccaggcatgatggctcatgcctgtaatcccagcactttgggaggccgaggcaggtggatcacttgaggccaggagatcgagaccagcctggccaacatggtgaaaccctgtctctactaaaaatacaaaaattagctgggtgtgttggtgcatgcctgtaattccagctactcaggaggctgagacacaagaattgcttgaacccaggaggtggaggttgtagtgagctgagatcgtgccactgcatgccagcctgggcgacagagcaagaccctgtcaaaaataataataataataaaggcaattgttctagtgatgttaagtgagcttaatgtatcactgcagatgctgaacttatatgataggtgaaatagaaagggtgaatttaaaacagaactttttatctcattctttctttctgttctttttaataaaaggaaggattacggccaggagatacaaccagcactttctgtggtactcctaattacattgctcctgaaattttaagaggagaagattatggtaataaataaattggtggtattattttagctattgctagatgggtggtaaaatgtggtaccaattgcattacagtacactaatgcattttgacgtgatcttattaatataaggattcttgatcctgttaaaaactacatggagagtcccagactttgaaatcgagacagtgggaccttggcagtatttgggggtaccaagctgaataatattttattagtggcaaacactaaacagtagcaggcactattctaagcagtttacatatattaactaagttaatcctcttaacaaccctgtgaggtaagtactattaattctccttttacagttgaagaaactgacatacggaaagtttaaataactcgcctaaggtcaaggattcagaacagcacccatgtgactccagagtcatgaacccctggaaaatttttcagatttcctgggatatttgccccaggaatctgaaagatggtggaaagattaactgtatctcaggcacccgaagatacacttatcttgagaaaacatttgactttttgggttttggccctctgccttcagcagatataaaggacaatgtggtacttgtgagagctgctcaaagtctgaatccactgtccttcactggtctttatcagctagcaaaagatcaagtttaagaccaaggaggcaggagaatggcgtgaacccgggaggcggagcttgcagtgaaccgagattgtgccactgcactccagcctgggcgacagagtgaaactctgtctcaaaaaaaaaaaaaaagcccctgtcca

SEQ ID NO: 109418 - DNA, 1105 bp, Homo sapiens
ttagccgggcgtgttcacaggtgcctgtagtctcagctactcgggaggccgaggcaggagaatggcgtgaacccgggaggtggagcttgcagtgagccgagattgcaccactgcactccagcctgggcgacagagtgagaccccatctcaaaaaaaaaaaaaaaaagaccaaggagattactctgaaatacaatttaattatatcctcaacacacaatattagatattgggcatgagtctgaaagtagaaatacatggagaaagaaagtttttttttctcataattttatttttaaaattatcttttaggtacctacccttgttgataaatgaagcatttctataatcttcagtgcctaccatgatagttggaatgcatttagagtttactttttcattgtttctttttcctttatgtgataaaatttccagttactaactttcaagaatgcaaagtgtataatttattgctttaaaatttctttctgaaggtttcagtgttgactggtgggctcttggagtgctcatgtttgagatgatggcaggaaggtctccatttgatattgttgggagctccgataaccctgaccagaacacagaggattatctcttccaaggtaatttggagtattttacagagattctctgagaaaaacctattctagagtacaaatgagagtgattcaggttactactttgagtaagaaaaatgagcataatctggaaaatataatcctgactggtggtattaggttttgttgttgtttttgtttgtttttgagacaaggtctcactcttttgcccaggctggagtgcaggggcgcaatctcggctccatgcaacctccacctccctggttcaagcaattcttctgcctcagcctcccgagtaactgggattacaggcacactcccgagtaactgggattacaggcacacaccactatgcccggctaaattttgtatttttagtagagacagggtctcaccatgttggccaggctggtcttgaactcctgacttcaagtgatctgcccacctcagcctccccagcatgctgagattacaggcatgagccactgcacctggcctctgtgtattaggtt

SEQ ID NO: 109419 - DNA, 1612 bp, Homo sapiens
agttattttggaaaaacaaattcgcataccacgttctctgtctgtaaaagctgcaagtgttctgaagagttttcttaataaggtataaattgtgtataagaatattttgtgatttgtctctttctatatatatcaaactggtcagtagcggtttgggaaatgtaaaattccaaaacagtagagaatgtaactttttcagtttgacccagaatttgtctcttacccaaagagtaattgacagcattagatcctgagataagttagttgtcctttccattttggcaataaaatttactccccagctatatattacataatttttgtgtatgtgtaaataatatataccatattctcacataggggaagagttaatctttgggtttagccataattgtactttgaactctgtttccattttctctgtatcattatccatagaatctatttattaccatgtactttttgagcacgtgggccgcagtgctccctacaaattctcatgtcaaaaatgctataattaggtaagattcggaagaaatgaaatgctatctttggctcttaaaaatgtgaacatcattcaattgtttgttgctgttggtaggctagaggagttttaggatctaggagtgtggtcttggcaattataaattctactttaaataaatggtatgatagaaaagttgatgtacatttaccttctaaggtaaatagataagataatgagttttaataaaataagaaattgaagccttttaaaaaatgaacaatttatgtgaggaaagatttaaacttgaaacctaatttttcacatagtgaaaaatgaaggcaagaggtgttgatatgcaaaataaaataccttttatcagaaagaaaaatgggaacatattctcattcatagtgatgaataagccaagactttttataagttgcaggctcctcagtccagtgattcagataatggttgtatcattgtcttacacaggtggtggtttgttgctataattgggcatggggattttaaattaagctaaaaacaaacttctcatgaagtttggaggtttgcatgttttgactctcacactaggtcatgcaaagaaatggctgggtgctgtcaaatgattctgctgttctctttttcctcctgtttttctttagcaaggaattggtgatgattctctgttttaattacatgatgggtggagaaagtgccttgaggaatcacaagtttcaaataactcaatttgttctggagttgtactttctagaaataaaaggtagaccattccaacttcagaaataagagtatcatgtgagggcacacaacacagatcacaaagatgatttattttaaagcatgacattcacccaattcttgaaacatttctttcaccataggaccctaaggaacgattgggttgtcatcctcaaacaggatttgctgatattcagggacacccgttcttccgaaatgttgattgggatatggtatgtaaattttgattactcaactattaggtttcattattatcttgggccaattttttgttgttgttctgtttgtttttagacagagtcttgctctgtcaccgaggctggagtacaatggcacgat

SEQ ID NO: 109420 - DNA, 1051 bp, Homo sapiens
ccaaatctgactgactaaggcctgtgctctttctaccacgctgcactgtttcccatttgacaaggactgtctttgagttcctgagtattgccttaagatagattcctagaaagagaattaggtcagagggtattaacattttaaagctcttgtattgccaaattgctttttttaagaaattacattgagttattaaatccagccatcagtgatctggtatattttttgtgcttatacttcatcttttaaacatgtagtttggaataattgggagatattttgattatttacctgttgttacagattcattctctctaatctcagggaggcccttattgtttggcagtcatttcacttctatctcatttcttaccacatttctcccagcacctgctccaaacagtctcttcatttcagaagccttcagttctactcctttttccatcactgttaatggattaaccttgtcttaatttgatgcaaggactgataacctctctgacgtgaccttgcctcctttgcagctgtccccagaccaccttgcatctcagaattgctttctaactcttttcatcattttcttattccctactcttggaagactctcctttacaaggggtgtccctgctattttcctagacctgtttccttagttttctccaagatttcattttgtcagttatctttttattagaccttctttatttttttctagcttgtttccctctgtgtaagcatgctcagatactctgatttttccccctaactcatggcccctctttgaacaaccacgtttttcctcattttcatttcatcttaaagcctcaaaaaaaaaaaagttaatagatgttcatggtcaaagaaaaataaatacacagcacctctaatcaaacttcttcagactagtcaacattgattgtcttgaattttttttttttttttttttactgtcaacacttcaaccccttacaatcgaacctgtcctccagcttttgaaggttgaatcaatttcttaatttctaaattgtaaagcattttggggtcagtcctc

SEQ ID NO: 109421 - DNA, 1014 bp, Homo sapiens
aaatggcaaatggttattgagcaaaaggtgttatggtaaatactagacattcaaagacaatcaagacagtctgatctccccaaaagcgtgctgtctactagaggagaaagatgtgtaccaagtcattatttctgacagcattgtgtattagaaggaacactggatttaatcaaaagataggagtttgaatcccgatgccacctcttaccaactgggtaaccttggataggaattgcataacttctctgagcctgttctcaaattgcctacctcataaggttgctgtgaagaataaatgcatgatggtttctgaagcacttatcccctgccgttagatctcctgagctgcatttctgtttaacacggcccccagtttgtcagccaagcagctcaaatatatgaagtctaaaatgaaagtaatgaccctttatgatctctttctattgttctcaatcagttcctttttttttagttacctaattctgctcacggtgtgtccctgttgttcagattccagatgtcagtgattgtggactcctcctttttcttaacagattacataatacctgcagctgccaagtctttgtctgtgttttcattatttcatcatttacatcagatctttcttttctcttcccgttgacacaccctagttcaggcctcattcaagtcatacccagagtattgtatcagcctcctaattgatctttactccttcactttgcaacctattctgtatgccttgtgaagtaccactccaattcttgaacccctttaattagaaaccttcagtaactccttcattgcctatcaggtaacatctatcctcttggctagcatttaaggcctccccacatctgctccagcctgactttctagcgatacctctcaccataatacaaacagtgttctgatcagtcttagctactcaccattccctagtagtattattgtctctgcttctgcctgttcattcctgtgtatcccgccttcatttttacctattgaaatttt

SEQ ID NO: 109422 - DNA, 2667 bp, Homo sapiens
gcagtgactcaatgcctgtgatcccagtactttgggaggttgaggcgggcagatcacttgaggtcaggagtttgagattggcctggtcaacatggtgaaatcctgtctctactaaaaatacaaaaattagctgggcatggtggcacatacctgtaatcccagctactcgggaggctgaaacaggagaatcgcttgaacccaggagatggagttggcagtgagccaagattagcctgggcaacagtgagtgagactcggtctcaaacaaaaaccaaattgggaaattcttcttgagttaaaaaagacactttttattatgaatcagattccaaatcattaactatttttgcaaaactggcacaagtggtttttctttttaagtatattaacagggtagctcctgagcctttccctttattggaaactttaactgcagtgttaatatatacactgcaaaagaccaaggatgcagttgaatggaaaattactcagtgtatagaaaggaaaaaaaccagaaatttaaaatagatacagaaaagtacactggtaatatttttatttcctattggagagtgaatccccacagttgctttttgtgacttgattcaaatgaggcactcattattgttaccaaacttgtaaaagcattccatgtattcagtggaggcagaatgtataatattttttccttataatttagcatacaggaaaagtatttattttttaagtagggtatcttaattatgctcatttcttcccctaaaccacattatctatatgattggaccctttagtgaaatcagaaaaataaagtaggcatgaataaatgttcaggacacacacatacactcacacacatcacagtatcagctctttcagtgagtttttattaactagataacacatgtaatacatagtagaatacatttcagaggcagagttcctcggattattttttatggatattagtgttcagcagcttattatttaaaggggtgccaaatatagcatccttctgttgtttattttaaatatatttttaatgaaaagggacttaaaaagtaaacatgattatctaaattacttaaaattttttaatcttagtaaaaattttaggaaagttatctagtttaaatttcaaatgttttaaaatttgtaggcatttaataaattatctttttttggaggggtggatgctgcatttcattggaaatgtcatttttccaaagtttctagctatatactctctttccttcaaataacataagtctgaaagcaatgaaaacgtcaaaggaaaatgtttatatacatccacatgtttatttaatatgtttctcttaacacctgaaacttgttttaaaacaaaaagcagtattcacttcaaatcataaacttagaattctgtatctcatgtcagaaatatgtttatggccttgcttttaagtggtgctgtttcccatagggcattagttctcagattttggaatgtgaaataatcacctaggaagttggtttaaaatgcacactagtgagcccaccttagacttcttttggggccttcgacctcactttgagaaataccttcttcaggttattctttatgtttgtcctgtggttaaatattagagtattcatgataaaacattttgagaaggggtaagcagtgagttattacccacaatttaaagcaaattttgaatgaatctttaagttaggtatctaccttcccaccagccccccaaaaaacctctcagtagtttctttcagtgtacaaaatgatgagcatttttctatgatgaggttttaaccattattcagggtggtcttttgtttttaaatctttttttaactaataagatttacggtgtgtattttatacagaaatgcattataaatgtttttaattgtgttctgttttttgcagtctttaagtgccatgccaattgttcttatattctatagaagttcgctcaaaatactcaacaggggaataggcagcggacagtcagaatggttggaattttggctttctaagaaaaactttattttgcataagcatgtggtcagatcattttgtgcatatgcagcctggattggatgttaagtaaatgcttgttcagtgccggtacatttacttaaatctgtttttatttttgtcatgtagaatactactgtggtcatcataatgtaatctatttctgtaccttttttttttttttttactttgaagtctttaaataaaatgtataatacccattgagagtggatcatttttcatatgtagtatgtcagaaatttgtataagaacaaagatgcatcaaaatttgttcaagaaaaagtgaaaatttcagagtttggaattttgctgtacttaaagcaccattctggtagaactgatgctgtcgtatttacatttaataatgttacatttagctggacatagtggctcacacagcactttgggagactgaggtgggaggatcacttgaccctaggagtttgagttcagcctgggcaatatagtgagaccccatctctacatacagaaaaataagaaattagccaggcatgccggcaaagtgcctatagtcccaggaggctgaggtgggaagactgcttgagcccaggaggttgtggctgcagtgaactatgatcatgccactgcac

SEQ ID NO: 109423 - DNA, 1017 bp, Homo sapiens
ataaacagtgtgagtgcctttcttttttcttttctgtctttttttttttttttttttttttggtagaggcaggatctcactgttgtccaagctggccttgaactcctccatctttctgcctgagcctctcaaagcactgggattacaggcttgagccaccatgccccatctctacttcttttcttgattacaggcatgagccaccgcaccccgccttcccagataggataagtattttatcctaatttcaactcttgcttaaaatgaagttctaggcagtattaagaaagtactttccaggctattccctgtatcacatcataaatttggtggttttctgtgagtgagtaaatcctaaaacagactccacagaggaacttgaagctttagggaaatttttcattaaggcattccatcactgggataaccagtttctccccgaaaggtacaaccaatctccagtccttgaaattcaacagcttgctttgtggacaatggctaacaatgagtcatttggtctatctgaaggtctcctttcctagatttgctcttgtttactctaggacttaaggatcacttaagaaccagatggctgggtgcagtggatgacgcctgtaatcccagcactttgggaggccaaagcgggtggattgcttgagaccaggagttcgagaccagcctgggcaacatagtgaaacaaccgtctctacaatttgctgggcgtggtggcatattcctgtcatcccagctgctcgggaggctgaggtgggaggattgcgtcagccctggagggtgaggctgcagtgagccctcgagtctgggtgacaaagcaagacacttgtctcaaaaaataaaaatctgaatagtttatatccctagcttattccagaatatactggaatttactgtgcacgatgctaaataaggctaataaaaacaacctctgcccttgatgttaaacgtagaaaacagacatactgagatgttcatctccacaatgaatagtccagtgacaaa

SEQ ID NO: 109424 - DNA, 1300 bp, Homo sapiens
gcggggaccccggagacccggacgcccgtcaccgcccccctcccccagtccagcagcgctccgcggggatgccctggtctcgacccggtccgtcagcccccggcggcgcagggatccgcgcccggcgcctaaactgccctggtgtcctcttcgttctggcccggggctggcgcggggaggtgcagcattaggggcgctgaggtgacacccgagaacttcccagggagagggtgcgcgggggggtggatttccacagtccttcccgcggcccccgcgggggggcggtgttgggagggcacttggggttatcccaggctcgccggtgggggtggggggactcctccctttacttccctccacccccttgcacacccacccccaggcttcccgtgtcccttgttctccctctctccgggttagagataggtgggtggctttgagtgggcggaggacttcagggttttaggggctcccccattctaggtcatgcctcttgctctcttccttggcctgtgttgagtaaggtgtgttcctgtggtggacgaaagtctgtacgatggttggtggcattggtccttaatcctttgggtctgttttaaggtaaagtgctgagagtttgggaagcaaaaatttctatttattggatttcttttggcttttctctcaagaaggaagtggaaaaagagtcttttctttttccctcttcctccatttgcattctttgtgaggtttgtctgccttgtgctttttgtcccggattagtcttgttgaaggatggagattcccaggcgtggagtctatagcttttggcttccattaagtaaaatcgctaacctttttttaagagaaagttaatttttgcctgcagtcattccagaaaaatagtgtacacggactagctgaattaatccacttaaaattgtaacttagttacatatggtagatatgttaactcctatctgatttttttggatgaaactgttgttttgtttttaaataggagatgaagtaatggatttttttccctcccttaaaatggcatagctgagaaagccccggtactactaattgagatgatctgcttaagagtcttcatattctgaactcgaaaggccttttatgttatattattgctcgctttacgcaactccaaattgctttcctatttaaatgaatgttcttctagtaaactggtgttagatttaaagaaatcactcaagcttcaccttggtaaactgaactcagtttaagattaagaaactgatttcggccgggtgcggtggctcacgcctgtaattcc

SEQ ID NO: 109425 - DNA, 2237 bp, Homo sapiens
actaatatggtgaaaccccgtttctactaaaaatacaaaaaaattagccgggtgtcgtggcttgtgcctgtagtcccagctactccggagtctgagacaggaaaattgcttgaacccgggaggcggaggttgcagtatgccgagatcgctgcacttcagcctgggcgacagagcgagactccgtaaaaaaaagaaaaaaaaaaaaataaaagaaactggtttcaaattggccctttggcctctggagcaaattcaaatgtaactcttccccaaccccccttctcttcttccagattaattaaaagaagaatgaactataatccttgaagataactgggcaattttttaagtcggaggctgttcttactggtgtgaggatttacacacgtcttcagtttttcagcacagaccagcagaccatcatttttagaggaaatactccctctgccctcctttttggtttccttggtggtaaagattaaatttggttgcatcattttgacttgtgtttgagtctagattttatggcacaaggaatggcataaacttttcatgtgttttggttaaaacaaaccagaccattgcattgaccctggacatctttaattgagaaattggtaactttattttaatatgtatatctgaagaattcaagaaaacaaaggcatcctcagaggtgtgcctcttttctttattattagaggcaaaacgaacaattttataggatttgtagtgaaattataccagattataaggagaaccaaaactaagtcgcaaaatttattaatttaaggggctctcgctttgaaagtttgagagtaagttacgataggcatttgtatccattcattactttcctcttttcaaataagcaactaaatagaaatgctaatctcagacttaattatttaacagaagagtgtaccatggaaaacctccagacaaatttctccttggttcagggctcaactaaaaaactgaatgggatgggagatgatggcagccccccagcgaaaaaaatgataacggacattcatgcaaatggaaaaacgataaacaaggtgccaacagttaagaaggaacacttggatgactatggagaagcaccagtggaaactgatggagagcatgttaagcgaacctgtacttctgttcctgaaactttgcatttaaatcccagtttgaaacacacattggcacaattccatttaagtagtcagagctcgctgggtggaccagcagcattttctgctcggcattcccaagaaagcatgtcgcctactgtatttctgcctcttccatcacctcaggttcttcctggcccattgctcatcccttcagatagctccacagaactcactcagactgtgttggaaggggaatctatttcttgttttcaagttggaggagaaaagagactctgtttgccccaagtcttaaattctgttctccgagaatttacactccagcaaataaatacagtgtgtgatgaactgtacatatattgttcaaggtgtacttcagaccagcttcatatcttaaaggtactgggcatacttccattcaatgccccatcctgtgggctgattacattaactgatgcacaaagattatgtaatgctttattgcggccacgaacttttcctcaaaatggtagcgtacttcctgctaaaagctcattggcccagttaaaggaaactggcagtgcctttgaagtggagcatgaatgcctaggcaaatgtcagggtttatttgcaccccagttttatgttcagcctgatgctccgtgtattcaatgtctggagtgttgtggaatgtttgcaccccagacgtttgtgatgcattctcacagatcacctgacaaaagaacttgccactggggctttgaatcagctaaatggcattgctatcttcatgtgaaccaaaaatacttaggaacacctgaagaaaagaaactgaagataattttagaagaaatgaaggagaagtttagcatgagaagtggaaagagaaatcaatccaaggcaagttttttatatcaatttttaataatggtaatggtttactttgaaatgaaaattctatgtttagtgtgtaacttaacctgtatgttgaacattgctcatgcaacaacaacaaaataccgattgatatatttgtattgcagtttttaggccataaagtgctttgcagtatgtttcctcatttgactttccaaacatcctgtgagagaagta

SEQ ID NO: 109426 - DNA, 1048 bp, Homo sapiens
tgggccaatagtcctgactactctggaggctgaggcacgaggatcccttgagcccaggagttggaggatgcagtgagctataattataccactgttccccagagcaagaccctgtctcaagggaaaaaaaaaatgtctaagaattttaaagggttttttttggtacaaattcgaatacttgtatgaataatgctgagcaggtggaatagcttttgtatttagaaaggagtgacaagaagttttttgtaaatgaaatcaagctctctaaattatttttcattatgagactgattagcatcgtatcactaaaatagagtggttcttcattaggaaatctgattatcaaagggtcacgtatacagaataagcataggaaggtgcagaaatttagagaaactttcataaaatgtttcttagtttttacttattttatatttttttactgtatattttggaattgtttaaattgtacattcatagacatttggagttttatgacctaagaggaaagaacctttggaatgaaatttttgtgtctgaaattttgcttatgtgtttgaaatgaggatgctatctgttcattttggggtaaataatgatggggaaattgggtgataagagcattttgaaatgttaaggctctaacttaagctactaaatgatccacttctttggcaagttatataatgtattgtattttaaaatttaaatacacataaaaataaatgattcctatgttgaaaggtaagataccaggcagtagatactcataatttggtatctaatttttattcctgattagtagcattactgctgaaccatttaattatattgttctttttttgaaaacctaatttgtatgttgacacaaatgcagaatagatgagaaaatctggcatgcctctgaatgttttgttgtatcataaacattgtgcttttcttaattgtttttaacatacagttaggataatttgttataaatgtgtttatggcttaccacagcatattaggtaaaattagcttgcaacattttatcatggttagtgtt

SEQ ID NO: 109427 - DNA, 1029 bp, Homo sapiens
gttggccaggctggtcttgctcctgacctcaggtgatccacccttctcgtaccaccacgcccagctaatttttgtatttttagtagagactgggtttcgctatgttggccaggctggtcttgctcctgacctcaggtgatccacccttctcggcctcccaaaatgctaggattacaggcatgagccactgcgcctggccatggaacctcttaaaggtagggtttagagaaatatccagctctcttttttgttttttcccttgtttaactcgttcctaatcgcattctccctcagtttcctgggtttgtctgttaacttcctatttttgttggtcaccttaaccatgccacatttcagctctcctttccttctttcccctttcccttaccagtgagtcttgcccccccttttaagtatccttttcccacaaaagcaaggtaatttcgtataataggaaatatgtaggggatgaagggaggacaaagtgtaaataaagtaaaccaaaataagggagaagttagtaaccacagatcatttattctttttttctcttcaatttctttttttgttttgttttgttttttgagacgattcttgctctgttgcccaggctggagtgcagtggcatgatcttggctcactgcaccctccatctcctgggttcaagtgattctcctgtctcagcctcccgagtagctgggattacaggagcgcaccaccatgcctcgttaagttttgcgtttttaatagagatggggttttgccacgttggccatgctggtctcgaactcctgacctcaggtgatccacccacctcggcctcccacagtgctggaattacaggtgtgagccactgaaccgagcccctcttcaatttctgaacgtcagttgttttctcatctgtaaaatggtaatgatacctatttaatgggggatatttgttagaattaagaatgatgtataaagttctcagcccgtagatgttcattaagttaccagttacctttctccttatttttctttattttt

SEQ ID NO: 109428 - DNA, 1038 bp, Homo sapiens
ttgtgacagagtctttatcgcctaggctgaagtgcagtggtgagattgcggtcactgcagcctcaacctttgggctcaagtgatcctcccacctcaccctccctagtagctgggaccagaggcgcacaccactgtgcctggctaattaaaaaaaaaaatttttttttttttttttgtagagatggtcttggtatgttgctcaagctggtctcgaactcctgggctcaagtgatcctcctgccttggcctctcaaagtgttgggattacagttgtgagccaccgcacccaacctttatttttctttctgatttgccatgaactgagacaccatttaataataagaagtattatgtaagtaagagtagttaggtatagaactcaaggaagcttagttatggaataaagcaaggattgaaagctctgggggccaggcatatagcataaatgtggaatattgactggtcatttaaaagaaaaatagctggttacttaccgtgccttttaaaatactgtggattaaatgagacatgtctgcagatattgcctgtgttaccatccatatagcagcacagctttgcttagtgattaggcagtgtgacagttactttagctgcattggaacagttggagggtcctctatttatttaagtttttatagagaattgagattcttgggggttttcttttctttctttctttcttttttttcttttttttttttgaggagtttcactcttgttgcccaggctggagtaaaatggtgagatctcagctcaccgcaacctccacctcccagattctcctgcctcagcctcctgagtagctgagattacaggcatgcaccaccacaccccgctaattttgtatttttagtagagacgggttttctccatgttggtcaggctggtcttgaactcctgacctcaggtgatccgcctgcctcggcctcccaaccaaagtgctgggattccaggcgtgagccaccacgcctggctgattcttgggtgggggttttctggtttttttgtttgtttgtt

SEQ ID NO: 109429 - DNA, 1064 bp, Homo sapiens
aacggtgaaaccccgtctctactaaaaaaaaaaaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaataatgctgctataaatacttgtgtagaagtttaagtgtagaactatattttcagtttttttttggtatgtatttaggagtgaaattgctaggtcatgtggtaattatgtttaatgttttgaggaactgccaaacttttcaaaagcagttgcaccattttacattcctgtggtagcttgggagtttcaaattttgcatatctttgtcaacacttgttattgtttgtcttttgaatatagccatcctagtggttgtgaagtggtatttcatggttttaatttgcaatttctcagtgaatgatgatattgagtatcttttcatgtttttcttggacattgcatatctttggagaaatgtctattcaggtcttttggctattttaatgctaggttgttttactattgagttgtaagagttctttatatattctggatactggatccttatcagatatttgatttaccatactgttttctttttactttcttgttagtgttcttttttttttcctgagacaaagtctggctgtatcaccccagcttggctcactgcaacctctacctcctgggcttaatccatcctttcacctcagcctcccaagtagctgggactacagggatgtaccaccatgctcggctaatttttgtatttttggtggagttggggttttgccatgttgaggctggtctcaaactcgtgagcttaagcaatccacctgcctcagcctcccaaagtgttgggattactggtgtgagccaccgcgcttggccgtgttagtgttctttgaagcacaaaagttttaaatgtttattacatccaatttatctatttttttcttgtt

SEQ ID NO: 109430 - DNA, 1856 bp, Homo sapiens
tgggtttgttgcatttccatatggattttagaaactgcttttcaatttctgcaaaaaatccagtggggattttgatagggattgcactgataagtagatcaatttggagactattactgtcttaacaatattaagtcttccaatccatgaatttgggatgtctttccatgtatttaggtcttaaatttcttttagtgatgttttgtagttttcattgtacttgcactgcttttgttaaatttattcctattttatttgttttggtctaatttataaatgaaatgttttaaaaattacatttatggattgttctagtgatttttttaatggagtgatattcatactttgttacttgatttttttctctccaagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggtaaaattgttatctaaatgatagtccattatgaaaagatacttttgtatattgctctgtcgcccaggctggagtgcagtggcgcagtctcagctcactgaaacctccacctcacaggttcaagcaattcttctgccttagccttccgagtagctagcattacaggcacgtgccaccatgcctggctaaattttgtattcttagtagagatggggtttctccatgctggccaggctcgaacttttgaccttgtgatccaccagccttggcctcccaaagtgctgggattacaggtgtgagccactgcgcccagcccccctgtatattcttagtaagaaaagtcaaaacgagatgctacaaatgtacttaagattattgttttacactgaaaagcaattttaatatattttaaaattttttgagaaaatagttttttaaaataattacctctatatagaactgataatgatagctgaattttaggtattttctgtgctatgttttccagaactgaaaattttaacatggtgaaaataaagtaaaacttgtattgtgattctttacattacaggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacaggtaagaattactgtttgtataatggtgccctttcagcatggaaatggaaactgttacttctctcttttttttttttgagacagagactgctctgtcgcccaggctggagtgcagtggcacaatctcagctccccacaacctctgcctcccgggttcaagcaattttcctgcctcagcctcctgattgtagctgggattacaggcgtgcgacactatgcccagctaaattttgtattttttagtagagacggggtttcaccatgttggtcagtctggtcttgaactcctgacctcatgatctgcccacctcagcctcccaaaatgctgggattacaagcatgagccactgcacccggccaccgttacttctctaataaaggaattactttttgtcaagctcagtttactaagctagatttcaaaatagataattctgttaaacatag

SEQ ID NO: 109431 - DNA, 5472 bp, Homo sapiens
tttagttacctaaattgctaatctctagccctctgaatattatatgttatattattttaatgtagtatatgagctttcaaatctacaaattaacaaacaggaactgttgcctgttatgttcaaaagcactggagcaaaaataagcaattctcttttgttaatagaatctcacaatttaaggaacatgaacaaataactaacatgagcaggctgtgatgagcggtatagtaaagtatagggcataatgaacatgaacatgctggatgtgttccttcctcttgttcctttgctttttcttaaatttagtgtcctgtcagatgtcagattaatagtattagatgcttaatggatttagtatacatgaaatagttcgttttgtaaaaagtaatttgaaaatagatattttctatgatatgaggattaaatggaaaaacaaaacaattaaaattgatagcgccttttaaatcacatagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatagaaactgttaaagagattcatctgtgtattactgacaaggttttttttgtttgttgcttgctttggtaattgaattctgaagaatttatctgcatgacgataactaggcattctatccatttgtagatcagagaaagtgaagagattatatattagtacttaaatttttacattttccaaatgaatgaaaatgtatgtttctttgtacttttttaaaaaaatcagcttagtaacaatactatatggtttcaactagtaggtaatctgcttatatttctaatgcaaacttaacaattgtgtactttttaaaagctgcaatatgtgttggaaaatagctgtggtcaattttgttatccatatttcagactcaattttagatacaatggtggctttatattttaagtatatagagctactcaaggagttgaatctccccttttctcattaacacaatttttctaagttgatatggtgtactcattaacatacaccaaatttacttttactttgttcagattgtggaatgaatttccaccagttctcttctttttaatgtgtaccctaggaggaattttactgaggttatagcataccccatgagcacagtggggaagaagaatgtgttgttatgtgctgctgctaaacagaagcagcagttgtaatttgtttttcagtttaaatgtggttatagttagatttttttttaagcagcaacttttcaaaaataaaatgtgataatttctgaacttttgtttgtgttgttaatagtggtgtgaaaatattaacgttcttgagaaaaactgataccactgttgtgtatcagtttctatacaatccataatcctcctgtacagtttttacatgtagttatgagtcttactaaaatttatataatggacttgttttcctttaagttgtaaaatgttaaacaccttgaaggttattttggacttctgtatgtttaaatgttgtcttaccaaaatttgcacgaatggaccattttcatttactacttaatatcaaaatcaggaatttacagtcaactgatagtacatgataggtgcatataggacagtttagttacctgctactaaaagatttttagataagttttagaagataaaggaattccatagtttcaggagggacaacatcttctgcactttttttttgcacagaaaagtctgtcattctctaatggcaaatttcatatttgttaattcttggctcaaaatatattaggtaaaattcttagatctgtttttaaagggagtttcctgaaactatcattaattgacattattaccccatggattttatgggataataaatgtttttcatgttctcttataagatactatgtatgaaattacttcagagagctatatttattttaaaataaattagctagggttaaggttatattctatttccagcatagaaggtagataatctaatggtgtagaaagaatcactaggttgtcatttaaccagttattttcatattttgcttaatagtacatatccaaaaagaattttgtacttccccaaatgtaatttatttactaaattgagtataacctaaatgtgtgttttctattttccatttaaattttgctatattaagactaatttaattcgttgagtcttggaatcttctcaaggaggaacaaatattaaaatgacatgtagaaacaaatttttttttttttttttttttttttttttttgagacagagtctcgctgtctcccaggctggagttcagtggtgcaatctcggctcactgcaagctctgcctcctgggttcaagccattctcctgcctcagcctcccgagtagctgggactacaggcacccaccaccactcccggctaatttttagaaacaaatatttaaaatgacatattctcccaatacaatctatttagatctggagaaggaaaaatcagatatttatgatatagttttattttaattttgaattatttgtgtcacagctcagctttttggaagacaaactcaaacacctataatttcatttatatttctaattcacttggaacctttctgctttatgttacctagaaaatgataatttgtttaacccaaaacttctaaaataaattgcttaatccttgaaatatgttattggaaaattttaagcagtgcttaaacaccattaaattattatgaacttgtaattcagaattgagtaaagaaatattttttctagtccttcatatattgaaaacttgccacatgacattgtatcgtcttcattttccagaagatgcgttggtgtgccataggtttctaacttccttgaaaatagttttttaagtcaattgtaaatatacgtattattgttaaaagtaactttaaactgcaacacatagcttcaaaacaatatagagattttgtaataccttataagtggagttggctaaaataccttatccatataaaacttattctattctttgcatgcttattttgtgtgttggttgctagcttaaagtttgatttgttgttactctttgtgtgccaaattcactaggcaagcggatttttcctcagacttcaaaaaataattcttttaagaaaaaatgtaaaaatgtttattctaaaaagctgcattaaagggacaacctataaaaagttttgctagctcatctttagaaggaagaaagaatattagcttgggtgatgtttaatttgggtggcgatagtttctgtaggctaaactttatgagaaaagtgtacctactctataaaggtaataaatgtaaaacctcttgctgttattgaggaagctcttcaactaccctaaatttcacaaatgtaacttataacactatgaaaagatttgaccaacaatttacgtttgctgtgtgctttagtttttgtttaagcatattcttttgcttgaatttctgtgttcatgagagttagggtgttttatgcttcttgaactaattttataacatatttaatatattaccagttaagatataaaatcatttgtacatagcgaattgtaaagcagctattaaagtaggtgaaataaagtatatatttgccggttatccatatcttttagaagtcctgacagaacaaccagtttatttgcacataggtagcttctgtttgaaggaaggtaaagttataaggaaactcaaatactataagatgtgtcaaggtatttctccagaattaattgcaaagctagtgctgaaggattttaatcagcttctaaaattttcttctcaataaggcatatgttttgattacttagggaagattcctcatttttatttgccctttatgcatttaatccacatgataggacattaaaaattaatataaagaaaaatcgtgctcatactgtacatctgtttctgtgcttggaactacttgttaatagtttttatcgaagctgtcagcaataagggacataaaactgctgtattatacattgtggaattgaataaacagcctaattttttttttctagtatagggtacttaagcatttccacttttggaagaaaagtgtattagtattttatattgcatttcatttaaaaggacagttttttttttttttttgtaaatccattcattgaaatggtttctaaactgtataatgtaatttggagcctatttagtaatagaattaaatgtcctatgtagtgctacaatttttgaattagaaagtgatcaaatgtaagaaaaaaatttaaaaattcagcccagaaaacaaaatagtgtattaaattagtttaatgtaaaaggaatttataagatttttttcctcaatatagatacctcacttgaaaagaaagcacagcatacttaaagtagttctagtaaacatgtcctagaaaacagttgctaaatgtaggacatcttttgaggaattagtttatgagaaataaaattttacttgtttttactatcctgttagaagtatttgtttatcctgataattttaagccaacatagtagtcttaaattacttttgaatttctaatctgtgaaggcagtaaatgaaatatctgttctgcaactgttgaaacaaataattggctacattgaccataattaaagttaaaattttgccaatgatgtacagttttatggttaaagttgctgtggttggttgcattacatgacacagaaaactgtcctctacctcacgtgaaataaatattttatatggttttactaaaaataagactcatgtatctggtcacctagtttacaaattttgaattatatttattgaaacatgacatactgtgctctgagcttatacctcaattgtattttgtgctgttttccattttcatgccttgtaaataacttgtatagattgtggatcaaatactaaataaaaacttttaatgccaattaaatttgattcaagttatttcagtatcgtgtgtgagcttaactttctcattccctaagattgacattttcttctttgttcctttaaagtctattattcgtaggctgggcgcagtggctcatgcctgtaatcccagcactttgggaggccaaggcaggcagatcacctgaggtgaaggagtttgagatcagcctggccagcatggtgaaacgctgtctctactaaaaatacaaaattagccgggtgtggtgactcatgcttgtaatcccagctacttgggaggctgaggcaggagaatcgcttgaatccaggaagcagaggttgcagtgagccgggatcgtgccattgcacttcagcctgggtgacgagcgaaaactgtctcaaaaaaaaaaaaaaaaaaaaaagtacattattcgttacacacta

SEQ ID NO: 109432 - DNA, 1029 bp, Homo sapiens
tgatttttagacttcagctttaacatccttaccaaatccctggtataagttatctactgcataacaaattaccccacaatttatcaatgtcagaaatccaggagatggccaagcacactggctcttacctgtaatcccagtgctttgggagtctggggtgggaggatcgcttgaacccaggagtagcagtttcaggctgtggtgagctgttacataatcacaccactgtactccagcctgggtaagagtgagcggagtgagaccttgtctctaaaaataaaaaaccccaagctacttatacattatatcatggtgttatcaataagggcaattaaaaaaaaaatccaggaacatttagcttgctgttgcggctcaggagctcttgtaaggttgcacttaggatgttacccagggttgaagtctgaaagctgcattgaactgaaggatttgcctccgagctcacttacatggttgccgacaaggtgctcaattgctcactatgtggacctgtccatggagctgttcatgacatgactagtttaccccaaatgagtgatccagaagaaaacgtcatgccacaatttttttatgacccagactgtacgtcacacactcacttttgttttattacaggacaagtttacatagggtttgaataccgggaggcagggatcattagggactatcttagagtctatttatagtaccctctaagttgtaattaaatttttttttgtgatgagatgtacacaacaatttagtattttagccgtttttaagtgtacgattcaatgacatagtcacaatgttaggcaactatcaccattgttttcagcattttttcattatcccaaacagaagctctgtacctattaaacagtaactccctaatgcatatcttctcccccagcccctgataactttttttctattttccgtctctgaatttgcctattctagatatgtaagtggaataaaaatacttgtcctttatgtctaacttgtttcattgatcatgatgttttcaac

SEQ ID NO: 109433 - DNA, 1025 bp, Homo sapiens
cctattattaataggttgcctgttgagccggggtgggattgggagctagggggcttgatagtggtgaaggaggtgttaacgttttcacatatatatacacagataatatatttgaagagtgaaatcatattgcttaaataatttggctgtagcagtttgacaagagaatgctaccctaacaatcttgaacaatatatagtgtggcagtatgacaagaggatgctaccctaacagtcttacacaatacatcctgtgaatggaaggatgaaatattttggaggaagctaggtacagaaaagatgaatatgatgatgtatatttttcgtatagtaaacctttacatagtaggaattgtatttcttaatgaaatttatgtttttattttaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataaatgaagtatacatgagaaataccaagaaattggcttttagtttatcagtgaataaaaaatattatactcttgaacttttgtctcatttttttgagtatgctgtttatatgattttgatttccctctgataactatcaacagtatttaaatagcttatagctggtataattttttcccacgatttccaaaatcttttatgtactcaggtaaaagtagcgttatataggaaatcttttttttagacactctcgttctgtcacccaggctggagtgcagtgactcagcttcctaaatagctggaattacaggtgtgagccaccatgcccggctaattttttgtacttttagtagagtagggtttggccatgttggccaggctggtttcaaactcctgacctcaagtgatctacccacctcggcttcccaaagtgctgattatagctgtgaa

SEQ ID NO: 109434 - DNA, 1287 bp, Homo sapiens
tatttttattttttctttttcttttcttttctttttttttttttttaccaaagtccccttcccttgcctataataacgtaagaattgaattttctagacataggtgggtggaatcctagctctggcacttacctgagcttgggctaggcagtatactaacctattcccatctgcagtggggtggcagaaaagcacgataatttaaaattgatcattggtagtatagaaaacaatgaaagtccgtaactttttgacaacttgaacatattaggacttggttagaggttcaaatcaaccccggcgtgggtagtggtggtgtttttttatttattgttacatttctgtatatgtaacctaacagtacattgtacagattgcattggtacaaactttaaaattgtttatataaattgaataagttgttttatatagctacataattatttctcatttatgtagcagaaagacaggaagcccaagaggtcaacctggaggtttaatttggaccttactcatccagtagaagatggaatttttgattctggaaattttgtaagtatcattctactcggcttatttttgtaatcagagttattgataatggtttaaatatatagtatttgataataacctaagctctattcctagggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggttggtacttttgcaaattttaataaaactatagtagttttggaatatttcatagaatatgtagttattacatgtattctgtttatatgcaagaataaatatgaactttagactaaaggcctacataaatgggaaattcagtaaatgagtgccaattgctgagtctagttgtaagtgtcatttattgctagaatatgagccagttgtgtccacagtcccagtccagtaaattataggccctgtaaatccaaattgtatataacctttaatgctgagtactttagtatttgagtatgttgcaagaaacatgtctgatgtgtacataggagaattgtctcaagttatttattcagtagaggtagccagttaaagtcaaagtcttaacatcttgctgccagtttttatttgttgaatttattcaccaaatattaaatactacatgggcagcac

SEQ ID NO: 109435 - DNA, 1020 bp, Homo sapiens
aatacacagatacttacattatggatatatttatgaatgattgtaaataatctaatgatatattgttagatatggtttgctaaatatttatctgtgactatagtatgttgtatatatacacatatatatagaatatatatatatatattcatgaatgagactggggtataattttcctttctcaaaatgtccttgtcaggttttaatatcaaagttatgctggcctcattaaaaagttgatgaatgtctctaatatgcccagagagtttgtaaattggtttcttagcctattggctgcatgtagttgatttatttaggaagtgatctcaggtaacagaagaaaccaggaaaaatgaaacttggaaagaacaaaagcaaacagaaatgtgctggggacaaccgaggcttaattcttctggaatctctcatgtagtaatatagaatgcactaaaccgtccaatcaaaagaaagaaaggagcagcaaccagtttcatgcaggcgtaacttgacagcacctccccgcatatatttcaccttctaccccatggcttctctgacatgaagcatgggacacctgtgggaacctccctacagatacccacttatatatttacaacctgaaaatgcaagggagttaacaagccaaagacaaacatttatcagcaggggacaggaagctgtagataaattctcccctgccctgaattaaaaggtaaactggcagaatgtgagttttggcataaaattgttacaactggcattgtttcttcctcaattgtttggtagaattcactgctaaaacatgaacagtatataatctgcctatggtttttttgtgggaaggttttaattacaaatgcaatttatttaaaagatataggactattcagatattctatttcttcttgtgtacattctgataaactgtatttttctaggaatttgctcattttatctaatttgccatatattggcaagtggtagtttatactatcttattactattaattgaattataac

SEQ ID NO: 109436 - DNA, 2118 bp, Homo sapiens
tatctataataggagatactgcaataaaatgattaggctgtaaaatttggagacacaatttttcattacaatgcaatttgcatgtgcacatgtgcgcacataactttatatgttagttcttttttccaaactcccaactcttaaaagtattgtagtctgttggtgcctcaactgttggtaactttttttttttaaatttacaactttccacaacttgtttttgtactttaaggtttctcaattagaatatttctagttgagctgtaatttgaatgcattgttctcagggctatttgtgctaaaagctgaaatttcattattttaaagctaattgcctgaaaatatattggcagaattttcccaaattgtaataactgtgatacatgcatataaaaaaatccttaatgtcaacacacttaaactacatgctaaatagtcaagaaaaaaatggaaacagtagcatccatactggaatcttgccatatttttttcattttagaatagattttggcagtctcatcttagaatcctatccttaggatacatctgaaagcattcctttggcatggaccccagagatagttttggagccaggcattgatgtagaggttcaccaaacatatttagggataatagataaattcataatgcttttttgggtacactgaaatgtttacatactgaattctgtaatatgaactaggaacgcatttactatgagaaaatatggctcttaagcagtgtaagagtgaaaatataagcatatttccattaacagtatattgtactgatcagcagctctcattttaacatcagttaggcataatatttcatagttttcaagccttttttttctgctaacattcagacaagtaacaggcaacaaagatttaagaaaaatttatggtggaaaaccttaaaaattgagacaattcaatctatttaatctattaaattttttctctgaattgggtatatggcatcattatttgattttagcagggaacatttggatttagcttatgaaacacagatgttctatgggaacatggcttgaagccaatatgtaatttaatgtttttccattaaacaaacatctgaacaccaacttagctaccaagtgaggtcaagtgcctgaaaagtactgtatacatctaataagcatgttttccttatgtaaaagatgcactttatggcaatgcataccaggctttcacctgctagaaacatacttgttgccaactttgccatctaccactattctcctccttagaacaggtagaaacctattttacaaaaaaaaaaaaaaaaaaaaaaagacaggttattgtatttatatgaagtccctaaaactgtttcttggtattgatagacttaagtttatcttagttcaagattgcactttttaaaaaactctggactattttcagcaatgaccgaacagcttgtcacacatcatagttgtgatcttttttgaggagttatttattgtggttaatatctactataaataagcattcttgtgcttgttacaaagcataatgcaaattactagttctatactagtataatgaaaatgactagttctatactgttatgtacttttgtcttcctccccaaaaaggaaacagtttagcattgtctaaattcagtggcacttttttagtaatacatttttttttcttagatacaggagaactattgcttttacctgcagaaactcaaatgttttcgctaaaactttaaaattctaaaatacgtagtatgggtattactaattgtacattttacatttcaaaaatagttaaaattcaaatgttaagtctttgacttaaaaaacctttaaatatagataataccttaacaattataactttgtgatattattaaaatatatttgtctgttaacttcatcagttgtattaaataaaaatagttaacagcttgcactattcttgtacatatacatctttaaaacaatttcatacccaaaaattgtatgacttaagcgtatgtcactttaaaagaaaatctaacttgtttttattgagtacttttatattctaggtccttacgtagtgccctcgcattatgactgggactattaatttctaaatt

SEQ ID NO: 109437 - DNA, 2527 bp, Homo sapiens
gggtagtaagtgttcaaacatttatagttatttttcctgttccctggaagttgtcttacaaaccactctgagaaattctgctttagaaaactgtaaagaaagtagcttgttttggaatacccctttcagaagtccatatgtacaaaatatccacaaatatacaatatatgaggaactaattatatcttctatatgtattgtcttctgaataacgttttgcctgcttttttccttctaggtgtctgtcatgtgtgcaatgagtgaagaatatgctgtagccataaaaccctgcaaataaacggaaacatcaggcatgaacactgtttatgtctgaatcaactgcagatctaatttggttctaagttgtcaccaaagctatagccttcataagcaacctcatttctttttttaattgttttcagattgtgctgggttagttttgcaagcaattgataatttttaaaaaattatcaatatgtataattttttttgaattttgtagatatgtttcctataatattcctgtggttttcagtatgtcagtccaagaaacaaacaagatagcttcagcagatgtgatttgtctgagcaaatcattcctgtgttttagttagatgataaaccagggttttaaatcaaacaatgtagcataaagtggtattgaagtaccatatttaagttgaactgctctgcattaattacagatttaatataaaatgaactgattatatattggaattgttgcactttcagcctgtgtagggcaaacacaaatccttaaacaaaaatcatgttatcaaaaactgtcagttattttggtggccacatgcaaccatgtgattactttggtcatactatttaccaaattgttggcaaacttgatgtaaccttatatggtggttttagtcccttcttatggttggcagaagggcactgaactgttgggtgaaagttagttagcaagtaagattataaggaagacacaaaagacagtggcaaagagggttgattaaatctataagtttttatgtgaggactttgtaagtcagcataaaaatgaaaagttgtttctcagttgtttttgcttttaactttgcccccaacgtttaaagggagtgatctgctttacatgatactatgcaatgcttgttttccaactatgttgaataaatagtaatatttatcagtaaatactcctttccaacttccttttttttttttttttttttgagactgagtctcactccatcagccaggctggagtgcagtggtgcaatctcggctcactgcaacctctgcctcccgagttcaagcaattctcctgcctcagcctcccaagtagctgggactacaggtgcatgccaccacgcccagctacttttttgtgtattttagtagagatggggtttcaccatgttgtctaggctggtcttgaactcctgacctcaggtgatccacctgcctcagcctcccaaagtgctgggattacaggcatgagccaccacacccagcccctttccaaccatttctaagtagattttttgacattaatgtatttattaaacaaaaactgagaattccttaaattgatttggaatttttgttaattttatgtcctttttttcctaaagtgaattaaagtgaatcatggaagcagcattactttatatgaatattattatttaagttaagttattttaagtatatgcattttttctgattgttgtgtgacttaattcagttgctggtgtgaactataactagcaaataattctataaactgaattattttaaaaggtattttaggtgacaccactgcatttctatttcatcttttgagtcatatgtatattatttccagaattttagacattattacagggtttgtgaggacctttgactcagtgacaatcatcatattggagcaaaacatagaacaaaatcactatctcagaaataccttaattctctaagactggctcttagacctctcccatcatgccttgacctctaaaaagccctttgttcctatcttctaaaggaaagtatatcatatatgatgatgtaactgatctaatcagtgactggaaatagcattagtaacagaagatcccaagttttagttgcttaatttgtacacacttttaaatattgtcttagcctcggcaaaccaatttggggaagaagcaagatactttaagagaaatacaaaggaaatttctaaagcacaagaaatagtgaggtagtagttagtcgtctttcctacaacattttagcttttgcccatctaaagcacaattaaaattaggctacattctttccagtattctatttaagtacctactacatactgctctagtttcttagtactctgtaatgtgtatcttaattgctactggttggcattgtaactcataggaattccagaaaattattaatccgtgctgcttgcagttcattcatatggcccctcttaaccatgctggtgttatgattcagtattaactctcaattagcatgcccctgt

SEQ ID NO: 109438 - DNA, 1125 bp, Homo sapiens
acctctaaagcaatagggcccaatgttgcgaggactagaagcaaatatttgttacaggatcattaagggtaatcatgagaagagccactaactttagttcctagacctgtgtattctacctataggaaaaatagcatcatatattgaaatatattgtaacctgcaaaaaacagcactccaggccaacaaagtaccattcagcaggtgccatatttgagtcttcactaggctgatccacagaggcaagctgttttggaatgatagggtacgtgagccagcgaattatctgggtgttgcactgccttgttactttgcctgtaaaattagttttctagtcagaagtgatgcagtgtgagatactatgacaggaacgaggcattctgtaaattgagatgagattttagcagaagcactgcaggcaagaaaggcaaatccatatgcagagtaaaactattgcaataagaaaaaattgctgcctgtttcatgatggaaggggtacagtcaggtggccagctgttctgggaaacatattaagacttcttgttcttctgttctgtgttcttcttctgccatatcaagactgacctgtttctgtgaggttttcagtagtggctgtagtcagatcagtcttggtgagagaaagcccgtgtcattgatcccactgagcaaagatgagagaagctacaaaaagaagctgaggccgggcacagtggctcacacctgtaatcccagcactttgggaggccaaggcgggcagatcacgaggtcaagagatcgagaccatcctggccaacatggtgaaaccccgtctctaataaatacataaattagtcaggcgtggtggtgcatgcctgtaatcccagctactcaggaggctaaggcaggagaatcacttgaacctgggaggcggaggttgcagtgagctaagatcccgccattgcactccagcctgggcaacagagcaagactccatctcaaaaaaaaaaaaaaaaaaaggaaggcttctgtacatctctacaaaaaatacaaaaattagccgggtgtggtggcaggcacctgtaaccccagctacttgggaggctgaggcaggagaatcgattgaacctgggaggtggaagttgcagt

SEQ ID NO: 109439 - DNA, 1086 bp, Homo sapiens
gctgggaattgctcagactgcaatatcaataggcaattctcacctgctatgtaaactcctaaatgcctcatgctgtgaaggtgatcagttaagttcaaatcaaaatttgattggaccattttaaaatactgtttttaaaaatcaggtactttcatacttaacattgatgtatgtattctttctaaagcaaattaaaatttgatcaaacaattacattctgaataagattcaaattaagtcagaaatacccagtcaaacccaatgactaaatgattaatttcaaaaaataattctctgtcccatcccaaacctattttcttatgactcatttcttctcattggctgtgtcatcaaagaacaaagtaaagtgaaatttggcagttggccagttaattaaagacttggcccaagtatttgggccacaaaattactttgtaatcccaattttctgttttgactttttatgattcaaatgaatggaataattgccacattttcactttactgtgagttttatagacctagcagcattatctgcaggatggcaaatgtctgaactaaaagttagcatttaaagaaatccatttggatgttttcaggtttttacacattcggatctgaataggctcagttaagatgtgaacaagggatatctattatttcatgggattcttctgaaattgatcctcttaagagcattcatctcagaccccacagccccaaggccagatcatttaatacataatgaaggagagaaaaatgtgaacagcatgacattttctcaaactactcatgttttaccaaaagaaaaggtagaaaaggcattgtaaagttttccctatttctatgtgtggtaacatagagactaaatacttctttcagtctccagcagcaaaaatagcaacctattaagatcagcacccacactggttagctctggtgaggagaacttgtactaatgaggccctggtcagggatttaatgcccatgggatccaattagcttcacacaggatgagactctgagcccagtcaggatgtaggctcatcccagctgcttctgctaatgcccatgctctttttcaca

SEQ ID NO: 109440 - DNA, 1032 bp, Homo sapiens
accagaagagggggaaaagcatgaaacagttttcacctccttcattcagcctctacccagcaccttgtgatttgaacttgtctaccttgacttcactgttttccagttgctatttgtcctcatcactaaatttactggtctgtcctctctattcagaactagttcatagctcccaagctttcaggagacatggcattcctgggggcagatctttgcagatgtcatcaaggcacttttctagacctcttaattccctcatgcttcctggtcaggctcctagcagtaaaagaaacacagcatttgagcatgcaaacaacatgcctgagtcatcaagcactcctgatgtgaggtttcccagtcaccataagtctgggccatctctggtgggtgacatcttccaaggtccctggcttcctggcatctggtgtgcttcctttgggcttcacgcatttccacagatatatgggaacattctttggggatttcatatttagtcctctgctcctgggtgtggttaacataatccagcttccaactaaccgttgtctgttcatgaaacagttcccaagtcttagagtgggtgatcatattttagaagaaagatgaaacatttagttgatagaaggagagtgacagtgctaaatttaggactggagcaatcgatgtacaaataagaacaaataattgtctgccttggtttgagtcatcatttttaacacccacttcttagtaggaataaaaatcagtgcaaggatctttacattcttgatcttttaatgcttctcatcagcagtgtatgaactttttatgtaaagcattatttacagatgtcttttctcatattaggaaggcaggggctcaaagtgaccaagtagtaatacacgtttcaaaactttaaatatgaacatagcttatcagtatcttaactatcaagttataagaaaacctgggttaaaccctctggaagtaaaataaaaggatgccattttctttttttcaaatgcaccctctgtgcccatgccaccgtctcct

SEQ ID NO: 109441 - DNA, 1027 bp, Homo sapiens
tccagtctatcattgatgggcatttgggttggctccaagtctttgctattatgaacagtgccacaataaacatacatgtgcatgtgtctttacagtagaatgatttataatcctttgggtatatacccagtaatgggattgctgggtcaaatggtatttctagttctagatccttgaggaattgccacactgtcttccacaacggtcaaactaatttacactcccaccaacagtgtaaaagctttcttgtttctccacatcctctccagcatctattgtttcctgactttttaatgatcgtcatgctaactggcatgagatggtatctcattgtggttttgatttgcatttctctaatgaccagtgatgatgagcatttattcatatgtctgttggttgcataaatgtcttcttttgagaagtgtctgttcatatccttcacccacttttatttttccttcattaaaagttctttctcatttgaagcctactgactttaataagctttcaaggccagggacaggaactgtgcattatccatctttgcaccccatgcagagcttgctaaggttgaacctggcactggcactggcacctagtaggtgctgcattatgtgttatatatgtgtattatatgtatatcattatatatatatacacatcattatatataaaatgatatatatcattatatatatacacatcattatatatataaaatgatatatatcattatatataatatatattataattattactaaattatatattacatataattataataatatatataatttagtaatgggtttgctgggttgagtaaatgattattgaatgattatatgaatatgtattatatattttataatatatatttataattatatatttatataaaatatatatttataattatatatttatataaaatatatatttatatatttaatatattatattaaatataatttaatataattaatacactaatatagtaatattttatatattaatatgtaat

SEQ ID NO: 109442 - DNA, 1069 bp, Homo sapiens
ctgaaatttatgttttatgagataaagtggttcttaactatttttgttgccatgttcaatagctagttacttttaatgtttctataataagaaaacagtatgcaaagatacactttaacagaatttcataagctcctacactatgggtaataaccagagttctgaaaataaaaccgttactttcacttgcattttaagtcagattgatagctttctttcatttataacgtcgtcctagtctgaaagcaaaatcaccattttattatttcttattcaaaggctgaaagaaaaaggtaccaagtaaaatgattttgtatgacaaggtcaataagacttggcagcaaagacttggattgaaactttagccttgccattaaccagctgtgatgttgaataagtcatctagtccttgtctcacttgtaaaatggtataatattgatactatagttatattgctattacctggaatgacaccccactcttattattcacaacctggactttttatgacccaggtctgttttgcttttaaaatcttaaatgtacagcatcccaatcttagaccacagcctttgatgcttccagcctgtactccctcacaccctacacacctgttctttgatgttgactaagccctcgggtcttttgtcagtctctcagtccccatgaaactttaataacttgtctctccagccttgggcctcatgatttcttagtttaatcatttttagccaacatgtactatctcctttatcctttgttcttccataatatccaccttgcagaccccttccctaaggtcagtctagctgtttatttttctgcatttgggctgcacagctcaactcagcactgcttaataatcaactgtgtatgtacctgctcagttccttctcctgttttccctggaatagttgctcccaatctccaccactctcctctcctcccttccgctgcccctgccttcattgttctccacaggtgaccttcttctatgccttttagaaaaactggagccattggacaggtatcccttattgggtaaatatcccacaggtctccctctgc

SEQ ID NO: 109443 - DNA, 1023 bp, Homo sapiens
gggattgggacccagctgtttgtgggtaacaaaccctccaggtaattcccatgcacactaaagtttgacagctttaaaagctttatagtttcagatctagtcttcgtaatttatatgagtaacataaagaggccaaactcaatggatcttttggttatatttaaattattatatgttgttccacagcaaaacattaacaaagttactttaaaccaagatggttggttttcttcataataaaaatgtaaaacatcttgaaaatacatggatatgaaggaatattactttgggatggggtatagggcttgctgtacactgggtccatttttgcaaacttctagcaatagctctgccaacttcaggagatctctgttgggatcaaataagatggtggattcaacagtgcttggtgagctggaatgaacgtatggattatttttgagttaagcctctctcctattagactgtaactgccataaggataaagactaggctactaccactgcgtagaccagtgcctgatacagggtatgtgtttagtgaatgtttgtaaaatgatcacgttattttttgggcttttgtttccgcataatgccttgggctttctgccacatctgcacagcacttgtactattattctcttacttaaaaaacaaaaaacaaaaagctgagatgaaatttacatacagcaaaatatatggcttttttttttttttttttttttttttttttttttttttttttttttttgagacagagtctcgctctgtcggccaggctggagtgcagtggtgcaatcttggctcactacaacctctgcctcctgggttcaagcgattctcctgcctcagcctcccaaatagctacgattacagcctgtgccaccagacctggctaatttttgtatttttagtagagaaggggtttcaccatgttagccagtctggtctcgaactcctgacctaaagtgatccacctgcctcggcctcccaaagtgctgggattataggcatgagtcactgt

SEQ ID NO: 109444 - DNA, 1030 bp, Homo sapiens
cactgcctctgcttccctctgccatagactttctttattacattaacctgctttattgtttttatggtattgccactctctgaattatcttacttccttgtttatgtctgtatttagcaatttaaatacataagtcaagggaaaattaagtcagagacctagtctgtctaggccatcactatccctagtctggcacacagtaaatgttgacacttctggggcccagaattgagctatgttttccttgataattctttctatatttgttcccagttttaaattttttttagcattttcataaaatgttaatctttgtactttagaaaaatatatttgcacaaaagcaataaacaaaatcctctacctatttttttttttttataatgggatggggatgtggatcttatgtttaatgaattaccagtagtctgcagaagcaagactatgctagaaatttacaaaatgaggcaaagcaattttctggggtctggtctcctggcagaggtcctcaaactttagtatgtaaaatgaatatttgggaaaggatttaaaatgtagatttcccggctccaacttctgaaattttgattcagtgggtctggggtatcctctttgaacatttaataagtataaatgctcattctgttgttcaaggtcctgggaccgcacctccagaaactgcaaaaatgattgtatgttatcctgttataggtcacttgagtgaatgctaatcctatactttttgtaatcatttattttaggatttccatgctgactcaaacttacataaactgagaaaagcaaaaatcaaagatcttgccctgagatgtgatacccgcctgttttggcttattcaaagatttgactttcagtgtttttatttgatatgcttatgattacagtttaaagctgaataatttaactcaagacctgagaatcaatattgtcaaaactgaccttatatagcaaaatcttggcctgttgggtggagattttctcaaatctgtatatcacgatctcttcattaacc

SEQ ID NO: 109445 - DNA, 1018 bp, Homo sapiens
tcctcatgataatttctagggaaatatccatcattttccctagtggcagcgatatgggatggcatttccattacaaattatctcgtgttctatttttaaaaattcctcctgagccctaaacttctctcagttaattaaatttattatagaaatcattcaggttgtaatattttcaattctgcagaatgtcaaaagtattatttatagggtattctcgagattctaagtggatacacatttatatgtttatttacgagaggtttcctttggtgtccaggggaaaattctcccttgcaagaaacgattatttcctaaattgtacaccttttaccattagacagaatgtagtctacccaacctgctcacttgacgttgatcctgtctgacacagaaagaaatgtgtctcagcaaaggcttttaaatactttcaatgaagataattaggttggaagattgtgttactgcattttgagaaactggattgaacttgtgaagtaactaatgaattaagctctgacttaggtacaaaattacttctgatttgctgtcaatatgaaggagcaactctgtagcatgctgttggttttatggtgccatttcttagagcctttccgtttcattatgtttcccacccatagaatatacatttgggagacatttcacagcttggtacactaattcaagaggtgaaactctgcagtcttataagaggagataccaagagattcaattaaggatgagaatatttggaaaatccagaattatccataatttcttgttatttgaaaaaggcaaggaaacaaatggcaagaggtctcagatctttttagagagggaagatatttagcagctaggttgtcaacattattattctaaaggattccattctcttggtggttgatacagtactatggcaccttccaagtttaagggagattctgcaaagaatggtcatggtgaatgcagtgaactttgggacaggagatttgctctcttttaccagccccattgttttgta

SEQ ID NO: 109446 - DNA, 1048 bp, Homo sapiens
tatgagtgtaaggtcttggcagtgtagcttcagggggacaagggacagaattcagaggatgctgtgtttgagagaagagaagaaaaaggaggagacaatgaaagagaaagaggaggctatggaaggaatgatcacagccatcacatgtaaatcaggatgttagatctcccaccatggagagaatttgaggaaggaggtaataatgggcagtgccaaatgctgcagcacagaattgcagctactggcctggatgactagagtatgctggttgccctgcgggagtgctctttggaagcagagttatctgtagtggaatggggtgggggtgggggcggagcccttgagaaagtgaagaccctggattcagagcaattgttcaagaaatttagtgtcgagcattaagagagattaggacagcagaaagctaacatgctttcttttcttaaagtgaggaagacctttggtcggttgaccacagggggcaggaagcagtggtgggggagagataaagctatgaccctgcagtcttgcttatctcaatacagagctgctccatttttctggtttctgggggcctagtccttgggagtaactttgactcctctctttctctgcactgatcattagatccatcagaaaacctttttggtattttatcttcttgaaaaatatagccataatccaactacttctcacatctatgcaactatcaactttctcctgaattattgaaagtctccgaactcatctcccttctccttccttgaccttgagtctgttctcatccagtgtctaaagtgatcctaataaagcttaagttggataatgccactgcacaaaatccaccagggtccccctctcttttattattcactagagtaagtattgaattccttgcagtaacctacaaggccctgccaaacctgacctgctcccccagcccccagcaccaaacacacaccctcctcattcctcaagctcaagccctccaggagactgcagcgtcctctcacgtaggagtgctcttctccaaatacctgcttggtct

SEQ ID NO: 109447 - DNA, 1062 bp, Homo sapiens
gccataaatcccagaagcagttgcatgtattagcttagacataggtcttggaggcacagggtaaaagcctcccctgcctatgcttgcatttgtgtgtttcttcgtttcatttttagcttctaaatattgattagctttagtgagtgctcactggctcttgtggttatcctacagctatagggggataaggcccatgacagttaaatggcattcctggaacagagcaaagtggaaggggtggtcaggtctgcaaaatgcagttcagcagcaaatgctatcccgatgtctcccacgttctctactgtgtacctcctactaagcttgggtgcttttttcctttacaaatgcagactgttgcactttacagtaatcagctgatatgactgcaatgaactatgacttcactggatagaatctttgaaatcaaatgtattaaattgactcttcctttctcagataataatgagtagacattccagctataaagaaagaattaatagattccaagcttttataggctttgggggcagtaataaaaaaagagaggaactggcacagatgccgctgtgcttgatttcattctttttgaggggtgttaaggttcttgacagcctcgccaaatgatccaagggggcaaatgcactggctctgtgtgaggctggggatggggatgaaaggtagatacactgtctgtttgatgcagatttgtgctgcaatgttcaaatcttcaacctgttctcagtcttttgaaaatcaaggcatgtaaatgaatgatgatagcctctagtgtctggttaggattccccagatgacaccttggcagagcatttagccagaacgtttttggcacctcagagagtaacgtgtataaaaggtgaccatgaaataatttgggctcatttgtgagcttctggcttatctcatttgttttcaaagtcacaggaaggaaaatgacttacgattacatcaggggttggactctctggatttgaatcttggtgctatagcttactagctttgcagcttgtgacaagttatgtaaaatccctacacttttctaca

SEQ ID NO: 109448 - DNA, 1059 bp, Homo sapiens
acccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggtgagcaggacgttttctggtttctttccagtggtttgggttagggtgaatgggctcggtgcgtggactgggggctggggctggggcagggggacagcagcgggagaatgcgtcggggagggaacctggattcccgttttgattcggggttgctgaggtgctcctggctgagcccctacggcaggggctgtgcggtacgtgtcttcctctggccgtggcttaggctctcccgagggctcgtagagcttatgccagtttcatcttataccggtgtaagagcattaaaatgaaaggcgtgtgtgcgtgtgtgtgtgtgtgtgtgtgtgtgtgtacacgccccgggcagttgtctggtgccaaggcgcgagacccgactgtcccttctgcaaaaagaatgccagcgtgaataaaggcactggcccctcacgttttccagctacctgcaagatgacattgtgaggctggctgtccccgcgaagccgaacctgccgctccaagggggcagttattgctatgctggtcttgtagatggcaactgcctccccctcccccttttctacctcccgcgcccgggcgccctctcagcgctcccttaaatgccagtctgccactcacctttatttatggctttaactcagccctgcctgttctttctgactttgtggctgtaacgtttcagttttatggctgaacttaagcaggtgaaagggatgtgttttctgcttttcctcaatcagaccggaactccctggagtgtgtgcgagtgtgtgtgtgtgtgtgtctgtgtgtgttttccccgtgtctgtggccagtcc

SEQ ID NO: 109449 - DNA, 1022 bp, Homo sapiens
ttgctatgactttgctatgttttatatacatgccatatatatgctattactacgcatatatgctattgtgcaattattaattattaaatgatattaaattttaaggaacgacttgtccacctgattgtagctgcctgatgattttagagagaaatattaagacattttagtcgttgattacttgtttgtgcttgatgggtacagataaaggtctttaaaagcttacatgaaactcatttgtatcttgtggatctcagtttctgtgttcccaagtgcttcatagcttttcatctagagatggtaacaaagcaaagaccacagattcgaaacaaaaataatgtggcaaaggattagataagagggaaactccctaaaaaccagattttagggttttcccagagaatatacacgttaaaatgtttcctccaaacgtgggagaaaaaaaaggactgtacagtagagagttcaaaatctgtaaatttggggtaaagtgtctaagcaaaccttagattattcctgattctaggtttggaacacacattgcattcttgctctcattctgctggactggcttaattttgttatatctgggtcttttggctaataagagatgagcatttgtctcataacataccatctaattttaagttgagttttgtgctaattaatttttatccaacatgctttcttgttgatagtcaaagtgacttagatgtctcacacatctcagatggtttatggacctcgctgtgacccagaagggcgtgatgccaattttcttataaaatgaatctgagtttcaaagctggagagaaattcttaggcaaacttttttaacttgaattggctacgccccaaacgttgaggaagttgcatggcagtagaagatcaggactctgaggaaagaattgaagaactaggagtagtagtggtattagagatgaattttctgaccgtcgaaccttggtagattttcacctgatggaccagttccgttcttcacagcccagatcactccttgt

SEQ ID NO: 109450 - DNA, 1026 bp, Homo sapiens
tctgcctggagcacacttctcctaagtctttgcatggcttccttcttttttgtcatttggatcaatgacaaaatggtcaaatgttatctccttggaaaggttttttccctgaccattgaaagctgcctcacttcacagtccacattgcattgcttgctacctgatcctgttccagcctttcacctagggttattttcatgctaggattcaccactatctgaaattctttttcttttctctttttcttgcttactgggttttctacacaagaacttaagctttatgagagtagggactttcctgacatgtagtaggtgctcactaactacttgttgaatgactacctttccaagttgttatataaatatatgatgttagtgtgaaccctggttcccaagggattcatttgttttcctaattgttcttttctgacctcacagatgttgctgtttttatgacaatgattcattgctgagatattactgcaatttggaacaaagtgctgctctcaactgatgagaaataaaatctgtagctttctatgtgaatgcctcctgtcgttttcagagagcttgcaaaaacttgtttcagttgcatctgtcatgtgggtgtataatctgtgatagaatggatcgattaaacatgaaagtatcgtaacataaatgagactgatttggggaaactcctgtttcctaccttttttgagttctaccggggtggtttttggtagtgtcatggggactagggaaatgtgtatcactttgtaagaaaggcaggccataggctgggcacagtggctcatgcctgttatcccggcactttggaaggctgaggcaggtagatcacttgaggacaggagttcaagaccagcctgaccaacacggtgaaacctcatctctactaaaaatacaaaaattagctgcgtgtggtggtgagtgcctgtaatcctagctacttgggaggctgaggcaggagaattgcttgaacctaggaggtggaggttacagtgagctgagatcgtgccat

SEQ ID NO: 109451 - DNA, 1622 bp, Homo sapiens
cttttctcctcaacccagcattttatttaaacaaaatttagaatttggccgcaatgggccaacgctggggccaaaaatccacaggtttctctctccatccctgctggtttctagtcccccctccccctcttccctcccaggcttaatcatattttggaacgggtgaggtcttttgttgggtgggcaccccctgattgcttgtctgtttattttttaatgtgcaactaatttgatttgaatttccttcagtttccaggccttcctagggaaagctaagggagagggaatatgctttttaaaaatcgttttctttctttctttctttctttctttttctttctttctttctccttctctctccttccttccttccttccttccttccttccttccttccttctcttctcctcctcctccttcttgttcttgttcttcttcttttttttttttttaaataaatgtggcaggaggtggggcgttgggaatggggaggcacggtggttgtgggcaaagagtcagaaggagcagacagacccggaagaaaaggaatctgctctggaataacactttttttttgaggcctcaggccttgggcaaaattgcttcgctctgtaatgatttctgctgccggagttgctcctccacccctaagttaaagctatgaacctgggtgcccgggcaacgccccacagtggatagcagccgggagcgctggttttgtgccttttgtgggggcccttggttccccctcattggaggctgactctgaaatttactggatcagtaaatttcctggctccctgggagcagctgttaacgaggataaagtctctgggcatgtttctggccctgcaaaaggacctcacccatgaaggtacaattctcactttgtttagataccagaggggcacccacaggctggctgagaatgaggcatagttgattaaaaaaaaaatcagtcattacaaaattgtttttaaactcacacgtgcttttaaagtgttgtggtttaaattactttaagataaaaaaaattcatctgtaaggatagcgttcatttaaaagatgctaaaactgcaggatctcatcatgaaataggaggttgtagcttctaattacagtatatacaatttcagaaagatattccggtaatcttttaatacagactttataaatagctcacatcagacgatgggttatattggagagccagtcttctgcggtttcttgaagaatgcttgggatctgtgaggaagctctaggcccttggaggctaggtagcagttcactcagtaggagtttgtgctccttttgctcagtatttaacctggtagcatttgatggataagttcattaggagctaagtagaagaacttaccacacttgtcagtttggaaaatgaggcccgggaagggaaagtgacttgttgagggtcaccattatagacgaaagtttaatacaggattgtgttaatagctcctttctgggatatctgatgtgtactaagcactaattcctgtgcttttatacattatctcattaaaattctagtattttcgatttaggttgtgttatgcacactttacaaacaaggggattgagatttacagagagagagtaac

SEQ ID NO: 109452 - DNA, 1051 bp, Homo sapiens
atgtaatctctttttattaggatttttaagaggcaactgccaggttcagtataaatatatctgaatctattgtatcttccatagttatggtactgtcctgggataattgcagttcatagtcttaactctagacatatcctggaggacctatgtctgtaaattatctttgaattgttctatgttattttagtgttatgtgaattacattgcttccagctctttgaaaatcgttaattcaactgcaggtaaggcgtcagttactgagactgttcagataactgaaacatcctgttcatacccattcctgaccattgggaccactgtactattttcaaggataagataccactgtactattttcaggataagaaccatgttataaatagaattatagtgtcctagtgagtgtgacaaatataggaaacatgatttaacccatgacatatggtttgatttgtaggacatccccaagtgcttaatacaaatgagaaatgtactataatcttaaggcataaagatgtttaaatgatggacaaaaattgagggccacatctgagcatcagtttgaaatcagaatatctcctctgtcaaggagtgactttactttctagctgggtccttgataagcttttgaatctctctgagtctgggtttcctcattttaatataaggaggaaagatctaactcgtaccttttcaaatggtgtcacaagggattaatgagtcagtgtattgagaagtgtttggcaaagccttatacaaactccatagttcattatattccagagtttaaaactgagctggtgctatggtatttctctgcacattttcagagacctccaaattgtgcttggacagtttgaaaaatgatttatttttctctttgtgatcagtaaacaaggtccaagctttagatgttgtattttattttaccccactcctaatggaataggtgatttgtgacctctgcaaagttgtactatacataagttgtcccatatctgtgtttttgggaagctggtctgtagctgggctagtgttgctgaagtgg

SEQ ID NO: 109453 - DNA, 1037 bp, Homo sapiens
ataaggttttaggccttgtatgttaccttagcctattacttgagctttcagcaattacagctgagaatggaaaagaatcgtattttcagtgtaggggagtctttgcaacctacctgcctttccactttagaaatcacaattgccttttcttcttgttaacgaggttaatccattaagtgggatatttatatggtaagacattattttcaagtaaattaattctcactcttaaggctgttgagaattcacttaggtggttgaggagaagctttgtactttagtttactgagtgtctctctctctctctctctctctctctctatatatatatatacactttgccttaaaatatatattatggttatggcattatgtgttgtaaagagggagagaatgcttgaattattgtggctagataggggcaggtagacaagcacaggcccaactggaaggatgacttgatggtagttgagcactttgcaaggtacctccagtgagatgccagaccctagtaacaagctcacctggaggggagtttgtttgtggtgcaggtttaatgtcaaggaccagttcttggaaacagaaggtatgtggggtgccagttgaagatcaggggacagaaatgtttttaaaaccaccaagtataaatcacataagatcgatagacagtcgtgatcagccatctacatacagatgaggatgtttgtcagtttgaaaatggatcgattgttgaatttttctttgtttctccccagttaagatatgcaagtttagcattctgtaagtgttggatcagaatttctgatgcccttggcactcactactcagtgtcagtttagacattggctcctaattttttttctttttcttttttaagatacagtgtttcactgctgctggagtgcagtggctctatcatagcttactatggcttcgaactcctgggctcaagtgatccttgagtagggctatagctaggactataggttcacgccaccatgcctggctaatgtttttttttttatttttatagagac

SEQ ID NO: 109454 - DNA, 1382 bp, Homo sapiens
actacaaacagtttaccagcaatgggtagaactatattatttgcttgcaaaatacatcacaacaataaacacaatatctgcctcccccaccccactccactctaccaatagactccaactatgcctatttattggttttggagtttttctattgacatttgttttgctacttgttaacttcttttgtcatgtgtaagcatttgatggcagattggggacagcaggtgttaaaggtttaagagcatcattattgcttttagcttcatttcttctgcctttgtgtttgggcaagattgtggagagtcctgagtttagtatttagataaggtaattacatgtccttctcctctacttttactaaagcaagatcctcctgggcagcttagttccaggtactgtatgaacttgccagtaataagagtaagtttcttttaaaagatttctggatattttacgttttatactcagtcactcagatgcgaggttttctagtatgtgtctacttaggggtcagatttgaccagtttttaacagtacaagttgtacatataggatacttaatgtatttctaggatattatgcttcattttctcttagtattttaaaggttttaaaaaacccattctataccttctatatcttttattgtttaagtcattcaatgggaaagaaaataataaaagtctttagatgctgtttctgatttttcgatcatggtttttttaatctcaagaaaaataattctgattaagaaatagaggtaaacattattctgaagtagtgaattagagaatacttaaatatattgagctggaatccttgtgtattgcatgttgggaatgttaaatgataaagctactgtggaaaacagttctgtagttcataaatatttacacatagaattactatatgattcagcaattccattcctattcctatacgcaaaagaaagcagggactcaggtacttaaaagccagtgtttatagcagcattattgacaatacctaaaaggtagaaacaacccatgcccatcaacagatgaatggataaacaaaatatggtattatatattggaatattttggtacagtggaatattattcagccataaaaaagaaggcagttctaatacatgccataacatgaatgaatcttgaaaacattatgctaagtgaaataagccggacacaagaagataaatattgtatatatccacttgcatgagatgactaggataggtaaattcatagagacaaaaagtagaatagagattaccagggcttgggggaagggaagatggagagatagtgtttcatgggtttagaatttctgtttgggatgataaaaaatttctggaaatgaacagtggcgatggttgtaca

SEQ ID NO: 109455 - DNA, 1056 bp, Homo sapiens
gatcttggctcactgcaacctccgtctcctgggttcatgtgattctcctgcctcagcctccggagcagctgggattacaggcacgtgccaccatgcctggctaatttttgtgtttttagtagagatagggtttcaccatgttagccagactggtcttgaactcccaacctcaggtgatccacctgcctcagcctcccaaagtgctgggattacaggcatgagccaccacgcccagcctttgtgggtatattttcgtgtgtgtgtgtgtgtgtgtgtgtgtgtgtgtgtatagtgtgtatatatactatatatactctttatatagtgtgtgtgtatatatattgctgtatatataaatggcttgatacaaattccactcaatgagcttttcataccatagctgtcatttttgtggcctactaatttctctggcggtaggatcattacggatatcaaaaggtattgagagtcatggtctcctcatatccaggagtgatacgaagaattattacattgcatttagaatgctcttaaatgattttggcctattcaaaagaaaatgatctccccttttctttgcatatccttgttatgttccagagccatcattttagataacttatcattttctttcttcttttttttttttttttggagatggagtttcactcttgttgcccaggctggagtgcaatggcgcgatctcggctcaccgcaacctctgcctcccggtttcaagcaattcttctgcctcaacctcccaagtagctgggattacaggcatgcgccaccatacctggctaattttgtattttttttttttagtagagatggggtttctcctaacttaacattttcttaaatatcttctagcactttatctgtacttttcagaagacttgactttttcattgttgtctaatagtctccttgtctcccttatttgtgagtagggatgatttctgatttaacttggggtcttttaatcgtgggtacacagtaaatattcatttgatggctgggtagctggatccctagtttgaatgtgccatttaa

SEQ ID NO: 109456 - DNA, 2182 bp, Homo sapiens
cgcccaggctggagtgcagtggtgcgatctcggctcactgcaagctctgcctccagggttcactccattctcctgcctcagcctcctgagtagctgggactataggcgcccgccaccacgcccggctaattttttgtattttttagtagagacggggtttcaccatgttagccaggatggtctcagtctcctgacctcgtgatccgcccgcctcggcctcccaaagtgctgggattacaggcgtgagccactgcgcccggcctgttcctagtatgtttcatgtgggatggcaggttttccaaatcctagtttccactgagtcatcggtgagtccaatagagggaggattctagcctgatgtcagacgtcctgcttggcagactaatgaaggactttttttttttaaaaaatgtatttttaacacagattggtgtatttgtatatcttcagtaagtttcagttttagccaagaaataatctttcataacatttttcatgagaaagcatagaatgattttctagaaagtttaatggcaagttgtgttagatgaaaaggaaacatttttaaggacactatgcttcttgggtattcttgagcccttgtctatagataatagccggttacaatgtacagttttcatatttggaggggacatgggaaactactcacttaacttggagttaatattttggtgctctggaaacatctgagtttggaactgtgctgtgcacatctctaactggtttaattgcccagtctctcagtgtcttagcactctcagtgttttatgctcaatctctgtgtcttgttatgactatttggctcaacgtagtgttttgaactagtgattaggaagtggtagctgctgctgttttattattttattgctttactctgtgactacagacagatttaattgttggatgtatttcttaatgggataattatttaaaaacattcccagttactttaaaagcgtatgtgaatattagccatcagttttgtcttgaccttgcctttggctccttgagtgtctctgttcatgtgacagctttccagctcatccttaatgtcatactcgagctgtttatcttagtgaggtagtgtgggcctaaaatgaaataatatatatcaaaagcacctgtgggggaaagcacatctgaatgccaagcagtacttagttactgcaagtgctacttctaccaatatttttcttcctttctgcccctttaaagagaggttgtccctttttaatagatatatgacagctctgcttcctttcttaagtctaagatcaaagaaatgttgtaataaaggggagtcactccctcccattccttctctctttttgtggatgttgttctgttttttaagagcgatcaggtcttgacattagtggatgcagctgttgggctcccaagctctgcctttcatctctgggtcaccactgcagacagcatccttcatctctgtcatggtgtaaagacaccactgtgggggaacagtgcgttgcaggttaagtacatgaagtatttctagagatcctagccacctttgccgttcattgttgtttggatgcacttttctttgaaatgacatggaatgtttggcagagatgtcaatcaatagaagagtttctctgctttagaggtacctaaacctcaccaacttcttgtaaattggaagactagctccaaaaaagtaaaaggggttggggggaagaacaaaacttttactggcaggtttttttctagacataaacacagttgaatggaaaggataatagggatcgaagcctgtcttgctctatgagagtgaatgagctagtgttagactttaatgctggagaaaaataacatctacctttttttttttttttttaaatgaggcagtcagtgcagtctaactgatgaaaattaaaggtcagtttcttcagtgccccacctcagtgcatgccttgggccatgttaataatgacaatcccattatttccttgcagtaggcaggaaatgctgtctacacccattagatttgtttgagtggcccctggctggaaatgaagaaaatttaattttctaatttgcagggaggaaaaaaaaaaaagcatacagtgctacatagaggttgattcttgggctggaaggagtgtcatttttaaaaacttgaaattctgaatctcta

SEQ ID NO: 109457 - DNA, 1212 bp, Homo sapiens
cttccataatgtttattttccttatttatttgtcactattaatgcttacaggaagcagcaaagcatggaattctttacttttttaataagtgtagtactagtgtaacttatatgtgtgttttgtagaaatacattttgatgatagcacgtaacataatacatatttgggagcattttaaaaatattttctgaatttatatttcacttaaaaaaaaagagtgaggtttctagtggcatttttgatattaatagtaagaagtcctgtgatccatacaccttcccagtgggtttttggataagtctcagattagttctcctcaggactcctgacactaattgttctccatggcatgggggaatttgaagcttatatataaaggacttaaaaggctttgaaaaatttctcctgatactcggcatttgggagtcaaaagtttgcatctgaaaaattgttttcttgattgagaatttaggtttgaaagtgactttatggattattaactggccacctggcctctgttatagattgtctgacctatttatttgaaatttatctagtatacttaaatttggcaagaaatcagggcacaaatacaagttaggcgtattgtttatttttctaagtcaataacgcaattcattttgccatggaaaagtaatcatggaaaacattaatacctgatagactgtataaacttgcttaacttttagcataatgatacttttttccaggatgctgaccggatggttttatgtaaggatgtttatctatagtccagtgaattaaaacttttaggtaaatagagggcatgtattacttattcctagggcagttccttttgaatgatttcacttattgagaactgtcattttgaaatgtttcaaaccaattaggcatctttagatctaaatcttccagccttcagctttagggaatacatatttggatttgcaagaatgtgaagatttagccaggtagtcacttcctattagctgtgagaggtcttcggactcaattgactggtgcttgttaaatatctgtttttttggagaatttgtttccctcccgaagagagaaccctcatagtcagtggggcccattgacaattctcaaatactatcttttaggattctcgtgactcagttttgtagtgaacttttgaataaatataagtaatgaaagatggtagatttaatttaaaagtctagatt

SEQ ID NO: 109458 - DNA, 1092 bp, Homo sapiens
ctttttttttttttttttgagatggagtctcgctctgtcacccaggctagagtgcagtggcgtgatctcggttcactgcaagctccgcctcccgggttcgcaccattctcctgcctcagcctcccgagtagctgggattacaggtgcccgccaccaagcccggctatttttttttatgtttagtagagacagggtttcaccgtgttagccaggatggtctcgatctcctgacctcgtgatcctcccgcctcggcctcccaaagtgctgggattacaggcatgagccaccacacccagcctactttttaatagtaaattgaagttatgggtgttagatatattctttgcaagccgttttgaagcagattcttttcctaatgtgtcatgtacaatctgtgggggaagaaggttatataaagcaagaatgacttctattcaacaaaatagtgatattctatattttcctgtctcttttgtttctttctttaaaatgaactacagtgagacatggccagattgatttcttcccttaaattgtctcagaaactgtacccagtccactaattgctttgttcagcggacaggaaatggttatatttgcacaagttacacaatcttaactaagtcggggcaaagaaccaaagagatctctgatctttttttccagcattaacctttcagttccacaaactaatgcatgatgcataaaccaggttactaggggacacttatcaaaaaccataaacttatttatctgaatgactttctgtttagggatactaagaaaagaagttacgtgaggtaatcatgctggtgctgaggttaagtttgtgcagtttcacttcttccttaatagtttttttatacatgcaataaaggacatgtccggaagctgatcagtgccagcatgaccatgaagtgctcagtccccattccttctctccttacccctcagcccccttgcaggctatatacaaatttattcttttccttttctagggttgggaatttgcctcctttcttcctgcccctgtctgttattggtccctagtaccccaatttctgctacttttctcctccttcttttttttt

SEQ ID NO: 109459 - DNA, 1131 bp, Homo sapiens
aagaagcttaagggccaggtgtggtggtgcgaatctatagttccagctatatggaaggctgtggccgtgagaagattgcttgaggccaggagtttgaggctgcagtgagtgaataacccctgcactccagcctggacaacatagcaagactctctcttaaaatagatagatagattagatagacagcctaagggagcctgattgcccctccaccatgtgaggacacagcaagaaggcaccatctgtgaaccaggaaaggagccctcaccagacatctgatttgttggtgccttgattttggacttaccaaccccgagaactgtaagaaatgaatttctgttgtttgtaattacccaggctaaggtattttgttaaagcagaccagatggactaagtcagccccataatgacccgttttatatttttatttataatctatctgctgcttaattttgtgattagtggccagctactgtttactcatcttttattcatctgtaaaactctttttaacttgtctttgtaagaaacggttggctaacagatgaattttcaggttgttcagttttaaaatgttttacttaaaagggtaagacaactccccaatgcaaagtgtgacttcagagataactttcatttctttgaaatgtaggaagtccatagccattgctggctgacatctttctgctcaatatgctccaggggaagattatcaaattttagcttctgagctttcaaatggctcttattatcagtggcatattacatgaaactggttttgggctcttcaaatttatatttttggcaaaggtgttgggagatttgatttcattcgtcatcactgcagtacctggcgcatagtaggctctccatttggtgtgttggatgaatgaagaaagtgattctgctagtcagtggggtttaaaaacaagtgtccaccaacttaatgggtccccattgatcctgagttcacctctgttgccctgtatatatgtgaccccatgtttattgcaaccttatgggcatctcaggcactgcagagaacagcctcttaaaatttctggtagaggcctggtgcggtggctcacgcctgtaatcccagcactttgggagtctgaggcggacggatca

SEQ ID NO: 109460 - DNA, 1290 bp, Homo sapiens
ttgcagtgagctgagatcgtgccactgcactccagcctgggtgacagagctagactccgactcaaaagaaaaaaaatttttggtagactcctatgtgccatttctggagaactgaaatagtagtggacatacataggattcattttagtgtagatatgactttttagtgaaacttgaagtcctacttcctgtgtgtgaaatagggtaataggatcacacccgaagaaatgccgccttgttcaaaagtgacaggatcgctgttcagtttggaatattggaaagtgggcaggtttatttggaagcactttgtttttactatatgtgtaaaactccagggagcattgaataggatatgaggtgctccctttggctgtgcattagcaacgtggcagttactgatctgtcatttactttgaaaaggaattacaaagttttggcctcatgcctggagtagctccagatggtcagaaaagatttttgtactgaagtcagaaagtatattgcagtgatagaattgggcttgtcatgtttatattagaacactggcttcccactttattcctctgcaaagtttttctttctttcttttttcccagagagtgaggggaggaaattgttgctttagagttatgagtctaatatttggaatactgttgttcttggtgataatgatgtagaggtatgattatgtggttaatgtagttactttgtcaacctaaatacccctgattcttagtatttacaaaggatgcatgaaggcttggaatgtagagatacaccaagaccattgtagctgatgtagaaatgcaggtaagaagcttcatttgggttgcgtttgcttgtctgataacctggctgttagcccacaactgttatttagtagcttaccaaacttcatctgttctgtcttcccatgattctgtggttgctaggggtaatgatgacgtttgggtgttcaatatgggtgggaggtgggcctggggagatgagcagtgaggcgataatgatactaacaccaagttttgccattttaggcattagagcatcttaaattccacatatgatcttgtgtaccttcatatcaaccctggaaggggaacgatgtgattcctattttcctgatgagaaaactgagactttgggaggtaatatctgcccaaggcaatatctaggtaactcccttctgcagcctgtttacatatagttttggcgaaaatgactacaatttcctgtcctttcaggacagaggtggctacaggcttcaggaaataaagctcattttcctctggg

SEQ ID NO: 109461 - DNA, 1025 bp, Homo sapiens
aagcagtttacaaggtgatgccttatatttaaataccaccgtatttccaaatctgtttctattatatatatcgtttattgtagcattctcacagtgaccctgtggtgtgaacacagtgactattatcccagttttcagatgagaaaacctagtctgagagttgtgtgcctttccttacttagggcactgtggcaaataaagggagaagtcaagctactgcttccattccagtctctgaattccaggtcccctgctcccttttctttccagggcatgtatgatgtctcaaggttggctaacctctaattgaaaatctgtaggtgcttatcttctgcacttttgaaatgatatgaacgtgaaatattttcaacatgctaacatttttccaggccgttattaggggattaaatcatcctgttaccgtaactgcaattttagatgttctggtgctaaactgagatctgtcaatagagtgcaacctttcgaaagtcttaaaaaatagggtacatcttggactcaagaattatgatatcaaaataagacccttggctatttccggagtgtgttagccaatctaccctgtggttttctttctctggaattggtgaagaaagagataaacaagatccaaaaccaggtcgcatgaaaggatcaacactcccctggacatacagttgtttgggataatcgtaaatcctgctgtctgtagtggctgacgaggggagaagagcagaatcctagcactccggctactgactgtgaaactaatgtatctttgctatcacatatttagcatttaccttttactttaagccaaaaacaccttacacttttcttagatgagctttttaaaaacattgtaatttatgaaaaaaatttgaacatagacaaaagtagagaatagtagtggatccccctggacttattacccagccttgacaatcaatcagctcgtgccagtcttgtttcatctttacccgttttcattctctgctccttgctgtaatattctgaagcaaatctca

SEQ ID NO: 109462 - DNA, 1068 bp, Homo sapiens
tgctgtgaattccgtaactcagaaatgtgtgctcacaaacatcaaatcagcctgtacacagatacatagagcagccatgtatcaaggacttagaatgactgctgatccttgaactcttttttaaaaaggaaaaattagcacaaggttaaaacttaaagacatcagattagttctgtttaacagcaacctgttacttcgtgcttttgcatgtcagcagcttgtcctagagtcagcgagatttcttgcttgtgacttaaagaatcttgtcttttggctgtagagtatgatttcatggtggaggatgttgcagatatcttagtttgctattttatagcatgggttatactttaagggctgaaaaaaataaggtaatttaagcctgttttgagacacacggaaaggaagctatttcataactatcagtcatgtgaaatttggcaggcccctagcccgttagtggccacagtcacatgattgattaccggttggggacccacagttagcttattgcagaactgcatctggcataattggtgttgtcatccagtgtcaaactatccaccctgttctgccaacttccttccaataacaaaactttcttgccttgcacgagtgaaagcctgtgtgattgtatgtgtttagaattacagagttttaaacatgatccaatcacaactatttgaacttcttgattttagtacatttgtacctatgttgccaaaaacatttttttccttgtctttgtgtcttctaaaacattgaaggaagaggtctttgatgcttccttaatacttttatcatgtttgaagtcctgagctctataaataatatagtccttattatctttttatcttgataatttataaaactgactgtccaaagatatgtacgatacttgtagttttatatcaaagaattttaaatgccaagaaccagggaagccatctaattctccattcgagctagtgccgagacctactggacaacatcttgacacttggtcattggcctgtgctggaggcatgatattctagtcctggttctgcctctgcccgccagtttggtttt

SEQ ID NO: 109463 - DNA, 1029 bp, Homo sapiens
cagcctcccaagtagctacggctgtaagtatgtattaccatgcctggctaatttaaatttttttttttttctagagatgaagggtcttgctatatttcccaggctggtcttgaactcctggtctcaggcagtcttcctgcctcagcctcccaaagtgttgggattacaggtgtgaggcactgtactaggcctgaatcgttgaatttttgactctagtcttgaagggatggaacctgcccttctagtgttgtttcactttgggataaagcccaaaggctcagagctcacctgtaatctggtggtggtagactgatgtgtgtccatcatgggttcaaagttgatatttacttagtaaaaacctgccaggcctcagatgggagttagatggtgaatctcctctctgtgtctgttaagggcacctcatgtgtttcatgtaaaatccttgtagagtagattctctgaatccaactgttagattgtttcaagtgttggactcattttccttatagtaacttacttaggaattcatgtaagttaaggacttcagctgcttacgttgtttcccattgtttggaaatagttaatgcactcttaaaaattgattaactgaccatcagtgtgtcatgctagtctaagattttactttaacaattgatatatagagattgaaagttgtgatgtagtaactctattttccctaagattcatctattcggttgacttttttatcccagtactctcttcaggattgatcataggtattgattggcactagtggtttacagatgtaagaactgagagttagattaccttttggattctcccacttagcaactacagaaatttgcttctgtcttactttacttctgtaatcatcactgttttctccattaatcagaaatgtaaccttggtgtcggtggcatttcttttgtctcagtagctctctgatttttgttctcttttttttctttacagagcacaaaacttattgacatgagcctggaattttgaagtaagggcagtcatgc

SEQ ID NO: 109464 - DNA, 2290 bp, Homo sapiens
ttatttaaaggaactatgtaagtgaaatgctaataacatttcttattttcatataatctttataaaattgggatttcacataatctcattaggagaattgaaaagaattaagttgttagatcagagttatccaaaaggcattctctagtgaacattagatcttaaaaagtttgtgtgttcaaaaacgttcggccttggggagattctcagtgtatattaaaagttctttgaagtgtagtgttaaagaacttctagctcttcaactcagagtttctcaagcttgatggaagttttctacagaagatgtattagcatgtagcagagtatttttcctgtgtcacataccttagaaattttcacctggatagatttattaaagaacagacaccacaggtggtgagttcctggcttcacatggtttcttgcttttcctcacttttaccagagtttatagttccatttcttccaagccactcccggagatggaaggaagtggcatgctcaaaacagtgtagaatccaaacggaatgagaaggataattttgagtcatctttcttttgtttagaaaataaatataccttttttgaaaagaattgatttcctatttttaggtaatgtacttctagttaaggcgcataacttaccttgcctatattataaactatcagcttgaccgaagccatctttttcttctgctgttggtcttttagagacttgctgttattcacatagataatacttgttttctctgtgagccgtactacttgccaggtttgggacttctcacatagaggctgatgtaatagggaaagacagtgggataattaacattttggaatttgataagtaagaatgagtgcatatgtgtgtgggcgttaaaagagcttataacttggttagatttcctttgtaaacttaggtggaaaatatgcttagaaatttgaagtgatttgagaagcaagagaccttatcctgccattaatcagtggtgtgacctctgaaaaataagggatggaatagataatctcagaggtgctgctgattaaaaaaaatttttttttcaaatttcattgcaaattttaaatcctgatgttgcatttttaaaacttgtataggttgtaacatgctggaaatgaaatcaaaccctcactggggaaaaattaatgctgatgtacaaatatgatttggaatctttggtatttgccaggggctataagaattcaatgcttctccatttgtgatctttctgtagcacgtgaaggctgattgagaatttgagagccctagctctagatctccaaataattggagatctctaaatagttagaaatatgcaagagaagatagtccacattagcaagagatgagaatgtagtatataccactttggttcatgtatcttgaagcttttatcattcgtcacctcagccattcgtttttttcagagtaagtcatatgcttagaaccaggaaattgcctgccacatcttgttcctggaaaagctgacagcctaaaaatgcttatcattcaaggtgtgacctaaatgagtgttgtacagctattgtaatttttctataaagttatgtggctaaacaaggtactttctagggaaaatttcttccaagtaggcctttatttacaacttgaatcctaaattagcaaaaccgctgtactggtaccacagaagttcatattagaagggaatttgcaggtagtctagtccaacctttttatgttgcaaataaatgtagactgagaaacctaactcctgcagctagcatacataacagaactgaaacccaaatctccagatggccaccacggtcatctttcctcagtatcatgtgggtttcagtcagtgtctctcgtgctagaatgaatcccatgtaaagtatgttttaaattaaatgtaatgcccatacatcaaatcacacaagtctgtaccttcgtaattatattttgaaatgcaattgatttgctgaatataaatgtttgaaatgttttgtacatagctattacatttctttaaactgtattttataagatgtatatttcaatgacaatacttatcctacaaaagagaatggtttcataaattgatttaaaagtaggtgccagtgttacacttataaataaaaagataaattttacatagtgaaatctaaaaaagaaatgcaattgatcatttaaaaaccacattttaaataaattctacaaaaggtagccattatgattttatgattacttgtgttgacagtattctcctgtggaatgtgtgatgcttaaaat

SEQ ID NO: 109465 - DNA, 1191 bp, Homo sapiens
tcccaggtcggccatctcaactttttacaacgttaatgacaaatatgatttcgacatatataattcatttgtatcagtgttttgggtgtgatatctgtcagttgtgatggctgttatatgagttgaacagttgtgtttaatcctgatatgtaaattgttagatactgctttaaaatttttaaaattagtctattccgaatttccagatattaatattatctctgaaatgttgagtgaattagaagtggaagccagagactttgtctttttctctacaactcgtccaacttcaaacgtgcctccttttttctgctactgttgttactgagaaaacttgagcaggcaggtccttggtgcttttttctaaccagtggatggcaaatatgtgatgcacatctcctagctccttaatcccatgaccttgacagccatctctaattatcactgagcgggggcagtgaatctttctcaactctgcactctaggcaggtaccaaagtcaattggagtgggcatgtgagaggaaacctagggctgtgaccaaaaataaacaaacaaacaaacaaacaaacaaacagggagctggagaaggacttgtgcttaggaacacagaaatagttcttggtgagaacagaataatccaagtttcctgcttctccagagcagtattcttaatcactttccttgctcatggagtgggatagggttgtgaaaatgaactgaaatggcaccctttcagttttttcctgttacttaggatccagctcacaaaactaaattattctttaccttgtgtgatccgggtactgaagataatacagattgagtatctgcaatttgaaaatccaaaatgctccaaaatctgaaactttttgagtgccaacaggatgccacagtggaaaattccacacccaaccttgtgtgactggttgcagccaaaactttgtttcatgtataatattatttaaaatattgtataaaattatcttcaggttatgtgtataagggtgtatgtgaaacagaaatttcatgtttagacttgggtcccatccccaagatacctgtatatgatactttgtattatgtatatgcagatattccaaaatctgaaaattcagatctgaaatctgaaacacctagggtcccaagcatttcaggtgaggaatactgaacctatataactacttttcat

SEQ ID NO: 109466 - DNA, 1011 bp, Homo sapiens
caaccccagccccaagcaaccaccagtctactttctgtctacatttgcctattctggacatttcatataaagggaatcgtacattatgtggccttctctaactggccttttctactttgcataatattttcagggctcatctatgctgtagcatgtatcagtattttattcctttttaaggaatgtatccataaaatggatacatttaagctatgcgtccataaaatggatacatttttgtgtgtccattcttctgttggatggtttctcctttttgagttatttaagtaatgctgctgtgaatatctgtgaggaatctgcgtttttaaacaagcaccccgcttaattctgttgctgatagttcctgcacatatctggagaaactctaacctgaatggttagtgttgtagaatgactcccctcacagtgctaagtcctctgttccccatctcttatgggtgcttctgcttgaagaatcactggtctgtgagcgggtgtgtagtggcttagtggaagtgaggttccagaactaaattacatggtctgcatgtgcagggtagagtggacagaagggacatgacagggacagtaggcagagtaaatgggtcctgtactttttcagaatctagtagtgacttgactagttcctgaactagggtgttgctgctggtggtggtaatggaaaggaagagtcagaggtaacagacttcatcaaaggaatactctcttcagtaatggtgattttaaaatactcggcaatttttgtttttcattgactcagacacagttctgtctaattctgaccttatctattcctatcatcctgttgttcaaagtaaatgtatttttaccaactgtttgagagaggaaatcctgggataattagctgaaggatatagtgtaataaaaaaataccaagttttgatattttgaagcctctgatctactagggatgtttagatacagtacaagcctgagtcagagctgaacttctcaaagttctttttcaga

SEQ ID NO: 109467 - DNA, 1001 bp, Homo sapiens
ttagggctggttttgtaaatgttaccaaatctattacttaaccacagatgttcttccattgttgtgtcccacagccagagtagaatggtgacgattagttctgtgagacttggataaaacctgtattctttaggtctctttgtatgtggtggtttgaaagtatttcctcacaaaaatttaaacaatcacatggtgcaaagtaaattgaattatgttttcttaaaaaagttaacttatatcattatacaaattatagatgctcattgtagaatattttaaaaaatatagcaagttcaaaagaaaaatacaacttattcgttattctattatccataagttaagcattaacattttggttctatttcatttcagtcttttaaaaaattgtgtatacatatataatctgactgtgtaaattgcactaagcattctattgtgaacacttcctcatagtctggtttactttttctatgttgtaaaagcaacttcctgacactagtaaatggtattatttatgatgggcatggatacacatatcttttattttacagcagctgccttaagtagacttccagtaaatccttgagatgtatgtattacttgtgatattctttattattatacccaaattgatagattagtagaactggcaggggcattggtcatggaattcagtcctttaatttgagaaataatcctttgagctggagctgcaagaaatttttttttttttttaagaaatgagaaaaataagccagaagagttgccctttgcccaatattattaacttatttaatggccgtaagataacactgttggaagcagctgcctcttttcttgtacaggttgggaagttggggtattgagaatttaatcaacacatttttttaaagaaccaggttgtacttccttacatgctcaagtatggaggaaaaagccaaaccctgaggctagtagtttagtattgaattgccaaaatctatttattaatttcatttttc

SEQ ID NO: 109468 - DNA, 1072 bp, Homo sapiens
tcaagtagcacttgggggaaacaatttagacagtaagtgaaactttaacaaattattagggattgaactattatctctaacattaattaaaaatttttattgcaacagttgggcttgcacagttttacaactagatattttatctttgtacatccttcagaagcataaaagcgaatttttattttgtgaaaagtagaattgggagcaattgcttggaaaatacccaaaatatactaataattcaaataagttaatcatttatttgatgtcagtacatgccccctgctctaatctatcatacagtatatccaacctctgtctatcgtagtatattctttgcatatacttggttggagctgaccttgctgcttaataatttatattattttctcctgcattgtactatcaacctcttaagaacaaaaaatatataataggtgctcagtaaatgtttgttagttgaatgcatttcatgtcttctcaccactgatgcagataactcccttcctgattcctcagtctcttcctctgctggattacttccaccaacatacagtagtatcttttatcttaaaaacgtaaacacctgcacctctccccacccaataaaacaaaacctcctcagttgattccacatccccttccagttgctaccttctgtccctttttccctctttggcagtatttctccacttcctctccttccttaccgcccactttacagtcttcactctgtgttctcatcttcctcttcagtctttagcatgttctgttggctttatctcaggagtgtgtgctgaatccatactctgccgtatccacttcacttccactaccactgctggaccccgtgccgtcatctcactagggtaggacaggacaacccttctcgctggtctctctgctttcccttttgccccaccagaaagcagtctccacatagatcctgaggggtcttttccaaataaaaactttctgatgtcattggcctacctcaggccacgttcttacacctggagtgaaatccagtcatgctgcctggctgccagccttccgtgttagtgctggcctc

SEQ ID NO: 109469 - DNA, 1942 bp, Homo sapiens
gagtaaatgatttgtcatactattcttcttctctcttgcctcttttaattcttctattcttctagaatattgctgagtgtttttaatgcttcttcttcagaaagtagaactccttaaacatatacagaaaactcgcttctcctgctagctcaggataatttatcatctacttgccctggaaggcagaaggcaattgcctcaatcatgtccaattctcttgactttgcctattcctgttgatcagcacttagcatgtcatttcatggagagagtttttttccctcttttgtttcttcttttgaaagcccttgtttcctctaggcagaatatgtaaccagagttttttcctggagtgttcttttgaatacacatttccagacagtatgttcaacatattaaagctttccaccctcagatggtgctcatcatcagcatgtcttttccatcaaatgtgcccctcctcctaatccagtgaccttttctgttctggttgatatcttcttaataactttcttcttgatggcttccgtcttgcattcagtagttcaaatcctgtcacctcacaggtttactccttaaatatactgatagccacggtgtcgggggacccgtgaagagttttgcttacataacagagtttgtctactcctcagaaatcccaacagaaaggaagttttgtaatcagtatattgtagaaaaatgaataaacaactcttgagacgattacccaggagaaagaaggatattcagatgagaatgggagtgacagttaaaaaagagactgcagctattattgctaaataacattatagaagagctccttttgtggcagaatcctgttatgggctgggacttgagctagaaagtagaaagaggctggtcatatgttgggtatggaaaaccaagtatggggaagctcggtcttggatcacattcttcagcatcaagatgcgtgagaaatgcacaacctgtgcaaatacttaaatgaaattattattgctgactgccgttcatgcttcctctaccactcaaatttataaagccctctggagtcaagataccgtcagcctctctcctttgaaatttggggtggaaaagaatgagaggataggctggcatgttggctcatgcctgtaatcccagcactttgggaggctgaggcgggcggatcacgaggtcaggagatcaagaccatcctgactaacatggtgaaaccccgtctctactaaaaatacaaaaaaaattagccaggcgtggtggtgggcgcctgtagtcccagctacttgggaggctgagacaggagaatggcgtgaacctgggaggcggagcttgcagtgagccgacattgaaccactgcactccagcctgggtgacacagtgagactctgccttaaaaaaaaaaaaaaaaaaaaaaagaatgagaggataggatttatgactaaatttaggagtgactgaataatagatttgttcattttaataagtatttatcaaatgtcttatatgctggcagtgtattaggtgctggtgacagaaagatgaataaggcactgttcttgccctaaaggaatgagcagtctagttgaggagcaaaatgtggcctaccaaaaaaaaaaaaaaaggctgtatttacacatacgtgaaatcacaggagagtgcttggattgcagagtgtcacagtgcttaggagttcagaggaggaattgaggattgggataagtgggcaggaaaacagaccaggctaggaaaagtatctgtggggaggctgagcctgggtcagatcagatctaagatgaagtgaaggctagaactatccagactttgtacatcaagtaatccgtttctgttttattaaaggagaatacattatagggattacatatgcagtggagagctattaggggcactacaaacaaaccttatctgcatagtcggtgatctc

SEQ ID NO: 109470 - DNA, 1006 bp, Homo sapiens
cctccccagtagctgggattacaggcctgcaccaccacgcctggctaattttgtatttttagtagagatggggtttctccatgttgaagctggtctcgaactcctgacctcaggtgatccgtccgtctcggcctcccaaagtgctgggattacaggcgtgagccactgcgccgggccaaatatttgttttcttgaaaaggagcttttaaagtcatttctttaacatgaaaatcatttatttttacataaatatacaatataaaaactacaatggaagaaaatcacacttcaatacagacaattatccatgtctttttaaaggtccttagaccaattctagcatcactgtaataaagcaaaaaccatttgctttgtgtttaaagctctagggatagaactgtaatatatgcccatggaattaattagctgggggaggggggaaccaatggatgccaagactctatgtcctagattttctctgacaatcccaaattcatatactctcttctaccacgctcataattgtcagacaatgtgccctgaataccggttcagaaaatacaattcaccagtattacggaaagtcccaggcaagaaaacggatttctgaattgggacatgtccggactgtcgtcacattatctgcttatcatattgcacaaaaagtgtctgtaacagttcctcagtggtcactgacaccaggccaaacttcaaagaacgacgcagaggcatccagcctctaaggtccacttataccttccccccctgcttactgagttcaattcctgacccccatcccacttcttcagggagaaagatgataggtaacgggcttttaagcatccgacgaaaatacctcccttcaaatgtttagttcatgtaattttcactgctgctgagtagccatagcaaccagattataatctaccaagttacctcagaaaccaggcaagtctcctgtgtcccaatatcaatttttctcagtagagcagaagtcattatttaa

SEQ ID NO: 109471 - DNA, 3237 bp, Homo sapiens
atactgtaattttttatttaagactattagatataaattgtgaggctaaagaaaataggtgagtgtgatggtgataaaaaatactgattaaagtaaaattcttaggaagcaccattatgttagtaaacagtaatatttaaagatacttaattgctaatagtttttgtccaaaataatttaggaatcttttaccatagcagttaatctgctgacttgtgttaagtgaatagagacctcaaaatgactaaatgacaacagaatgcgtgcagaggggaattctaagagggcactactatgagatggctgtagctttgaagctattcgaatgtgaaactttttccgctcttgcttgttctccataagacttcttcagctctgtgtctaattctccccctgcctcagtgagtgtgggaactgtatcgttgatgaacatcatgctctgcccagtggctctgtgaatgacaccattgagagctgttcaccatttctgaatttcctcatttgtctcccatcccccgcccctccatgtatgagtcagcatccagaatgtcacagggaccttaatgttacttgtttttccttatgtgatacttttgggaccttaacgttgcttttttttccttatatgatactttaagtgcatttattagacttgtttggcacactaaaacactgacctgtcattctttctaagaattttatgacaggtcctagggaatttgggttgtctcttgctttgtttagtgtgaaatgacaagaatggtgtcatagcttggttttgcaaactgaggtagactaaaacttcaaaagcaaagcatgcatatggtctctccctttaatacatactttgcatataaatgagaaattcctgttttactagcttaaaacccaggaagaggacctgttgcaaatgaagcttgctttcaaagattgtagtgaatctctgtcttggctgaaatttgcaaccagttttttgattaaaaatatttgggtgatttgaaagtaaaattattgtaacatgaatgcattaaattctgaatctttgccaacttttattatattggatgaattgttatttgactatttgtaaaatgtctgtattataaatggaaatgtttcttcctattacaagattaggattttaggagcttgttttctacataagaaactgccttgaaaaccatttctttttttttttgttttttgagacagggtatcctgtctcaaaaacaaagacctggctctgagacagacttgctctgtcacccaggctgaagtgtagtggcacgatcagatcatagctcgttgcagccttgacctcctgagctcaagtgatcttcccaccttggcctcccaaattgctgggattacaggcatgagccagtgtgcctgtccgaaacccatttctttagtatttggtggatttgtgagggattgctaacaagctgaaatgttattgtgaacacttaggcctcacttggaaaatcttctagaattgaaaatagcaagtcatttgccaaggctagccctagtgtcatggccatctttctttctgattgatccaaagctgtatatggtgagagttaatcctcccaggaggctctaagccaagatagtctgaatttctaggaaaatctgaattactctaccaactctccagcttaccttatgatacttaaatgttagcttcaagaccaatcagtcttttacctgtgtgtgtctgtactacaaatatatatttacgtgtgtgtatatatatttgcttcattagacgatttttccattttccatgattggatttacatgaaatttggagaaagattgaagaaaaattactttcagctttgtggagtactcttgatctctgaaatgtttgggggctctattttgcacatgacagttagcaattcctctcaacatggactgatgcacagctatttgttacaagtagacattccatacgctgacctgagaaacccttttacagacagcagcttgctgctgagtaactggaagtttaccagcaggtggtttccaccagggccggaaaatactgacgggcccagagcagaaagtccaggttatggaaggaatgagagcaaaggctgtgattgtacgtgcaactgtcatcttgctgggattgtgtaatgtcatgaggctgggttacgtcaataccaaactatgttgctttcctaggaggttttaagtccctctcaagggaggtactcagggtatatgctgcttcctgcctttctccttcttcctgtctcagttatcttgatttttatgtttattcttatatttacataagaacggaatgttaaacccttagataaaactgtcacccaatgttgtgtcatcagacttaagatgaattggtgttgagttctcagagtacagctctgtagtgtgaatccctggtcatttcgtagctaatgcttaacctgttagccccaatttcctctcttaaaatgggaacaatgatagtacctatctgataggattgtgaggataatccattgtaagtgtcattattcttatcatcattatctagttgtatacacagctttactgatttttcccccccctaaatagatggcatgattgtgggcaatgacttcattttcctacttgtagaaatcagttgaaattctagtctccctttcattgcttatttatgatagacttgctttcatagggttgctggtgatggcaccagttcaaacattttagatgaaggtttataagaatgtgtatactgttcagatatggggttatagctaaaacaatgggtccagtgttccatgaatttaaagtaaattttgttgtagatttttagttgttggttttcttttgaataacagccgttcactcttgcaccacgcctgagcagctatattcagagaaggctgtatcctcttattttatccaacaaagcagtttttctaatgtgcctccttttacattttcattgaattccatacttctggctgggcatagtggctcacgcctgtaatcccgacactttgggaggccaaggtggggcagatcacctgaggtcaggagtttaagtccagcctggccaacatggtgaaaccccatctctatttccccctaaataccaaaatacaaaaattagctgggcttggtggttggcacctgtaatcccagctactcaggaggcttgagacaggaggatcacttgaacctgggagatggaggttgcagtgagctgag

SEQ ID NO: 109472 - DNA, 1029 bp, Homo sapiens
ttgtaaagtactatacaaaaatgggaaaattttaaagcatgaaactggtgagaaaggaagtgactcagaattcaaaatagataggactccacaccagtaatgatctggaactgaggaacattgcctacagaagagagaagccatgagagacagttgaggtgagtgaattggctccatagtaacatggaaaatggaattacacatttcttttttttctcacgtggacagagactattgtagcaatttagaacttcgggccctgtttaaaaaaatctatttcaagcgtcaaattattgattgccagactgagtattattagtaattacagttacagcactgaggagttttctcatagtgtctgagttctgctcctgttcagtggttgagttcattgatcatttttctactcctcattgcacctgtcatgctggtatcagcaattaacattcctcagaagcgaatagaatgccaggctccatctcagatgtaactcaagaacaacaggtgcattctacctattcttggctatagacagagtagttagaaggcaagtaattaaccatagagcagactttgaagaaaatgagattctttagaatttgagacaaagtgctgaaaagtagctctggataatgtatttaggagacataggaaatggctcaacaggaagggtgaaatagccttaccagtctggcctctttaaatttgtttcaagcctgtttcccttcactgatacaaatcttactaactctgcaccttccacagaccctttgttatgtgcagctgtttttgtttgtttttatgaaattcacttgaaaagtcattggacttgaatttatacagtaaaaaatcaattaactagattcttaaattttctcttccactttaaatgaagacacctaacggtttgaaaccttctggctctgagaagaggaagagggtccccagatacaggtttcaattccttaccatttagtctggttccattgatcaggggttcagttttctcaccttaaaataagaggatta

SEQ ID NO: 109473 - DNA, 1086 bp, Homo sapiens
ccttcccctgatagcagaggggaacgtgctcaacttacaaagtttctgaaaaaaatcacacttcttcttttcacgggacccctgtttgaaatttgcaacaaattaaatgcttaggaatccaggtgcctaggagccctgctatttcagctctttccccttaatcatgttggtttacatgaggattgattttggactcactgggccagctacgtgaaatgtggtattgtcattgtctctttgcacagaacaattcatttgctgcttgtcgtgaatccatcctgtgaggtattatgatgacatctggcatggcttctttgtttactgtgtttaccgtatgtgtttagaaggaaaaaggcctgtagtgaccacttttctgtgtcggcccctgggtcaggttttccatcctgactcatgggtgtcgggaccgctgagattggttgatggggtgtgcagaatttcctctgtcgggcttgggagccagaaagccacgatgaagtttgatttggcttgtggcagccttttccaaatgtgaatttggatacagtacagtaagccctctaagaaaaggagaagaagagaaaataataactctagagctgggaatatctggggaacattgaaaaacggggaaagtctcaaagatagtattctgtgtctcccctgagctggtgttgctgtagtgctcagaggccagcctttttttccaagccgagtgctccctgcacttgggagaaaccacagaggcggcctctgtcctgcatgtgctgcacgctgccttgctccagactgtcttgaatgtgacctggcagccagtgctgtttcctgctgacgtggcctcccacaactgagcagaacagagccacctcagtgtactgaggaaggagcaggctgggggcatgaatcaccagcgggatacggaacaaattcagaggggaaagcgcctaactattcaggtttcctggtagatatacttaaaagacacctttcttataggaaggaaggaggaggaagaaaaacaggagtgaagaatgcctcaagagtcaaacagtgatttgtttggccctaggaaggatttcttatcagcag

SEQ ID NO: 109474 - DNA, 1004 bp, Homo sapiens
tgatgctcgataagcgcttgtttcagccactactgaatattttttgagtttgcttatttgaaggcatccaggacagctccttgttactgtcttctaataggccccccaaaagtcatagtatcacagaattttagagtgagatgggactttaattgtaatctgatcgagaccgttaatggtttctttttttttgagacagagtcttgctctgtcaccaggctggagtgcaatgttgcaatcttggtgcactgcaacctccaccttctgggttcaagccattctcctgcctcagcctcccgagtagctgggactacaggtgcgtgccaccatgcccagctaatttttgtatttttagtagagacggggtttcaccatgttggccaggatggtcctgacctcgtgatccgccgtcctccgcctcccaaagtgctgggattacagtcatgagccaccgtgcccaggctatggtttcttctaagaagtgatcgtagaactttgtcttcagttactcccacctgaaagcccactgtacaaaacgtgcaggtggagctgactgagggcagagaggccggagcccagctgctcatctttcttttagtagtggccctggaaactcttcccctgaccattccacactcccgcatacttaattgagaaaccactgatgaaatctacaaccttaattttataggtgagggaattttacctttggtagggtcacggtgttaggtcattatgataactttcaaggtgcctgggaataaaagttttataactttaatctgtctcctgcttttgagccttcgtgatctctccaggagctgctgtaatggcttcccaccctgcgtgggaacaagtggggtgctggtgggacaagtcgggggctggtgatgtactctatgtgtttgtaggtcagagctggaaaccacagagaacagcccaggtggtttcattagtctaggtgtgaggtcactggggggcggcagtaggattggagatggagg

SEQ ID NO: 109475 - DNA, 1027 bp, Homo sapiens
tcgtgtactgtgttagaaagaaaaggtaacaaattactgtgtttatttccagttcctgaatgtagatgaatttaagtttgttatagggggaaatattttctgtctcattgcaagtgttctattatggctttcagttagcaacacgtgctcaccttactcttaagtattatatatttttcaagatatcttaggaatagttatggttttatttgtttgtttggacatagaggttttactctgtggcccaggctggagtgcagtggcacgatcatggctcactgcagtttcaacctcctgggctcaagtaatcctcctgcctcaggctccggagtagctgggactacaggcatgcgccaccatggctgagttttgtatcttttttagagatgggatttcaccatgttgcccaggctggtctcaaacttctgacctcaagcaatcctcccacctcagcctcccaaagtgctaggattacaggtgtgagccaccacatctagccaggaatatttatgttctacctgctgtaagaaaagcctacccaaaagtcaattctgtatgtcaattaatttttttgttgatggagagggagtagtttcaaggaaaagtgaattcagcagattctttactgacactgggaatctaaatgggactgctgaatagctttccatttttttgttttggttgtgtgattgaatatgttttataccaaaatatagtttattgttccatgaatatatttaataattgcaatatcttataatctcactctagattgaattttcatactgtagattgaactttcatactgtactatacagagtagaagtgagttttcatttttaactacatgaaatctcagttctaaggtcaataaatttttcttctgtttcccacaagtaagatcccattatataaaccatctcagaagatgtccacattagagaataatgtttacaagtagttaccaaaatgagaaactgccaggcattatttacttacatgacacgaatgttcactctcttgaatt

SEQ ID NO: 109476 - DNA, 1059 bp, Homo sapiens
gaagggctcagatgaaacatgttttgtaaatgtaactttcaggtaatgaaacagtaccttcccattattgagctctttttttaaatagctagttttgagttgaaaccaagacaatagatattcattatgcaaacctttgagccacctttatggtattactgtcttagtattgctctaatgttaaatgtcttctctgtttactgtaagataaaacctttgtgttcagtcagaaaataaagggactccttggaggactttgccaggggctgcatgaagatatgtggctgagacctatatacaaaggccttctgtgcagggtctatgtggctctacaaaagtggtaagctgagctgagaggagaagcctacagaaatggaaagtggaggttcctgtgtccattatttcaaactgaagttgctcctttatttagaaaacaaagcaacatgccagacaagtacataaacatttcatgtaattatattaagataggcttggaaagtgctgatggagactttaaaaacacctggttcaaaagcatgtatttatcttctctgaaattaactggtgttttatgtcatttacagtctagtgtgcacacttcttatttagcaaaaaataccacttcattttcattttttccttgttgtagatgtggcacatattactactggaaacttcgatgcccagtatttttttctctattctttttattaaagaatggggtatctttttaaaactctctttgcacactggcatgaacagggaacacagtattggtggagatggggttgggggaggtttagagggaggaattgcattcttttggcattcctgagaggaaaacagctgtattaacttttttttttttttttttggaaagtgcagaggcatctcccctgactctcagaattccagttctttacagctgagcaaaaacagcatggcatattatttatgcctggagtcagcatgcatgaatgttgctgttctgattattagccaagagaaaacagctgtatacattactaataaaaggactttgaaatgaaaaaaaaaaaa

SEQ ID NO: 109477 - DNA, 1061 bp, Homo sapiens
cccccccccccccaatacaatttgctgtccatccggtcccatgtcctagtttcctctctggccatgctttctcacaggggttcccagttgctctcctcatttccatctttgctccctgaccaggcccctgctgcttttgctttctcgctgcttttgctttctctgctgcattccctggatttgtctgacagtccagggttcttgtctccttgccgttgtctctctcagtcatctcagagtggtaatagagaagctagttgatggccagggaaaagctacagagagctaatgtctgctgctccttgcttctcttcctgtcacctttgggcctttgttgaatgaacaagtggagagtaagtagagaaaggggtttcctgaaacatttccagcctgttcttttaagtgctttttttcctcaggattttatagtcctatacgtggtaggtaggcggatgggcgggtggtgggggaggtattacagcaaaatgcttacatattcttttcacctcttgttttcttttttgttctcaactgggacctactattctcctccccattgctgaaaggcaaattcttagaaaggggccatttagagtatgtgtagctgaagaacctcaaatagttcttcatttagcaaatatttaatttcttgagttctttttatgttttgaatattcttagagatacgaaaatgaatttgatgtagattctgcccttaaaggggtttaagtaaaatctagaagcagaatttacacagacaaccacacagaaaaccctaaatctaaagccgatatgtaaacacatgattaccatagtaagtgagaaccttgtaccgcgttggagaagtgtgaagggtctccccagaagacattgtttttcctggggaggggatcacagtagtacagatgtgaaaaatctgccctaatattttttgtttgcactatgtggatggaaatgaaaacttacctgtaacaaacagttttatctatagaatgttttataagcctatttttgttccttttctattatatgtctacacagaatataaatttaccccatca

SEQ ID NO: 109478 - DNA, 1048 bp, Homo sapiens
ttgggaagcctaggtgggcatatcacgaggtcacaagattgagacctgcctgaccaacatggtgaaaccccatctctactaaaaatacaaaaattagctaggtgtggtggcacacacctgtagtgccagctacttgggaggctgaggctggagaattgcttgaacccaggaagcagaggttgcagtgagccgagatcacgccactgcactccagcctggtgacagagcaagactccatctcaaaaaaaaaaaaaaaaaaaaaaaagattttcagtgggagcacagactgctgctcactcactgagtggatttcattatgtagtctcagtgtttcccagactgcttgacaaatgaaggatgtacgttattgctttttccttactttggcctgagaatgatgcaaagcaggcctgttgcattaccaagcatcttgggatgctgcactgagtaataggcttttagtatgtgttaccttgtcaacagcagtgactgctatgcccaggacatcagcattgagttgtttttgcacttgtgggggtgacttcctattgtcctaccagaatcagcaaggtaagttgggagaaatcctttgtcagcaggatgagaagcagcaagtgaaggctgggctcagtggaggagaacaattctaggagctggcgtggtcacaggaaggatagagaacacggaggtcaggaggaagcatgagtcaggctggtggctgtccggggtcttctcacattagcagctggagagccagggctgaaggttgagtcgtaagtggccagccttgtgaatgtggtatgctagacaccaacagaacttcctggagctgggagtttcctggggtcttcctgatgtgtaagaactgatgatcaggaccttacaggttatgtgtctattttggttgtccgctctgacagggcagtggtgttgtggtagatacacttttgctggaggcatttgctaggtgagtgggcaagatgtgatttgtattgggtgtaatactcaatccagcagtgcttctctgctgcagtcaagtccagactgc

SEQ ID NO: 109479 - DNA, 1094 bp, Homo sapiens
aatttaaagatttatggtaggacacatccataggtgacttcatagaagaccaccatgggactcagtgagtacccctccagtctgggaaaagcttgacaaactacataaacctgagctgagggagaaaatacacatgccatttccccaaattcctggtttctagtgtcttggcactatggtatttttactcttattttataaatcctataccagcattttaaaaaatgaagaaaatggcaagaaaatcatggaaaatttgagtcctcatttagtacctccctatcttgattttttgtcttttaacagatgaagtggtgaagagagcctgcgattgaagattttttcatctcagctttttcccccttaccttgttctctctcatgtttcatgatctgtgtcatagatatttcttcattacgagcacttcgcggtgtggcttttcaatgtctgaagtggattaagtggcccacagtcagttctgtgacttgagtttcaaaagtaaaattaccatcaacaatgtgattcaattttattttctatactagctaaaagcaaggaactatattattaacaatcttggctttactgtagtttaaggcaggtgatgatgatgcttattagtccacctgaaagagtccttccaggtttttggaagctttattcctgcttattaccttgcccttgagaagtccttcatggaaagtggaaacactgggttgacttcttttccccatatcctagttgaaagggacagcttatatgtatgttagactgtccaaaagtgtttgtagaacctcattttaaaaaatcaactgtattgtactttttaaaaaatgggatcttaaactctttattaaaaataataaatggaaatgtgttaagcaaaaacattacttgacctcttcttattcattgtgtaataataacgtataaaataattgctttatttacatctgtattgaccatggctgaacttcttgccagtaggggtgtcgtgagtcctgttcatctctctgccccttggtgggatgcctagcacttggccacttggtaaatactggaggaatgattgaatgtgtgaatcctggattagt

SEQ ID NO: 109480 - DNA, 1069 bp, Homo sapiens
gagaacggcgtgaacccggggggcggagcctgcagtgagccgagatcacgccactgcactccagcctgggcaacagagcaagactccatctcaaaaaaaaaagaaaaattatcttagtggttatactgttgtagagtagtattgattgatgcatttattcaaccagcagcccttatgtggttctgctgtttcgtactctagtagatactttgagagctacaaaaatgtaaacgtgtgattcttgtcgttgatggatgaccttacctgtcaagtgaaatgagacatgtttttgtttttggttatttgccatttaaatggattttaaaatccttcgtactcactccaaagttattgttttctgcgtctggattctaccttactgcttctataaagttgcatcttttcatcaaaattatatatggtactgctaaatgggttggtggaaatactcattgaaaagaatataattatgacatagatcatatacatagcttcacattaagaaaagggtattgagtatttgaaacacttgacattgtgtttataaatatctactcatctagtccagcactgaagagtcatataagtacttaatttcagaggtgaatcacaagtggcattaaaaatgtatttttcttgttacctggggcctatacatttaatgagtttaaattattcctttggcctcaactctggtgggtaacctaattctaataccatggtgaatggttactgtgactaccctgttgctaagaaacctgttatgttatcaggttgccttggcgaagtaacggcttcttaggactccttagcaccgctgggaggttgttaatcagagctgtggaggaccttacagaattagtttccaaggttataactaatttttctttaggaagagaaataaatctaagtctgtaaaaactgaaagaaaacaaagtctaaattattttcagttaaatcatgacctttagttattttaaaaaaagtttgatcttgagataaaaacctatttttactagtatttttactagttacaaggatctatgtcttgaatggtggcaccccaacc

SEQ ID NO: 109481 - DNA, 1011 bp, Homo sapiens
atttcccggtaccctttttttcctccctctctttaatgactctttatttgtaagttagaaatttgggctaagcattccctgcaaaaaggcgtctttcctttattcattgaaaaacacagaaatctttagtcttaagcaatacagactggtctgtatgaggttgtatttgtgcatgtagaaagaaaaagtaagaattttataaagccttctgccttgctttggctttttttcggccagtatttccttttgtgtattctacaagaagaccagagaactacacatgatagtagtaaagatccctcccgtcccctgttagatactttctgtcatatcctttgacacacttgattcaactaacacccccttgtaagggcaagtggttattcctaattttgtaagttagaaattctccaaacggaacagtgtattggtctctttcccaaaggatgcaagatttgtcttcttataaagtcttaagaatggtctcattaaccatctgttattgaatgagtagattcccgtgtagacccttctgttctcagggcggtcattccaccttcccctgagtctctggtccatgacccctggaagagattgcctgaaagcacattcataattttgctccacattcatgatttggcttaaacaaaattaagaattattacttgagcctttttaatagtttgctgcgggtgtggcacactttttctgtaaagggcaagatggtaaataacatgctttgcagacatacagtctctgatgcatactcttttacaaccctttaaaaatgtgacaaccatttttagcttgtgagctgtaccaaagccggccatgggctggcagtagttttcctgagtgtttgtccttaaaaacatattacatggggagttctgtggattctgaaatttacccattattttcgatatatatagaagtgggaatgaatacttagcaataaaaatatgtgacaagctgtgggcactctaacatcctggaggacattgtctctct

SEQ ID NO: 109482 - DNA, 1057 bp, Homo sapiens
ttttcacttacaaacaaaagagtaaaatcaacaggctggtctgtaagaactctcatttactttccggaccccttctgtgtggtttaggtaaggcagagactggaactatatacatcaaactaatcatctcacagcccattattaggtcccagctgccggacaacttagaggatttttattaacaatcaagacacttttgtaaagttaagttaatttttggagattgctggtcccttccagcctgacactgaagtgatgatgagtgagtgagcagccttctagattggcaagaaagtggcatcaggtagataagctatgactctgttttatggaatatttggttcatttttttttccattgagcagccttctagattggcaagaaagtggcatcaggtagataaactatgactctgtgtttatggaatatttggttcatttttttttccatttccataatcacttttgattttccttagtagttctagtccatacatcctggacatttctctcttgcctttggattttaagtgcatgagttaaaagaactaagctagtaaaccacgttaggatgttgtcaataaaatgcccttacagtgttgtcaaagactttgctttatggcaggcactcttgcaggggcaatggaagagccaaccctgagagtagttaaaagggatcttctgtggtttgctttgtaagcctcactaaagcaacaataattgaaatccctgaaatatattgagtaatgatatgttggtaaagcaatacatgattattacttgtcatacagctttcaggttggtgatgtttttcatgttctttcatttgtaacagatgaataatgtaaaacagagcttgtgaggagtacaatgacattttgttgtctggttaataatttcagcactatttgcaaaattgccctgccagagcatgacctaggaattgtaaagtggaacacaaataaaataggaaatgtgtatttgcccatgagttcttcatggacttgttataaaaacacttgtttgctgtcctgtcttttgctcacttctctgtcccc

SEQ ID NO: 109483 - DNA, 1035 bp, Homo sapiens
caaataaatgacttactttacacaagtctttgtaagtaagaatcactggagggagaaaggggtgtagaacaggctcttccagcagggacaccagatgatggatcacattcacatcagccgtcagttaacagaaaagaacaaggaatgtagaattccattatgtctcctgctcatgtattttgaggaagcatttcattccattgaatagagtacagttctcaccattgtgacgcaaaaataacacctccttttatgctaaaggtccatttaagaaataccagttaaaaattgaacatttctaacggagagaagcttcagtgtgctttttcttactagtattattgctgtgattacattaaatgcaaaaatatttattgcatgtactaggaaaagtggagaatttttgacttggatatagttcggattctggaaaacttctgtagaaaatccaaatagagtaaaagtagagctgtacactcgcttgtatgaaactgatgatggaagcatgttgatgctctttcccggctgacaggtatggcagaatatgctagacaatattggaagaatagttaaaatggaataatttgaattgaaaaagggaaagaagcagtctgtaaggcatgtgaatgactaacttcatttcaattgggctccttgaccagaagatgggtgcaaagttaaatgaccttccgtgatagtattatgtcttttatgacacgttacagtagagtatctgaaaaagattgttaatatgaagaaaatagaattgagaagccaacaggatgtgtacacaacatcttctttaacgctggcagtacacacacttcaatgaaatgaggaaggccgaaccaaatataaaatgtcttagttgtcttgttatcaccaagagataggagcaagatacattgttgtcatgcagttgtagaaagaaagaaacacacacacacacacacacacacacacacacacacacacacacacacacacaatctcctgcagcaggctggacatatgtgagaagtgctcagtactaat

SEQ ID NO: 109484 - DNA, 1052 bp, Homo sapiens
aatgtgacccttttagaaccttcatcacagaaatagttgttctgttttttcagcatctgtgattctttccctccctgtcatagaataaaatgtgtatttatagtcatcaccaagaactcatattgcctcatggggattgtatctcagcatctagaatactgcgtggcacaaagtaggtacttgctaaatgtttctaaatataaatgattgtccaagcttaagtaagtacaggagagattcatatatattcttaaatgatttgcatgtttaaagagaataatataatgctcaatagatggaaaataacaatgagactgatctatacctgcaaagaatgaaatgttctgaatgtgtatttaaaagagagaggaacaccaagacagttcactggagaaaagaataatcttttcaataaatggtgctggaaaagctggatatccacatgcaaaaagagtgaagttgaaccactacctcacatcatatgcaaaaattaactcaaaatggactataaacataaatctaggaactaaaactataaaacttgagatacaaaattttataaccttggattaggtaatggatttgtatatgtaacaccgaaagcatgagcaacaagagaaaaaaatagataaatttgactttaaacaaatgaaaaatttttgtgcctcaaaggacaccattaaaaagtggaaagaggcctgggaccgtggctcacgcctgtaatcccaacactttgggaggccgaggcaggtggatcatttgaggtctgaagttcgagaccagcctgaccaacatgatgaaaccttatctttactaaaaatacaaaaaaaaaaaaaaaattagccaagtgtggtggcacatgcccgtagtcccagctactcaggaggctgaggcaggggaatcacttgaacccaggaggcggaggttgcagtgaactgagatcgtgccactgcactccagcctgggtgacagagtgagactctgtctcaaaaaaaaaaaaagaacaacaacaacaaaaattaaaagaaaattcacaaaatgggagaaaatat

SEQ ID NO: 109485 - DNA, 1066 bp, Homo sapiens
aaaatcccctggctgttgatgtggccttcctgaacctgcttttagtttaagagtagccattagtgcagccgcaatttcactgattgttaggcaaatacttacctggatatgaaaagagcctcagagctaccaacattatatctttttaaagttttgaccctggtgttggtttagtctaaaggctttctctatcaaaatggatactaagaaaccagataattgagggtaaaattagactttagcctctaggactttgcaaagtgattttcttctgagtctgactatgaatggaagcattttactgcttcagacatttattatgttggtttagatacattgtagaagaaatgcctgttataccatagaatgtttgagcaagttatcacttttaagaattatatatatataattatataatttctatataattaattatttatttataattatatttttatatatataattattccctgttcatctcacattataacttattcacagaaaaaacttttttgagatgatattttaagtgaaatatatcgttgtaacttagggatagaatttgactgtatgtgtgttttgtttatttttttttgtagtcaaagaaatttgacatgattcaaattaatcaggtgctttcacaatgtcgtataaggggatgatagcaaaacatgaaatcaatactttgatttcatagcagcatcaataacttcctatcaatttgatcttttttccatgcgacacaccaagaaaacatcaagtattggggatatactatgaaaacatttggataaaaactgaaaaaatttagttagctgtaatttttttaatgtattcagtgctttgactcaacatgcattaaataattgagtgtttcttagagctttctggctgtatctgagctctgatgacatgaaaggccttggtgactgactcattgcttgctggtatatgtctgacttgccttattttagcagtctgttagtaggatgccacatggttactgttttgtaaatgctgtcctttgcaattttaggcaagacaacagtatgatttaaatcgt

SEQ ID NO: 109486 - DNA, 1054 bp, Homo sapiens
tttaccttagttcttagtgtgcatacctaaaagcaatttaaatattaattttctaaactataagagttttaaaagttttcaacatgtctgaaaagattattactgcccatagtgaatatgttaaatctcatgtgtaatacatcgtggtgtttagaacatttactatccttctggtatattttgacatagtttctttggatacacactctctgaataggattatatttgttttgacacgttctctagtgcaaactggttctctcatgaagatttgttttttaacaaaacaactcttgtttatgctttagctatgttaacagtaagaaacagtggagctttactgttgagtaattgagacagcagttttgttaaattatgcagggtaaccatacatttctgttgtgcctgtgacagtcctagtgtaggtctcttgccttgaagaaattattgatattccttccttttcgctctcagaagtgttcagatttggatggtaatttatattgtcactccatagaagaggtgacccttttttcttataaagatgtaaggacccaatctttatgttacgcattgtcatttttactgatacctaaaaataattttgaactgatttaaaaatttaaatttaacataaagttttccccttgagatcataagattgcttgcaggcttctattttcttttgagccactttaaaatgtgcatagtaaagtcaggtgacattctacatttgtcttgccttctattactccaaaagagaagtttgagaccacagcttattatgtttggcaccagatttcagagatggcttttctttatccttatacttcctccttgaacatttcccctgattctgtgagctttgattattttaaatggaaatatgtcatctcattatcttagttaaatttgttcaaatgttggctcttttgtatgccacagaaaactttgactgcaatatacttcccagtagaaatactattctgtctacagggatgagtagacttttaaagtagcttgattctaagtacatgtttaataggggtatttt

SEQ ID NO: 109487 - DNA, 1073 bp, Homo sapiens
ttggaggaaggtttatgtgtttaaatgaagttttggaggtagtttagagagaacctattttgatgccacataaggaaaaacagtggctatttctataggcatagggaagaatgacttaagtgaggcaaaaaaggtagcatttggataaggtaggtgagtttatagatataaatgactggaaaacaaagacttgaacaacttttaaacataagatcaattatttcaagtagattccctttttcattcacaatcacattctcacagacacagtcccagtttctacctgactgagatgcagtaaggaatctgattataacactcattgattataacactcattgaatttatggattccttactgcatctcattcaggtagaaaaagggactgtgtctgtgagaatgtgattgtgaatgaaaaagatggaatatgtgtatttttgagtgtctatggaagagcttctgacaagagagaggaagattaggtaaaatgaaatatcgccgtcggcatttccccctacgttatttgggtgagtgaatttcagcctgagagaggaatagtaagatacagtgaaatgtgaatagatcatgtgttcttttaatttgaattatgtattcttttctctattttccaaactctgcaattatcacgttattcttataactcttaaacaaaacataaatcaatatcatacaaaagaaagcaaagattcaagagacttttacacaactcttaagggaagatgctgggtctcatataaaataatttttagtcaaatgatactgtaatttctaagtttgaaattagtttattagcaatgttacaatttaaccatgactatacaagaactcatactaaaaaaaattatgaatagattttcctgaagagaatttttatccgaagaaaaacgagagagaatgtataaattgtccagagagcttacgaggtttgaagtactttgattacttgactcattctttaataattttcaccttgccttgcaccaaaactgatttaagggaaatgacttagacacaaagaagcagataaaataaatgtaagcattaaggagcc

SEQ ID NO: 109488 - DNA, 1023 bp, Homo sapiens
agaggcctctgagtgactctagttaggggccgagcgcacttgaacgccttgcaactgtctatgtgtgggatggagatagttctggggacagaagcctgtttcataaggagcatgctgctcattaacatgcgctttctgacttgggccttatcctgcaggcccaaggctggagaaatcaaactgtgaataactacttttctgtaagacccctttatgatgatttttttccctcttactgggatgttgattttactagtgcaaaggcaaatttacagctcaacaaagaggaaaccatggtggcccaaattgttaattagtagagtatataattgtctttattaagttacatcacttatcctatcttttgccttttgccctttccccctcgtatttttgttgcaatctggaatgttttaaagatgtttactacatgattctttcaacaggcaaaatgagatatttttgtcatgtcaagttaagaagtcttaacccattaaatcatacttgaagcttcacatttttcacttgcatataaagacaaaaagcatgcaaaaataattcgttgagttttcttttgaaatgaatgttcaccagaagtttgaggtcagaattttgattagtttttaccatatgtagtactgaactctgtaaacccatgttattttctctgcctttttgctttcttgggaactgatcatgacagcatttagatgacatcagaacccatgttggtaaaataaatgtcatcccaaagaaccctttaaacagcaggtataagtgatgatatggtttgtttctggtatatttgtaaccttcaattttattgatttgaaacttctatatgttatttctttcatttagctaagttgaattctgaatttaactgggttagagatcgtcatcacaaaagtgccatactcagaagcatatttaaaatatgtactagttgggaccttgcagatcttggtttagtctcaattcagccacttgggaactatgtgcccttgggcatgatagttcatc

SEQ ID NO: 109489 - DNA, 1782 bp, Homo sapiens
gttgcccaggctggtcttgaactcctgagctcaaagggtcctcctgcctcagtttcccaaagtgctgggattacaggtgtgagccaccatgcccagcctatgcacagtaaattaagctagtttaagcagttcataaagctgaatgctataacaactgtgctggaaatagaagtgagttgtgctgtggacgtgcatgtgtattcacatgtaaaatggcggctgtgtattttcagggcatatttaatagttaaatatcagaatctgtataattccttttaaatgatgaccggagctcatggcatttcccaagaagaagtgaaatgaacctatctgatttggaacatatattttctttaaaaagtaagtaagattgttttcagggagcatgagataagatttacaaagtttaaaagtaatctttaatgaatcttatgtcccgtaaatgttaaatagccctcagggaaattacataaagctggtactcattggatattacactaaatagctaatgttataatagattgattagaggtgtcttttctctgatggctgtcatgtaggcagagtctaataattaatttaattttgaagaagatttctgtggaccctgaggtgtcatatgccaagtgggtgacaaattctaaagccctgttatctgccttgtgtttttaataattattgcccattgtaataaacttgtatcttagatttcttttttcacccttcagtgggtgttttgcctaaattgaaaagacatagaagattttaactacatatgaagtactattttaagtcatttgagatttttctctcctccagaattttttaatcctgtcatacttggcggaaaataatgtatacatcaaagtcaagcatacttaattatatagtttaaacatcagtgcatcattagttaaatgaacaaattagttaaaactctgtatttgctgtgggtttcaaaaattacctggacagtaattagagttacaaagagttctaaaacaaaagttgatgagaataatgaagttgaactacaaagccctgattgtataaatagggcaagaagaaataataccaagaagtgggggaaaaagtgttttggccagacctgagaactcagctggatcatgtggtatcagccaagataatatgtgacagagaacggcagatacaaataccatgacactctgtacatgggaatagagaaatcagggataaaaaatacaagtcatgtagatcacagctctccgtgtagccaggctcaagttaaggtagttcagttgtataatcaactttcgtggtattgctaggaccttaatagaggagaggcaaagctgaggggagatcacattatgttacctctctggaatagtttctccaatctttccatgcatttaaaaaattggatctgtctaattcaagccatttagttctacccatgctcatgatcctttggttttagctacttatgtgatttttccatacaaatatcagtcacttgcagcatataccatgccctgccagttccttttggaatcaatttaaatgagaaaaataaaggactttgggaaaaactatttaagtgtgtctgttaaattgttttactatttgagaatagttctggagtctgaaatacattttccatttaatagtatttggcttttttttgtttgtttgagccatagcattcgtggaaatatgttgaaatcttaagtggagagaatatgacttactgcttttggtattacttgctgtctagaacgttacagtctccactatagt

SEQ ID NO: 109490 - DNA, 1126 bp, Homo sapiens
ataactacttgcttcttaaagaaatgcttgattccatcagtttcttcagctttttctgtgttcatttctactagaaattcctgtgtcatagaaaaaaagtcccctaaagccaccttcttcattggctctgttacctaatcacaggctccctgctccctgtatattccccgcacccatgactacttctctgttcattctatctgatcataatataggggccttatacatgcacagagcaactgtttgccccctcagaaacataagcctagaccacattttctgggtagattagtgttttctccacaaaggaaggtgtttgtgagactttcatccagtggctgctaggaaggtcaaattaggaacttttgtctacagatacaaagacattaacttacactttatgttagtggttgttactttatttaacaatggaattagtgtccactctacagtttagcacctctttatccttactgaaagactttagagaaatggctgctaaggtggagtttcttcaaatacagaaaaacatctggagccgtaaataagttgagcagcccggatacattctgtactagctggttgggaagaaaacaacacagggatatttcaggtggtgccgcacaacaaacagcggtagtttatggtctgagatagtctctgttcttttggaaccggtgtgtgcttcttctctaaagccacagtcagcagcaaaaaatactgtaacatgtcttttggaagcaattactgcatgatcctcagtgttctagcctcagaacatcctgagtgttccatttctatacgtgcgggagaagaggacatattaccgatgctttggcatgaagtaatctggagaattattataggatatggtctttcttgaccagcttttgaaatggctttcagtagcttctctttggatttccaaactgaccttctgtaattggatatggcctcttacagaagcagtagtataaacatgtttaaacttctaatgtaattattttatcctgaaccaagtagtctagcagtctcttccagcggatagatttgtttatcttaagtagagttgatctccccgccttacccttgttacctttggacacaggagatggcaggagaagag

SEQ ID NO: 109491 - DNA, 1040 bp, Homo sapiens
attttctccctctgtcttcacatcatcttccctgtgtgtgtctgcatccgaatttcctcctcttctaaggacacctgtcatattaaattagggcccaccctgatgagctctttttaacttaattacctctttaaaggccctatctccaaatatagtcaaattctgaggcactggggggccaatccagatttttttggtcatccattttttttcttttctgttgtcttatctattatattttcctcttgtgtgtttttatttctcacccagattagtccatgacctaaatggccgcttttgctcacaactgcctcttgggctcaataagctcactgttgtctagggtttatacacctcagctgttaggagttggagatcagatgaatgtggtttatcgtctgtagagtgaaatatggctactaagtggtgccattacagagccaatttggggtgtaaatctagtatttcagctcttggactttttaaactgcatctttaaatagaacactagtttcattctgagggggggaaatatacatgcagaagacattaaggcctatgatgaatgtcatgttttgaacaacaagggcagctcatttggacaacagaaatccatctgcagggcttaagagaatcctttattttatacagaaaccgaataagttccaaataatataaatgttattaaagacttagaatgagatagcaatagtgcatagctttggcctagagtaggtaggcttgaaaacaattcaggacttcttttacattgaccctggatttgtggatgtctgttctatcataatatgttttagagaataaaatggaaaagcttgtaataccagagagcttctattcctcagagtggttgcaattctggagaacaacctcttgcaagtagcattttccgtatagacatttcttgcctgctggcccaatcttaacttttcattttagttcatttctcagttcagtgcatttagaagacagtgcatttttcttttctggactagggcagatggtgctgtcacttttgatta

SEQ ID NO: 109492 - DNA, 1036 bp, Homo sapiens
cagcttttctatagattaaaaatgttttaaaatatgtattttttacaaatcgagcaatttcacataaaattttgcatttctagattctctagaaaagtgggagtgtctgccttacacccatgatacaccaagaataactgattggctgcatagcagctgcccccctcagatagggtgaggttttttccattttccatagtccttacccttcccttttgttttatatacccactttctttactcattgatattacctgcctagtggctataggcattttagtatgtacccacacatgtaacacttgctgatttcttggggtggtagtaggttgtgtcatggatggtaatgactttttcatatgctggaactcttgagccctctggatttgatacccatatcaggtgatgagcttcacttggctccttggccacaggctgagtatctagccttattcccaaataattcagtcatctgagacataattaagaaaatgtggatgtaaacactgttcaaaacttgctggataggagatatacatattaaaattatctttcagatgcaacatattagaaattgtactctggattctgcctgtcagttggcacagtcttgcaaaaagtattgtataagctgcttgaaaaaatgtaatatggtatgccaagtcctaatgaaaaaacattttgtggaaacgtttgtagactcccatgcaaaaagtagtgtatgaactttaattacctttgtaagttgttctatcctgtgtttaagtgactactttcctgttacatacccagggagggtaccagctcttgctggataatcatggtcttgagccttcccccaaaacacaagagcagtatctggcagaggttagggttcagctagcagtgaacagttcaaaaacacagggaagaagaggaaaggactggtgctagagttaatcttgtcaagcaaacatatctacctaatacttaatctgtttttgtgggtttgcatccctgtacaatttgatgttcttaaaaacactagcagcctttg

SEQ ID NO: 109493 - DNA, 1153 bp, Homo sapiens
taaatggagtctactctaaactcaaaattagattccatcaagcccactgtgaaaatcaagaagatcctctaacaagttgcagattcttaagttctatcacttatctttttttgtacacatccttcccccctcgtactctcttctccaagcactattctttcatttctaaaacctaattattgccccacccccaaaacatgcccatttccctcgtgttattaaaaggcaccgtcatccatccagttgagcaagccgaaaactaggaattagccttggtgtgtcacgtttcctcacccttacccatcacatccagtccttcaggacccacacctcctcaactagtcctgtctcactgtctctactctcagctctagcccaggccagctctagcctttcctttgcctgggccactgcagcaatccactgactggtctttctgttcccttgcttaccttccatatatccgttgttcacacagaagacaaacacatcttttcaagctcaaaagaagatcatatctgtcccttttcttagacaccccagtggctgcccgtcgaacgtaaacatgtgaacttaagtaaacaagtaaaaacaagtaaataaacaagtaaaaatacagctcaaagatttgagctcacagccctgaatggaataaccattgtctcttcaaccacatcttattactctcagtttccaggtacattggtccctccacttgcccttcttaggaccctttattctctgttgcctgttaaattattaaatgttaaatggaaccccgtgttaatctccttaacatcgcgaacacttaaaactatacagtgacaagtcagtgaaccatagtgaaactccattccccaatgacaccttcattcctgattttcctggtaacatttgtaatatcaaaaattcatgataacaggcaactgatttaatgataactccagttaaaaggccttggggaaggaacttgacaaccttactgccttctaatggtattgtttttccttttttctttttcgcaatgcagaatatgagttggaagtaaagagggtgcaagacattctttcgggaatagagaaaccacaggtatgtcttctggatttctcagcataaatgacactttttaaagtatttcaaatgtgcttttttt

SEQ ID NO: 109494 - DNA, 1069 bp, Homo sapiens
tagctgaattggaaaaccttgattctgcatgtgtttcaaatactgaggctttttaacagaagagtccaaacatgcctcagggtacatagttgaatttgacaacctaaaagcttgaggtgtgttgaaggacaggcataataaggcacttgtagaggagtggggtgttgccgttgggaggggtgcagggagtctgtacttactctggtgaggagcaggctgccactgggggtttttgagcaaagaagttatgtaatcagggctgcattttcagaatgatcaaacagttggtggatgagttggagtgagaagaagatagatgcagggaagagcagtgttagaatctgctactgtagtcctggtgaaaggctatgggagtcaaaattagggtggtgacatctgtgtggcaggcagcaggggacagatacaagagccattccagagatagaatacggcactataacctgttagaatagatatcaaatgtcaaggataactgggctttcgggtttggatgcctcctctcaggaattgcttcctctaagatgccttcctgattgctgtccatgcccatcaagtgggaggctctacccccagctttgctgtgcccttcatggacttctgctactgtatttaatatattgtactgcatctacttgtttctgtgtctttcccggtctgtggtttctctaggacaggttcacagctttgtcctttttgtatcttcagtgccattcttggacatgctgagtttgtttcactgtcagggactctggaaagatagatacagcgggcggtcgcaaatgtctggtaggccgatgctgaggagcgaggaggaacaagatacaagacagggagatcacatgcatagcaatgatacttcatgttgtaggattggatgatagctttgcagacgggggtgcagtataagggagagatcagaaaaggtgtgagggcagaattatggaaaaagcttatgtttgtagcatagtagaaagaagaaaaatctgtaaggaaaacagaggagtcagagagagagggcagagcagcgggttcactcatggccccaaat

SEQ ID NO: 109495 - DNA, 1655 bp, Homo sapiens
aaggtattcataggttccaaggactaggatgtggacctctttggggacctaccacactccccttctgatcctcataaatgttattgcctgagacagtccactgtttctttccagcccaattagttgtttatgcagtttctgtctttcctcttcgtaccacttttctctctgaagttcttgtttgtgattgtgtgttatttaacttttcgctcctaatacctagcactgtccttgggacatagtgaccccttaatagatctttgctgaataactgtgtggctgtagctgggttctggccgggggcacaaacgccggaagtctgaccagcctcaggatgtgcctccgccagcgtgtaaggcagcagccactagagggaaggcctgtgctttgcaatctggcactctgggttgggacttgcattggctgttacctgtctttgtgaccttgggtaagttacatcatttctttgtgcctcagtttcctcatctttgaaaggtaggataagaaatactacctgggactatatgagaagtaaattatatacttggaatgcagtatttatagtttgtagcgtatcactaagcaaaagtgaaacttctgtgctcttacatgggaaggaagaggtatcaggccatctgacagggaaagaagcagagccatgcaaagttgggagcacagttgtaaaaaggattatttaattttgtgttcctttcagccacaactggtagcacctctaaataaaaggcatatattttgctttgaggttttgcagatgattttatttaggtgcagaacttgtggattccagtcatctttctaggactttgggcaccctgaattgagcaagtcttttactcttcagagacccagctactgcaaaggtccaaatacttagtttcatttaaattttattaaaatggtatacaagtatactaggtatttatcttgggactggaacagttaggtgctatggggacttcactggtatagcctccaccatgacagagcaataagcctgatattattctgagtggcttaggaattagccagccatctcgagcctaatgtggtctgaccttctctggtggtggtgctagatgtagtctcccatagactggtgggctgtttattttcaggatataaataatgtaacctggaattgtggttctgcattgtttccatccgcgaatgtttagcttgttggaacaattgatttgtcggttccagaagcgagtaaactgacctgcgaggaacacttcccctgtaagaagcaatcccttgaaagataaacagtagtgcatctgggagcagataggcggctcttagcacttcaggaatcataaaaacagatgactgtgaaattcttagatttcagtatcctttttctttaaccttttcctttttcatttattttcctttgtggtggtgtttctcatgatgatcctttagaagtgaagccagtatttgtgtggtaatatttccttagtgtactctttaattagatcagtaggcctcccacatagttcaatccaaaggccagagcaaatttagaagctaccaatgtacaaggaaatatttttgaacatgaaagaaacaatttagtaactatgagaataaatggtgtttctgatccaagtactatcatttgcataata

SEQ ID NO: 109496 - DNA, 1030 bp, Homo sapiens
ccatatcagcctggtccttggttccagttttccacccattgggttctcctgggaatctgcaggacttcagcgggtattgttggaaaggtattagctttgaagaatgatttgacaccatgcaaggcttgaaaccagatcaaagtacctgtgggtatggcttcttccacataatgtagaaatcatacattcagctttttacttacgttaaaaaaaaattccctcgcatgacattattttactttatggaggacagaatgcaaattgcactggatttggatgaaagttggcattataaggacagatgttgcaagaaccatattttggataccaggactttgaaagagagcaccatataagatgtctttcattgtaattaaactagtttaccttggattaactgtgagccagttttatgccactactaataattctgaaaatgtaaaatggatttgaatacttttgtcccatgtttttcttcctcaggtttctaatattcaggcaagagcagttgtgttgtcctgggctccccctgttggactttcctgtggaccccacagtggtctttccttcccctacagttacgaggtggccttatcagacaaaggacgagatggaaaatacaagataatttacaggttgtgtatgtttctattgtttttctttgctgctaaactgtaaaattggagttgtgaaggaaaatggaaaacaaaggaaaaccttataggcttggcaaattttcctttagtttattttaagatttagtaataattataatgctaagaattcattgtgtccagagtaattcttatttggaaatgagtagcatagagctatttggtatgggtgtaatacatcacttggttatatttgctgtcagtagagtattaatgaaaactttctgttaatgtctgtcggcaaaaggcgattatgacttttagtttttgcatacattgggcgattataaggtgaccgcttatgttttagatccagacctttttgtagccctgttttttaaagttctacaatatgt

SEQ ID NO: 109497 - DNA, 1218 bp, Homo sapiens
gaatcactgatgcatactctgcttaaaacctggatgaatttcaggtctcaggcagaccagcaacttcaagaaagaattttcttattaggaggaaaacgtttcacattttctttctccctttcctcaattgtaaatcagaaacatactcttgttccattcagtcatgtacaaacttgaaagttctggatttagttcagttttcatttaaatgtccttagaacagattccctgatcaaagtgctccaggtgggggcacaaggacaggggaacattctctggctgccagtctgtccttgaatccacaaagacgctgaaagcactaaagatctgacatctttttgttcgtcagcaacagttattacttacacaggagataaggcaaaacaaaaacctaagtcagtgtacccaccctcaaggaattaagggactagtagtggggtaggatatcatcaaagaaactaccaaagaacagtttttttttgagttctcatcttagagatgggttctcatcttagagaactttgattttgtcagttgtttataactttaagtgcatcactatcctctcctccagattgagcctgcaagagcctaaaataacagtttaggacttagagcactcacctgagatccgagttttgggactcagagattgtgtgactctaaagagagaaggaagggaaggagagggagaagaatttcattattaatttaactaccatttactgggcccctgaggttttattactaaccataatagagcaataacaactgtttactgagtgcttcctataaaactgggtagtttagtaggtgatttacatattctcccaattatttatcatacctatctattcttggaacatgaaattagttgttgatattgatattaaacagctagcaccagaccacatgcgacaaacagccaaggtaggattcagatacatctcaggggaagctgagctgccttttgccaggggtaaggcactgtgctgtttgttaggctcttgctctttcctagggaagagtcggccctggcatgtttttgaagtgggagacacgatccgactcctcttcctggttgcttcccccaacttgtagttccactgtctctctagatctgtctaccctaatgctccaagagaccccactgcggcatcacctgtagctcttggaatcctgaaaagcattcttttctccagagttctttacttccct

SEQ ID NO: 109498 - DNA, 1028 bp, Homo sapiens
ccatgttggccaggatggtctccaactcctgacctcaggtgatcacccagctcagtttcccaaagtgctgggattacaggtgtgagccaccatgcccagccctgcttcttttcttgatgacatatcactatctagcagaggtgggagtttttctctagaagaagctatgggagaaggattgaggatatagagggctctaggttagggaagggcttttaggaaaaaaaaaactaggaacctctgggttgagtcattcataaatgtctgcccagtctgttttaatgttcctaaacagatcgtgatctggccttattcttgaaaacttgagtaaaggagtgaattttaatgggcaaataagaactttttattttagaaaaaattagttacataaagaaagtatttatgcaaagttggcttgttttaagttctgccttaagatattgttttaatttgaaccatacagaacactaactggtgctgctgcagctgtcagaacaaatacaggtcacctaagatcttgctatgaatatgtggcatggattcatattgatgatatatatcaatgatatgatgtttatctaaagaaacctgaattaatcgtctcagctttgtctctgtcttcatccattttgtgctgctgtaacagaatacctgagactggttactttataaagaacagagatgtatttcttacagttctgcaagctgggaagttcaaggtcaaggacttgtatctggcaagggccttcttgctgtgtcctcccataatagaagacaggagggcaagacagcgcaagcgtgagagagggaagggaaccaaactcgtctttttatcaggaacccactcctgtgataacaaactcactcctgtcaaaatggcaatgcatttgtgaggatagagcccttgtgacctaatcaccttttcaaggaaaaaaaaatgaccacctctcaacatgttgcattggggattaattttctttttctttttttcttttttttttttgagacagagtcttgctctgtcgccc

SEQ ID NO: 109499 - DNA, 1107 bp, Homo sapiens
ttgtttttgttttattctcaatgacttctaaaaattcatcaataagccttaattcttttaactgtcaaatatttgtattcttacctctacagactctacagacaatgcttccaaaactgaattccagggttttaacaactctggatctttctaggtgtccctaagtttatgcacatagtagtacatcctggaagttgttatgatagaaaattcggcatgctttgtctatatgggttgtagtttatatagcagttgttcctgattttaacaattggtcctgactccaagatttatgttttgtttgtttgtttttgagatggagtcttgttctgtcgcccaggctggagtgcactggcgccatttttacttctttcacaagtagaatttttttaaatgttagcaatataggaagatgtcttgaaggtcacacagttccccttctcctaattctttagtgagcgtgagtgctctggctctcttaaaagtcatttctccccttcgaaccctccccagtctttttctcgtttgagccacaaacagtctggtttctactgtattaaagcaaattaacctagtaagaaacactgactttttttttactggctacagttctaagcacaagaaaaggggaaaggagaccaaataaagaaataggaaaaatgaggcattaaaggggagccaacacggggtttggaagggatgagagcttccgccatggcaggatgggcctttcttgcactgcttactctgagttcagaaatagaggaggaaagaaggtagatcatgccacagcctgaaatggatacgacacataccagggctcccatagagtgtgatcggatgctgggtgtaattattcaagtgtatgcatttgaataaatcatcttcctcaacctcaacactcaaggttgaagtaagcatagtgtgtgacatgccagccacatagtgagttcactcaaggagcaactgagaaatgtcaggctttacttgctgcacacccccaactcggccaccaagttgcatctgaatgcaccttgaacccttgataaaatgaactttcaatcttaaagactgttagaactctcactcccttccattgggaaaggt

SEQ ID NO: 109500 - DNA, 1050 bp, Homo sapiens
ctcaggagttactgggaaaggctgtgtattttcagagccagtgacccctctgtggatgcagtagactcttggttgatcaggctgggcagtttgggccaatctaagtaaggaggaggatcttagaaattgtgatcgttaactggagcatcgtcttgtgcctgaaaggacctttttttattttattaaccaaaaaaaccacaggtacagtaaattacctgtctcaattacagaattttctgtagtgcctttatgttagagatgagatttcattgtagaatgctttatttgcaacatggacacttccctgtaagtttctattgtttttgttcattcaaactaggaaattaagcagttattcaagatgttcaagatgctccttcatttatttagggttatctgttgtttttttttttttaagtatatgcattgtttcattgtttacttttagggaaaaagaaatagtggtttcagacagtgcttcttcgggagccagaagcactgcaagttgacaaagctttgtccggcaatggggtacacattcaggctggccgctcgaaacgacattggtaccaggtatgacgtttccttgtcctcttgcccttcagcctttggatggtgatcctgagccttcttttacatagctggaaggcatgaggaagcctgctgcctccacactaaatcaactggaggttttccaagagggaatcctaatcagaggagagaaggcctcctttaagctggtgaatgtcactatggcctctgcagtcttgcaagctgtattgcgaaggccccactaggggtctctaagaaccaaggtgaaggtagcagtacagatcttgaaaggaattcctcttggagctttaattttttagatcacatgcctttttcttttatcactttagcaagctcttcattcacttgccttttttcaattatgtgagtgtttcctggtacaaagaaagagatgctgggccagccattgttgtcaagcccagggcagatacggaattggagaaaacctggactgtcttagaggcctctgcaggcctc

SEQ ID NO: 109501 - DNA, 1033 bp, Homo sapiens
aaagaaactatcttcagcttgggtttattcctgttgtattagaaattaaccatatatatcgctgtagtcaccttctgaggtccatttcagagagcttccccaactccccagcatctttgcatgttatgttgagaggtggttttttgtttcccccctccccgccgtcttttttctctcattttgacaaggacagtcatatattttgttagcctggcaagtttttactctgctccaaacctttgaagtatcaaatatgccaccattaaaatgggtggttcaggtggctgtgactctctcaaagtgtggtaagtctctagcaattcctggctctgagcagtgtggtcactgatggtaacatcaggattgccgtggatacccttgaataggtgaggtgatgggaacacactgagaaaacattacagaagcatttattttcaaaatggaaaataccggtaactagaagaaatacctagaatttgatcaccaacaattccaagtatatttttattcattaaaaattaaactgcagtgggcatctgacttagttttcttggatgtcctctgagaaatatgaaagcagattgccctgttttgtcaaaaatcagcatatttttatttcatgtcccaagaaagggaaaatattttgtcaaccaactaattattttacaattaaaaaaatgacagacatctactactcagggactgtatataggagaaaaacttacacacattgaattgaaagtgaaaatcattgggtaatatttgttaattagttgtgttgatgatgatgttagcctagcttttatttggttataagcttttgtatgcacacacattcacaaacacatacacgcatatatacatacgtgtgtgtgcgtgtgttttctttcagtatggtccctattctgatgtctcagaaattaccactgctgcagggcctcctggacaatgcaaagcaccttgtatttcttgtacacctgatggatgtgtcttagtgggttgggaggtaagtcaggcatattctgcatcaact

SEQ ID NO: 109502 - DNA, 1029 bp, Homo sapiens
gaatttagtttgcatttttctaatggctaatgatgtcaaacatgtttttgtgtccttatttgccatctgtattccctctttggtggagtgtctattctagtcttccgcccatttttaatggattatttccttaactgagttttgggaggtcattatacattctggttacaaatcatttgtcagatgtaatattggcacatacattcttccagtctctagttattttcattctcttagcagtgcaaaagtttcaaattttgatgaaatccagttttttatttttttcttttatgtaagatcatgcttttcatgtcatatccaaaaactctttacttaattctaggtagtagattttcttctgtgttttcttcttaaaagtttaatattctacatttagatctgtggtcccttttgagcaaagttttgtgtaaggtgtgaggttgaagctgaggtttattttcctcctattgatatccaattatttcaacaccatttgttgaaaagactgtcttttctccattggattgcttttgcacctttgtcaaaagtcaattggccccatttgtgtaggtctatttctggagtctctattctcttgtattgatctaggtgttcttctcttcactggtaccacactctcttgattactgtagctttatactaagtcctaaaatcaggtagtgtgattcttcaaactttattcttatttttaaattttgcattagctattttagttcctttgcctttccacatcactttatttttttaatgtataaagaaaagagatttgtttggcttataataaactgtaggctgtacaaaacctttggttctgtaggctgtacaaaaagtgtggtgccagcatatgcttctaatgagccctcaataaacctttaattattcagtcctcctaggcctctggaggagagggtccatgtctccaaggtttgtgaaatgccctttaagggcttttccccattatcctgaatattagtaccaggctcccttttaatcctgctaatctctcta

SEQ ID NO: 109503 - DNA, 1008 bp, Homo sapiens
ttttgccttaatttcccctactacaaaatgcaaataatgatagctgtcttcagtccttaattgttggggaaaaaaagattttagaaacattcttggccagatgcggtgactcatgcctgtaatcccaacactttggaaggccgaggcagatgcgtcacctgaggttaggagttcaagaccagcctggccaacatggcgaaaacccgtctctactaaaaatacaaaaattagcctggcatggtggcagatgcctatagtcccagctactcaggagcctgaggcaggaaaattgcttgaaactgggaggcagaggttgcagtgagccaagatcacgccactgtactccagcctgggcgacagagcaagactccatctcaaaaaaaagaaagtaacatttttgtttcttagaaaaggagcataacaatttagcctttgaaaccgagtagcttagtcaatcttaggctaaaatatccaggcacagacagaggtgagaggtggcaaatgaactatttgagatcttaattggaccagaaatagaaggcagattacagttttacctctcatttactaaaaacaaaaataacagaatggaattagatagcatttttttcaggttgaaacaaggccactaaaacattagtaggcaaatagaaatttggaaaactctgggaagagtatccttgaagatttcactgcatatacttgaaagcaaagtaggagagtgggagattgcaagcttttcaggtggtctttagaaattctagtcatcctttttttaaatataaataaatctccattttaatacattaatgtctaaagtataccgaaaaaaaagtttttttttgttttattcctttattctttgtaaagaatttccaccatcaataggtatagtgaaattttatctcttagaaaaggagcataaaaaaattccacccattaatgaaacagtattacaacctgatcactcacaagccaaaaaaggtccatatacagccagggacagag

SEQ ID NO: 109504 - DNA, 1750 bp, Homo sapiens
tcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagctagctttcttatgttttcctttaaattttcagatttaccttcattctgttttcactgatgtcttttgcaagcctttgatttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgtttgtaagtgctttgagatctttgaccaacaggtgctattggagtgcaaagtgttactcttacgtgtttattttgagtcatgagataatcaattttaacccaaagtcattggattatttatatgaagtccataatgttcgagtacctcagggacatttaagagttggaggtgcaaatatattccaaaagggtgcaacagacacagtgtatcc

SEQ ID NO: 109505 - DNA, 1131 bp, Homo sapiens
gctattttgtgcttgatctttattgtctaagatgcagtatcctgtactagcttataatattcccataccaaagtcatggggaaacaaacattattttgtttttggtttatttatactatattctgcatacagtactttaaatgccaattacagtgcaatctttatttattgtaaaattttttaagtgtacttatgtactaattttcccttgtagcatgttatatttttgtgttttatacttttgtaattttaggtcagtcttgttccttggcaacatctgtagtattattaatcttctgacattttcttatgtttttaaaaagataagagcatctagtgcattaaatgccaaaaaaaaaatacattatcagtgattgaaacgtttacatgtacccaaaaaccataatcatctcttggaagaaaatgctgagatcaatgaattattctgtgtgcctatattgacgtagtgagtactagagagttctgtattttattattgactataataattagtttaattagctttgcaaactgatggcatcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgctgctataaagaaattctctaattggttgaattttttttttaagtaaatagtactttaggccaaaatttatatgaatatttgatcttcttgagattttcatactatcatttaaccaccaggaagctgaagtgtgtgaagtacaaagctgacagcactttattttattgctctccattatttggtattcattatattccttcagtcagaaaattattactctctatggcactgttttttatcacaaatatgtatatgtgatattgatatataactatatatattgccatcacacacgaacaataaaataaagtgttctattaacctgatctctttgcccttttgctatgtgaggagtgaatgagtggcct

SEQ ID NO: 109506 - DNA, 1050 bp, Homo sapiens
aagatttcttgacctcagggctgtgagtctatcttgtgttggcatcaatgagactctggttcctgggccattccttttctatcttcaccatggcagccatcatgggaatcagcacggcagatggtggcgcacagattgaaatggggaaatggaagcattttcactttgttttctgggccttcatcaaccagcaagcgaatgttaagccctaaagccttaactggtttaaaactctctatcatgagcctgaaagatgtctgaatgccttgtttattcacggagtttgttttgtagtgagagatggttaagagcatccatcaggctagacggtggtgtgaaaatccatcctcagttctggttgcagaggagacaccatggcagttgccactacattggggatttctggctctttcctcatcaccttaaattcgggtgtcttttatgagtaatcaaaagcagcaaaagccaacgctatcaggcccagtattttaaaaccagaaaaagagatgaaaaagagaggtttgaccctactcagtttcaggactacgttattcaaggctgaactgaaactggtactgatttggaagcagtagctaagtttcttgatgcttttctggaacaaaacttgattaccgtcgatgtgcagaaacactctttgacattctggtgggtggtggaatgctggccccaggtggtacactggcagatgacatcatgcgtacagatgtctgcgtgtttgcagcccaagaagacctagagaccatgcaagcatttgctcaggtttttaacaagttaatcaggcactacaaataccttgagaaatgttgtgaagatgaagtaaaaaggctgctggtgttctgaaagggtttttcagactcggagaggaaaaaactggctatgttgactggtgttcttctggctaatggcatccattcttaatagcctttataatgagaatttggttaaagaaggggtttcaacagcttttgctggaaagctatttaaatcatgtataaatgaaaaagatatcaatgcagtaactgcaaggaa

SEQ ID NO: 109507 - DNA, 1067 bp, Homo sapiens
ttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcattttcccgtctcattttctgtttcccatttgaaaacagtgttctcttctcttctttctgtatgccaaattgccagccacaattctttcccaatcttctgcccagtggagtactccagctgtctttcctttagagaggtggttcagtggcctccttgatgacatttgtttcatgtctggatacagtatgtgttgc

SEQ ID NO: 109508 - DNA, 1043 bp, Homo sapiens
agccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactg

SEQ ID NO: 109509 - DNA, 1607 bp, Homo sapiens
cggcactgatttaagcttaaaagatttggtatcgtttaaaaaaaaaaaaaagctgggtggggccgaggagaatccacccaaactttcctcaggaagtaggatgtttactgagtaaatatgcggtagtcacagaaacacctgctactcctttaagacctcaggagccaccaccgccacctcctggccacatccgggcacttctctgcaaactcctggcgtcccgacgcccgagtcgttgggcttatttgaaacacacgcacaaccaatcaagcggcgcctgccgggacttggagagcgtcgaccaatcaccgcccctctggagactcctgcctatgggaaagaggttgacatcacgcgccaatcggcatggctcttagagagagcagcttagtttttgaatcggttgtggcggccgccggcgaggaatggcggtatttgtgagaggagtcggcgtttgaagaggtggaactcctagggcttttttgagagtggtaaggactctgtgtgagtgagagaggtgcaagtgggcgagcggctccagagccaagggctcttttgcctgcggtcgacgtccccgcccctagtgaccgcgaattccggagcgccccagctcaggcttcccggatccgggaactccctcgccgcaccccacccccagcagccgggccctgacgcggagtgggagaccgaagcccccagtattgctgggcatcttcgccctcacctgttggctcttttggacagaagagtgtgggtgaagggagggagttgggaaagggattttggcaagccgcgcagccctgtggctttgggggccggcacttgcagcctttgggggcttatctcagagtgcgccgtggttttattctaggattcatcctggcttctttgcgggaagtttaatttttcgtttttgcaagataaatccaggccatccgcccctcgtcctccccagccacccggcacagatgtgtccggcttagtggttaaaggcgcagcctctggatttagccgggctttgaatacctcttttaccccttactaacagtttgacttaggggaagttgcttaacctctctgttcctacgtttcttcatccatacattgaaaataataatagtacctgcctcttaggattactgcagagattaaaaggtttaggacaatgtctgccacgtattaagcgttaagtaaatgtcagttgttaatagtaatgttattgttaataacaccaccattatatcttggattgcattttagtccttcaccttggaagatgattgcctaaaaagtatttaagtaaaaggaaacttgaatgtttgtttacatggcaaattttatctctgggataaaagggggcatgtgttatagtgtgtttagttagaagctccttgggtctgttcttgggtgagaagctgtgtaggtttatgaacactgatcctattgtgcttattttaaaggcttctggaatacagtaatttgaaaaaaagtgattaatatatttccatttctaatctgactgttggatgttagttatgtcatcaagttaccgtagtgcatctctttttctctatacattttgaagctgttttggcaataaattgatc

SEQ ID NO: 109510 - DNA, 1556 bp, Homo sapiens
attcgcccacctcagcctcttgagtagctactataggcacctgccacccacacctggctaatttttaaattttttgtagagatggggtcttgctatgttgcccagtctggtgttgaagtcctgccctcaagtgatcctcctgccttggcctcccaaagtgctgggatttcagatgtgagcccccaacccaccctgatgaaaacttgttaaaccttttattccctgtctagcttttaaactcttcttaagtcctggaaaacttaaaaaaggattttctttcatagtccagagttatattggcactcacccatgcataattgttttgtcaaaccttttaggggagaggtgtttttaaagaattatgaaaatactgacaagggaccagcccaattataccggagaggtttagagacatccacagaggatgagtcaagagtgttggattgggggttggaagacaagataggtggagagtcgagcactaaatgcaaatagatgtgatgtaaattatgatttgtgcctgaaaaatagctgagaaattcattgttgctgttgcatagattgtatagggactggggtagttacagatggtgagggtgaatagttaggcggggaccaaattgtgaacttggtggtgaatttggacttggacatataaggagtactcatggaagttgttaagcagggaagtgatatggtcacatttgtatttaggtgcatattcctgaaaaccatgtggagagtgatttctaaggaaactgatggtaaagttgtgtggagctggtttattagaccaagtgaccattgtgtcattgaacgtatagagaaggggggccagattccagagatacttgaggtgggattgataggaattttggggagggaaatgtgggagaggaaaaaattaggatagatctcagatttttggctaggatttttgtgggaggtgtgttatggtggtgttataattgaatataggaagagaaattggttgagggcaaaggtgtggagaagggaggtagaataatatttatgactacagttgagtgtttgttgtatgtctagtaatgttctatgtgcttttgatacattgttatttttattatattcctgtgagtcaggtattagtatgtttattttacagaaaaagaaactgaggctcagagaaggtcagtgactttctttggttcattaaaaaaatgggtaataatactttttataaattctaggtaaaaagagcctctaatacttacttttgcccaatgaccatgtttatgtatttttattcaaattttattttttcagctgatttagaagaatacaaatcatggctgaaaatagtgtattaacatccactactgggaggactagcttggcagactcttccatttttgattctaaagttactgagatttccaaggaaaacttacttattggatctacttcatatgtagaaggtaaacctgttacctgctttaaaacaatcaatttctattttaattctaaacttattagtgactttcttaagatttaattttaataccaactgtaatgct

SEQ ID NO: 109511 - DNA, 1158 bp, Homo sapiens
ctaaaatgattatgctgattttcctttctgtaagtattaagtgctatagtattattttcctatttttctgaagatagttaatttgtacaataagaactttatgtatggtatcattttcttggtcagtagtggatatctttctaatgcatcttgatatcaaaatgcatgtacttaaaaactttagcattctaattttatggaacttatgcatacttgatgatttatgactaataagtaataagtcagaattatgcctttataatactgatctttaaaatttaagaacttaatttgaatggagatatgtatatgtaaaaatgtaagtacgtaaagaaatatggttgttcattaagtgtaatgctgattattgtgtgatagaaacttattttctacaaatataaacatgttaaagttgatattgaattgattgttaagccttatttagagagacagatggattatttgatatataaataatttttatttctgctaactatatgatgaaaaggacattaaagtgggctttgtaaagatggagtcagtggaagaatttgaaggtttggattctccggaatttgaaaatgtatttgtagtcacggactttcaggattctgtctttaatgacctctacaaggctgattgtagagttattggaccaccagttgtattaaattgttcacaaaaaggagaggtaagcatatacatttattatgacttttcaagttaaaatttttattaatgaattttaattagcaaaaaatttatttggaaaaatctcattgattgctgagagcaaaatatttagaataggaataatagtggctattctaatgtggtcctttaattcctccattttaaacttagtggtgaaaagctaaggcctttgaaagttaaataatgataactgtacatatgcatatacacagacaaatacatagtcctttttttttttttttttttgagacggagtcttgctctgtgcccaggctggagtgcagtggcacgatctcagctcactgcaagctccgcctcctgggttcacgccattctcctgcctcagcctccccagtagctgggactacaggtgcccgccaccatgctcagctactttgttgtatttttagtagagatggcgtttcaccatgttagccaggatgg

SEQ ID NO: 109512 - DNA, 1860 bp, Homo sapiens
ccagtaaatctttggattgggaaagttgaatggcaagaggggaaatgaaatatatttagcttgagaaagttgtgttgtattttctactaaagagaaagctcacatttaaaattgttgtatccttcagcctttgccattttcatgtcgcccgttgtattgtacaagtatgatgaatctagtactatgctttactggatttaggaaaaaagaagaactagtaagtattacgaaacaaattcaaagcgtattttttacagcaaaataaattaaaattggcttttttttctttttagtattatggttttatttttaaaatattgaaggataacttattatggctataccagattttaaattttctgaagaaacaaatcctgaagagccttataaagagaccagtgttttgtctaggctggctgatgtgaattaatagaaagatttcatagcaattctgtttgactgtcttgttaccatattggctacgttggttatttaaagtttttgtttatacattgcaatttcttattatgcaagttcagcctgaaagtattctgttgccctatagaattcatagaaagttccttttttatttttattttattttttttgagacaagtcttgctctgtcacccaggctggagtgcagtggcgcaatctcggctcactgcaaactccgcttcccaggttcacaccattctcttgcctcagcctcccgaggagctgggactacaggcgcccgccaccacgcctggctaatttttttttgtatttttagtagagatggggtttcaccgtgttagccaggatggtcttgatctcctgacctcgtgatccgcttgcctcggcctcccaaagtgctgggattacatgcgtgagccaccgcgcccggccagaaagttctttctttggttcacaatactttgttgttggaactgatgggtattactctgattttgtgggaacagtcttgatgtgataaaacttggtatttttttaaaaaaaccaatatatttacacagtatggtattaaaaagcaatatatttaggccataggaaaggcggttgtttaacttacatttgtgtgaaatctttactaatcccacctctataattttgcctgtgttaataggcaaactaatcttttttatacttactttgacataaaatttaatagctttataaaaatcccgtatgtattttataaatagaaagtatttagcaaatgctaaatgtggggtaaacatagtttaaaattttgttcaaattaaccataaagtcagtgttgcttaatttttcttttgaggtcaggttggtgacattggtccatcacatgggtggagttattcgaaaagactttaattcaaaagttacacatttggtggcaaattgtacacaaggagaaaaattcagggtatgtaaacttgggtatttttgtgtatttcaatacagcattattttggcatgggtttaataatagcagtcttttatctatttctttcacaattaaagaagagaaactcaatttttgctatgaatatatttagtaaaaaattttaaatcataagagtggttaaattttctttcttttcttttcttttctttttttttaaatagagatggggtgttgctctgttacccaggctgctttcgaactcctgggcttaagtgatcctcctgccttggcctcccaaagtgttgagattacatacgtgagccaccaggcctggccgagtggttaagttttaagtaggcaatggaacttgagtgaggtgttgaaagatgactaggatcgtgggggttggtagatgaataacattgtaggaattgtgaaagtagggaatttactcttgtctaagtgcc

SEQ ID NO: 109513 - DNA, 1133 bp, Homo sapiens
atagagacagggtttcaccatattggccagggtggtctcaaactcccgacctcaggtgatctgcctgcctcggactcccaaagtggtgggattacaggcatgagccactgtgcctggctgtctaagtgcccttcataagaacagagctctgctcttataaagtggttctaagatttaacttgtgaatattataataggagaaaatactctcactaggattgaatcttagtttaagattatagttgaatgtcttagcaagagtttatcattttttcttagtctcccttagtgtatttgtgtagcaaatggtaattttagtgtactcttcaatttaccctaaatatttcaactcatatctaaggttttagtgacttagtcggatgtcttcttctgtagtgccatcttgagggtcatactttcaaggaagtaaacgtgaagaaaggagaaatagaaatttaataaagatgaacttcagagatatatttatttaaaataaggaaacagttcggacaccatggaacttgttttgaagttattttaccctaacttgtatgattggaagatagtttgtctgttaatttttaaattattttgttacaaagcagatagtgatctaaaactgcaaaaaattaagtatgttaactgtttagaacttccttgaatgcagttatttaaggagaaaattcactgtaatgtttatatttttaggttgctgtgagtctaggtactccaattatgaagccagaatggatttataaagcttgggaaaggcggaatgaacagtaagtgtttagaaactcagtagttcattatgtaaattaaacattctggtttaaagataaatccatgtgctgaaaaaagtaatttcatagatataaaaactgaattcagtctgagtagcttgaggaataaaatctagggagaacaagttataaaaaattataaaaaattaaaaattgaaagatatctttgatatctttggattttaccttgtgaagtaattttggctattataaacattctgaaattattagataatagctaaataattctgtgtatttggattttgttacatatttttaaaattttgtgttatctggttacattttaattggtgcttgaaatttattgcc

SEQ ID NO: 109514 - DNA, 1074 bp, Homo sapiens
aaagcttatctgtgatcacattttgtcagaagttacttttgggatgacaggacacatcatttttttaaactgaagtttttgtgagcatttcaggaccaaatattaaatagtttcaatagatagattatgccaagaccttgaaaattactgtaggtttgtaaattgatatacctaacacttgaatttaagttaaactggttttggaagagtgtattttgtttttagggatttctatgcagcagttgatgactttagaaatgaatttaaagttcctccatttcaagattgtattttaagtttcctgggattttcagatgaagagaaaaccaatatggaagaaatgactgaaatgcaaggtaaaatttagcataatgtaaaagttatatctattttagtccctaggcctgcttaatcacttcctggtcaatatacctcttaaaaaatttgagtttggaaataagtagcttggcttatttatgcttatgtgcattcctttttaggaggtaaatatttaccgcttggagatgaaagatgcactcaccttgtagttgaagagaatatagtaaaagatcttccctttgaaccttcaaagaaactttatgttgtcaagcaagaggcaagtaattctagaatgaggttggtttttaaaaacactattaatagcttctctgataaaataaatgtaaactgtttattaaaatgttttttctctcacctagtggttctggggaagcattcaaatggatgcccgagctggagaaactatgtatttatatgaaaaggtatgcttttaaccccttacttatttgttctgtgagcttgattgtttgaaaataacacttttctgtccagaaggtttagaagcatgtttaggaatttcagaatgattaaaacaattgggatatcaagttatcttagtctatgtagatttaagtggaactattcaatgtaatgtgtattattttaacctaatatatgttgttctgtgcgaattcttggtgataacattacgaacaagaacatctctatcttcagaaacttagacttttaatggaaagatagatttgtacgtag

SEQ ID NO: 109515 - DNA, 1060 bp, Homo sapiens
atattagatatgtctggaggcagcagattgcttgttgctttcatccttagtaacttgaatacaaaagtagaaattactcttgtatcatactaacaattttaatgattgattgcagaactgtgtgaagttttatttgcttctaatgacatttcatgacgagcatatgtatatacatatacacaggtatataaatggagtacataaaatagaatagaaaatatggggaaaatgtctcaaatttagggagagtattttttattattacttccttctctattaatatcttgtgtctcctttatcactgtctatcttttagctcttttctttttcccacaatctacttaaactagtcttttttctcatttagttatttcaagtaccattggaagaggaaggacaacgtggtggacctatccttgcaccagaggagattaagactatttttggtagcatcccagatatctttgatgtacacactaagataaaggtaaatttgtatatgttagattggtagtaatttttttcagattgtacatatttattatgatctttgaggtacttctggttagctaaataagttttgtacctaaaacttcttattcccttattagttcctttgaatcatttgtctctttgttccagtgcctcataatgtttgttgtttgcttttgttttgttttttgagacagtctcactctgtcacccaggttttagtgcattgatgtgatctgggctcacagtaacctctgccacctgggctcaagcaattctcccgctgcctaagtcctgagtagctgggaccccaggcatgtgccaccatcccagctaatttttgtattttttttgtagagatgggttttgtcatgctgcccaggctggtttcgaactcctgacctcaagtggtccacccgtctcggcctcccaaagtgtggggatcttaggtatgagacaccatgccctgcctttttttttcgagatggagaatactctctcacccaggctagcgtgcagtggcctgatcatgacttactgcaaccttgacctcctgggctcaagtgat

SEQ ID NO: 109516 - DNA, 1050 bp, Homo sapiens
ttccatagtgtatatgtaccacattttctttatcaagtctatcattgatgggcgcttaggttgactccatgtcttgctattgtgaatattgctgaattctaccagatgtacaaagtttttatttttctcccttcttagttgataacactttttgctgtcatgtctgtttctatttaaaggcttctaatgaactgcctcttactaggataagaaccacacaacttaagttttataaattcattttggcaaggttctgtgaatagaatttagaagtttctttgaatctctttaaataggatttgtaagtttcagtgccttgagtactggcatttatacttttattttttgaggtttctaacttctttccttacaaaataatctcttaggtgttttttcagtttggttgagaattaaaaatttacaaattattttctcatttttttgataaccttttaattttctcagtcagccaacattgttttccttttcttgtttgcatttttgggtaatttaactgatcttttaatggcggtttggatttttgaataaataccatgcttttggaatctacatagatcagctgtaattgatattttttaaagtcatagacattttctttgtcatgtttgtatcaatacaatcagctttaacatatcttttgttttttttctgagtcttcctgttttagactatgtataccaattgatgtattttgtttagcaattaactctttactgagaaatttataaaataagtttgttctcaaacatagaaatttactttaaacttttgcatccactatgtcagattgtgactactaattatttgactttaagttacattgtctctaagggtgacaaatgcataataaataatgtttttttcccttttcttcctagtcaaaagatttggtaaaaacctaccctccctttgtaaacttctttgaaatgagcaaggaaacaattattaaatgtgaaaaacagaaaccaagatttcatgcttttctcaaggtaatgtgtgtttctttcaaataaaaatttgagaattatt

SEQ ID NO: 109517 - DNA, 2607 bp, Homo sapiens
gtgaataatgtagacttaagaaaaatttaaggtgggatatataggagtgtgtagaggaactcactttttatgtaagatgttaaccactggctggccaagaggacatttcaggccctgaaaaattattcagccaagtaatcagccacggagaaattccacttcttctctattagtttgtatcacagacactaatgataaggtgtactccagtaaaagtagggcatataatcttttcagaaaaccttttttgaaattgttgaataaattgttttcagataaaccaagcaaaaccagaatgtggacggcagagccttgttgaacttcttatccgaccagtacagaggttacccagtgttgcattacttttaaatggtacttgtctgatctgtttcaaactacatcagatattttaatggaattgttttttccaaaaaagatgaatttcttctcatttttagagtttcttagatttcagcattaaagtttatatatgttttgctttatggattatcttaaaaaatagttactggtgctactaaaattcagcctggcctgaaatattttatttgttgattagtagtatatattttgtcttttcatttaaaatttttcttaatatttcatggtgtgtcactaattcaaaatcattttatatccaagtacatacaaaatttgcccacaaaatcacaaggagaagataatttgtatgtcccgacttttttgtagcccttttttgaattttagtaaagttctatatacttggctttatgcttactgtttttgaccttagattgttcagaatactcttgaaacatatctatttattctagaactgaactataggtatcaatagagttttacagcagataatttttatgaataaattttgcctgtggtaaaaaatgtgtatgtatattttgttacatttagctggctaaggacagtatcagtttttattttattcttaattaagtatgaaaacaaaattatagccggtaatcccagcactttggaagaccgagggtaagcccaggagttggagaccagcctgggcaacattcagggaccctgtctctaaaaataattaaaaaaaaaaaaagaaggataactaaattataaacaggaaaaagtctataataaaagatataattcctaagctaaatctacactaatatatacagcagacaaggaggcaaattttgtgactgtttaatctgttattttctgtaaaaatcttggttagtatatgaattatagtactaactaaaaatctgacaatttttttgttttttagagttatctaatacagttgagaattactggcttataaaatgatttgtccactatttaaaactgttctgttttgcaaattataaggagaatatatgaacaaactttaggtttccaaaacattgtggttttcttctgatttgcataccttcattattgtttaagtacttgtagaaattcgtaaatgttacaaataaaatgatttctaggctttattactattattccacatgagagattaggtggacagtggtactagattaaacctagatttgataagaatatgccaaggatggcatagggaacacaaataacctggattagaagagtcaacgtgttaagtataaatctctaaggtaacaaaatctgtgcttaaagataccagatgctctctgtgatgtagccatgggccccagtatgaaatacaaaatacattatgatttctgagcttattgaggatcatgtgttttcatttagcactatggagagactttgaggaatttaggagtccccaagcattacttgaagggattggaatagcagtgtaagaaaatcaggattacatattctgaaaatttagtcagtaaaaatggaaaccttaacagatgtgtaataagagagctttttagggaacagtgcttaaaactttttaaaaaataaggattgaatattatctttaaaaattagctgtatcaagatggacagcattttagtcttagatgagaaatcactgaattttttatgcatggaaaaaacattgtattattacagatcttaagaagcatacagctgatgaaaatccagacaaaagcactttagaaaaagctattggatcactgaaggaagtaatgacgtaagtgcattattttcaatttttgattgtgccttagatttcgaatggaattgatagaaaactagaatcataaataggaaaatatcaatagcaaatttttgtaaaatgtctagattatttttctaatagtgtagttacacattaaaatgaagtattgtaagaatacattcattaatcaaaacatttatttctaagctattaaactattgtgcacagagaataatagtttagaaacttgaaaatgttacaaattccctaataggcattttcttcatataactctagtcatagcttgtttctgtcttcatattaatgtgtattgcccaaatgtaacttgagaatgtgaccacagtgaaacgaaaaggtttataatactttttcactttaatttttaaactttttgttttctacctagagttctgtggaattaaattggcgggattggttggaaatgtattaaaagt

SEQ ID NO: 109518 - DNA, 1226 bp, Homo sapiens
tacaggtttagtgtattttagaaagtgcatagggagtatagtaaagaatatagaaaggaataatagtaaaacatacttttctgaaggagtctatggatgttttgtttttgtttttgtttttgtttttgttttttttgagatggagtttcactcttgttgcctagactggagtggaatggtgtgatcttgactcactgcaacctcctcctcctgggttcaagtgattctcctgcctcagccgccgagtagctgggattacaggtgcctgccaccatacccagctaatttttgtatttttagtagaaacagagtttcaccatgttggtcaggctggtctcgaactcctgacttcagtgatccacccaccttggcctcccaaagtgctgggattacaggcgcaagtcaccgcacctggccggaagttgcttgtttgttttcctcatcctgggctccataggcatggaaacctttttaatgtaatgggatacttttaaggaatattttaactgattcacttatcaaaataagacattcacatcaaacacaacttgtgacatgagttgtgtttgttgtagttttcatgttctattttaaaagttttaaaaataactatttttcaggcatattaatgaggataagagaaaaacagaagctcaaaagcaaatttttgatgttgtttatgaagtagatggatgcccagtaagtattcttctttaacaattattaatttattttcttcttgttaatgaggtttctgtggttttaatataaataatatcttggcactactttcttttaaattacaacttcttaaaaattacttgataccaagtgatctcttttgttatattttcaacctatacaggctaatcttttatcttctcaccgaagcttagtacagcgggttgaaacaatttctctaggtgagcacccctgtgacagaggagaacaagtaactctcttcctcttcaatgattgcctagaggtaaagatgtacttcacatagtataataacactactgatttttgtaagttccctgaatatttaaaaccaagctttaattgaagagtaatgtagaattttaaataaactcaagtaatctttttttaaaaaaatcgaggacaatttatgatttaatactgttaatagaatgcttttagaggaaggtctaataagaagtgtaagttttcatgacttcaaatctaagttaaaatgaaaatttatt

SEQ ID NO: 109519 - DNA, 2801 bp, Homo sapiens
tttcttttctttttcttttctttctctttctctgtttctgtttctgtttcttttcgtttttcttttttttttcgacagggtcttactctcattgcccagcttggagtgcagtggcaagatcacagctcactgcagccttgacttcctgggctctggtgattttcttatcccaacatcgcaagtagctgagactatagacactcgccaccacaccagtctaattatttttagtagagactggttttgcatgttgcgcaggctggtctcaaactcctggactcaaacaatttacccacctcagcctcccaaagtgttgagattaccattgggattacaggcgtgagccactgcacctgcctcctttttctttaaagtcttatatgctttccttttgtcctttcctacttctatcaaagtattgccttcttatatatcatatacattattatttatagtatagaatacaagggaatcttaaagagcggttcatgtgcagaacagttacaggtataataaaatctcaccagaaattcacttgtgttaaatgcagagttttgttgttatgaggctaaatgaaaaatacttttttttggtcaatcatgttgcaaaaagcacaaaagtaaagacagtcaaactactgtacacaattgactgtctcctgaagtgagaaagtcaaaaaatcatgagacagataattctcaactacctgtttccctcataaaaaggactttagcctgccctgattgagaacagatgctaggcagagtcaattttcaattatattttatctggattcgcatcatcatggggttttactgtatatagtttctctgtactttatttgtttgtttccattaaagcttttataggtttttcctgttggagtccctaggtcagcttgctccattcatctaataggttagattatctttatttctttgctaatccattctggtttttatcccttattcctgagagctatggcttactttaaatttttgatcttatatcccctccagattcctcgcagtcttctgtaattggttcattgacttgccattcactttaatttctggtattggtctcctgtagctcccaagtccctggcttctcattttccctaccttcttgaatctattgattttttttttgttctatcccttttagcctccctgtcttagaatcacttcaacaaaaactgctttatttataacattaaatttggacttcagaattcataataaatataaaataaaaacttataatcttaaataaacttattctttagcttgtttgtttaggaaaaataaacaaaactcttagtaaattggcaatggaaattatggtacattcttaacctgataaaaacctatagccatcatcctatttaataataaatggtagaaacattcaaaatgggtaaaatctatgttttcttaatgacagattatgttatactgaaactaatttgggatttaaggatatatttaacttttaaatgttttatctgtattttaagggttttttttaaactctgtactagcatttgtcatcaaattaacacttgttattgtttttcctttctaaaaattaagcttaaaatcatttaattgttttgcttagccaactgttcctcttctcctgaattctaggagtttcatttaagattctgtcattccttgatcctgtcgcttctcatcatgcttctagttctttcatacctctgggaccttttgcaaaatatcccttggccttttttcctgacttttgaactcttcttatataaacatgaacatttctgctatacaattacatgtttgacttttgttacatagtaactctgcttataacaactttgtaacgaataataactaaataagttatatatagatttatgtgattagtgctattttattttttaagtatttggtcctttttcttcattttattgactgatacttttttattttctataatcagatagcaagaaaacggcacaaggttattggcacttttaggagtcctcatggccaaacccgacccccagcttctcttaagcatattcacctaatgcctctttctcagattaagaaggtattggacataagagagacagaaggtatgccggtcggatacattcttggttatataaaaatagtttatattcattgtaggtttaatttactccattttggcttttttaaattggtaaattatctttaaatatagttggtcagactgctaaagtaattgttcttgcacctctatcccatctccatctctaggaacagaactgactttttgttttctcaaatgaaagtactatctcaacctataggataccctcatctgttaaaggtcaaagagcttttaaatggctatgtattaaaatagcaccctagcctagcctattgccacaccaaaatttatttttttggttccttcagaatacaaaataaccagtctgttacctgcacccctcatcttaacactttcactgttggccaacagttgcatttttagggctatgtttaaggtacgggtcaggaatagatgtgggtgcaataaataaactcagagtaactggtagacttgatatggagtcatatgtgtattaaggaatgttttactctaaactttggtagtgttacagagcaggttctctgaaggcctgaaattgctgaaaatttatacctacctacaacagtgtcatctgtttaattgacacccagtggtgtatgtgcatggccatattttggatgttaggcatatgtttttacaatatttagctctttccatta

SEQ ID NO: 109520 - DNA, 1916 bp, Homo sapiens
taatcgactttctccccatggatgtcatgtcccatattttgttatttcagaatctaaggattaaagtttaaatctattgaagatcttatgtctcagaatccttatgtatgtatttttggtctcttgccaacatgtaacctttaattgcatggtctgtactctaacattcatatattgcctaagataagctggtagctttgtggaggccattatgatttctgacctctaatgtcagaagtataattttattaataagtaaatttaagcaacgataacctttcccgaagtttggttagtttaaaagtaacttgataattaaatgccatgtgctacaatttagtacttttgccgctacctttatatttcttttgaaatttttcaaaacttttcaaaacttatcctacaatggttaaataaatcaccattggctacttaagagttgcaatcttcattctgagtttttaaacttgtaagtagaatttctaactgcatgagaaatagaccaacgattggacatatattaaaagtttgtgcttgtatgccaataatatttataatgaagttagtatgatttgtatttaaaactataattattcttccatttattaggcatacctagtaagttgttagtataaatgtctgttattgataccactttaatttggccaaatcagaagctctaagttatagagtttgaggaaaacactgaggcacaggctaaagggaggggacacgtgatagtagataggatctgggggtttgaagactagggtaagaggagagcttagggaaaggggagaagtgtctcataactcacgagtaaacaggttaattggcttaagatgtcaaatgctagaaaatttcctgggaattaacacccatgaataggatttcaaaatctatagctgaggctcagtttctcctgaaattaatattatatatctcagtgggaaagattgactactactttttaatcttgaactcagcaggtctgtcttcaggtacatgtgaatttggagttgattgaaaaactcctgcccttccaaagcttctttaatgcttgacatactttgaataagtcagaaaatgtttttggaattatagtaagtatctattaaaaatgtgtgttctcaagtccagcagaacttaaaagtaaataaaaataaaaatgagttttggctaatctatcaattttacttttattttattttattttttcgtccttgtcctggtacatattatattttagaaatttagggaaatagactaaaaagcagaaagttttttgtcttcgttgtttgtttttaaagagagaatgagaattattgagaaagaatgaataacaaataaacctaggactactgaagataagtttccccgactttgcacttttgcctgtgatttaccctatctaccttcctctgtgcggagagcactaaaggaagtacttcatatttgtatcttagcaaaaataatatattttattatattcttagccactagtgaactagcaatatgttcaccctttcagtcattctgaactcagaatcttctagaaaggtaaaaaatcttgtatctatctttccctcccctaagtcagaagcagtttgttagttcattgagagaaagcatgaagcccctggttccatttttagttcattgatggttattaatacttagtcatagttaagataacaatagaaaaaaatgagaagctcctttattagcatttgctaaggatttaaatttcaggggccttcattaaaagagcatttcagcaaaattaaacacacttggagtttagtttcattacatataaaaatggatacattttacatcaaagagtaacttaccaatgtttagtttaatagtcatgctatgatttttactgtctattaaattgaaggataatattt

SEQ ID NO: 109521 - DNA, 1034 bp, Homo sapiens
aaattttgcacccaatttctgttcattgtcaccctaccggctcttgatcacaggtttagaacctctgatttagaatccttacaaatgctgattgaggacaaaagggtaaagtaggagaaagtctaaatcttaatttgagtttatgtcaagaacagtgtttgtggtattggttttgtagccaactttatacttcagcattaagtttaagtctgctaaatttctaacttgtttcagagttgttagattttattttgaggtctatttccaattgctttggtatccatgacccttacaacaaattacacatttactgaatgcttatttttcactatccttaagtcagtacatttcagggtagaagttatatcaagcacatgaaaagtcttgagtagcttcatttataaatactcccatatataaatatgcttaaaagtttgatttttagaaacagttgtgtgtttttaagataacaaaaagtattatttttcaataggagaatcttatttatactgctgatccagaatcctttgaagtaaatacaaaagatatggacagtacattgagtagagcatcaagagcaataaaaaagacttcaaaaaaggtgagttttagtgaaagtattatttagcacatctctaacatattttccagactatattcaaataatattgctgcaaacaccagtataaagatagtttataaaacaaagctgttcttcggttctaggaaatgacccacagaaacaatagttttacttcagtgacttccttgccacagtaactataacttgttatccctcccgttactgtaataatgatgcttctgtgaactatcctgcagtagaaatgtactgttggtgttttagatttaaatatgtgtgcactcatcttaaatatatcgccacagttattttcagcaaagggcacacggtagtcaggggacctgactatctattcctgactctagaagtctattttagtcttctcgtgatgaagataacttacttaccttatcagagttgttgaggattacat

SEQ ID NO: 109522 - DNA, 1647 bp, Homo sapiens
ggggctttgtattttaataatttttgtatctcctatcatttaacatttatgatgtataagagaaaaacatgttagattattattcaagtgaattccttcactctttcaataaagaaatggaggttgaggggatttttggattagaaatctcacaactagactggctgaatcagagaagaacttaggtctcttctctcccaggctagatttcttttctcctcctccttccattggactgcagtgctctctaaatgaaagtttaaatagtctacaaatttcctcactgttttgtgccaaagagattctaatcctgccacatagtacagtagaaaaacttttgccatatatttggcttttttatgtttaaatattctcatcagctgtattgaatttgtctaggtttaactaattgtaacttaaactctaggttacaagagcattctctttctccaaaactccaaaaagagctcttcgaagggctcttatgacatcccacggctcagtggagggaagaagtccttccagcaatgataagcatgtaatgagtcgtctttctagcacatcatcattagcagtaagttattttgatttaatggggtaaatgacttatttatgaagttgttatggaatttgttaacttctaaaaattggaaatatttcttccattttaaaaaaattttaataattttatttaacccagtatgctaaaatattatcatttgaatgcgaatcaatgtaaaattatcagtgagatattttcattctttcttatgtactaagtcttaaaaatgtggggtgcaccttatacttacaaagctggctgcatttcagactggctgtgtttcaggggtttcatagccacaagtggctagtggctcctggaaggacagcacagctctgtacactagcactgaagaatcagcatggaaagcatgatgctaggggagaggagttctcccctagtgcactttaaaccttggcatcctatcatacgtcattttttaaatatttatatccaaacctctaacctctttattgggtaaaggcaactgagaaaaccctactatgaatgaactagagacatacttaatgtgtagtttatttgataggaaattttactgggattgaaatatgttctaaaatctctgagaaaagaaacgcgtttcaatctggcctgtcactttactaatgtaaatagctatgattctgtttatacagatcggttccaatgacatagcagagaccgagttttattccttttactatttttgtgatgagtagaatataatctctgaaactgtatttcagaggatgatacgagttctaaattcatgtatattgtatatatatgtatgtatatttaaagtgtttcctgaacaatccaaatttccaacagtttcagaattattattagatatttaatactactattactaagtatttgagtgaaatatctgttctttataaaattattaacctactgaagttaagaaaagcaagtgactgtcatttcttagctgtgtgtcctgtagcaagtttcttattctctcaactgcatttttgcagatgatgttatatactgaggggcaatttgggtggtgattaagagcatggactctggaaccctagtgttcaaatccttgctct

SEQ ID NO: 109523 - DNA, 1063 bp, Homo sapiens
atgcagataaacattaatttgtgaaaattagattatagctttctcgaagccacctgtagcaactattgtaaacattttcatctttcaaatgaaaataaatgaattttatagaaaattttagaaaattaatttatttatggttatgtcacttttaatagacagcatatgtaagaagcagctaaaataccttcaagacattaatgtcatcttctcaattgcttgtttctgttctaacagattacccattctgtttccacaagcaatgtaattggatttactaagcatgtttatgttcagcgcctaaactctactggtgggcgctctcagtactcctggtttcaatctgtacgtcattctgctttccgagctagtttttcagagatactagaaggaaatactgatttttcaaatttcaaaaaagttctttccaagtcatctttgacatttgtgaagaattaggagatttgccaaccactaatggaaacaagcctcatgaagtttaatgtgagcttattagctatttaaaatttgtatttgcgggaaaaaaaaaaggaacatattttttctccaaggaatcacttatttggtgggtgggaactttggaattcacaatgttatgactgctttgaattaataacaatttaggtttaatagagtttcttaagtccagaaaaaataagttccattagaaattttcttatttaggaaaattatcattttaaagaatagtaattgtcatgagtagtggatttatattccaaatctgattcttaatgttagatttatagcatttatagaaaattatgcttttaatatgccaaatcataaaagttccatgtgaggaaagtgtaaacttttatattatacattcatatcatcattttgttgatacttgaatggttatacttcatcaacccagctttttaaatgcttcattttacaaccttgttgatgagaacttaagccaattaccttactagctcttacagttagccatttatatatgttaaaacagtagccttataatttattttgatttacagttattcttgagtctttgcat

SEQ ID NO: 109524 - DNA, 2191 bp, Homo sapiens
cgaactcttggccttaagcaatcctcccacatcagcctcctgagtagctgagattacagtggaacaaaattatatatacatatatacactctgacactcacatatgtacatctgagttgtacatatattacaaacactctttgagagtgtatgacttaattttagaaaattatttcccatgaagtgatttcattccttttaattctgctttatgaactaagaagaaaccttgtttgccaatttataattttttcttttataacctgaaacactgaatcattaatatttcataaaacaaagttaggtatcactactagcaataggccaatatctgttcagttgagttaatatctagttaactagtctagctatttggctttgttctcagaatgctataatagttttcttttttctcccttttccattcccctaactttaaagagtttagaattgtcagatgtcttgtacttaattgttacagtaatttgtaaaatgtaaaaataataggcatgatactgaactgtattttacaatttttttaaaggaaaatttaaaatatgaaatgtttgttttgtcttaacagggtatcccttctccctcccttgtcagccttccttccttctttgaaaggagaagtcatacgttaagtagatctacaactcatttgatatgaagcgttaccaaaatcttaaattatagaaatgtatagacacctcatactcaaataagaaactgacttaaatggtacttgtaattagcacttggtgaaagctggaaggaagataaataacactaaactatgctatttgatttttcttcttgaaagagtaaggtttacctgttacattttcaagttaattcatgtaaaaaatgatagtgattttgatgtaatttatctcttgtttgaatctgtcattcaaaggccaataatttaagttgctatcagctgatattagtagctttgcaaccctgatagagtaaataaattttatgggcgggtgccaaatactgctgtgaatctatttgtatagtatccatgaatgaatttatggaaatagatatttgtgcagctcaatttatgcagagattaaatgacatcataatactggatgaaaacttgcatagaattctgattaaatagtgggtctgtttcacatgtgcagtttgaagtatttaaataaccactcctttcacagtttattttcttctcaagcgttttcaagatctagcatgtggattttaaaagatttgccctcattaacaagaataacatttaaaggagattgtttcaaaatatttttgcaaattgagataaggacagaaagattgagaaacattgtatattttgcaaaaacaagatgtttgtagctgtttcagagagagtacggtatatttatggtaattttatccactagcaaatcttgatttagtttgatagtgtgtggaattttattttgaaggataagaccatgggaaaattgtggtaaagactgtttgtacccttcatgaaataattctgaagttgccatcagttttactaatcttctgtgaaatgcatagatatgcgcatgttcaactttttattgtggtcttataattaaatgtaaaattgaaaattcatttgctgtttcaaagtgtgatatctttcacaatagcctttttatagtcagtaattcagaataatcaagttcatatggataaatgcatttttatttcctatttctttagggagtgctacaaatgtttgtcacttaaatttcaagtttctgttttaatagttaactgactatagattgttttctatgccatgtatgtgccacttctgagagtagtaaatgactctttgctacattttaaaagcaattgtattagtaagaactttgtaaataaatacctaaaacccaagtgtattttatgtctcatgtattaatttcttcaaggaaattttcataggcaaatatgaatgcttgcatcaacatatgctcttttgtgtacttgcttgcttacttgtttattccttcctccagtaatatttttgatcattttattttacgaggctatctgtaagttaggaatttttaatctggaatctactttgagaaatgtagatagtgaatcctataatgttttatgcaaaattttgtgtttatgtgcatatatgcatttttctggcagaaaatacacaattgtt

SEQ ID NO: 109525 - DNA, 1030 bp, Homo sapiens
cgcctcctgcctcggcctcccaaagtgctaggattacaggcgtgagctgctgtgcctggctattttgtttctgtatggctttctgtgaatggtatccctatccactccaccacctgagtcagatacctgagaattctcctaggcataggcttatctttcttccttattcctcatagccaaggtgttgatcccacgtccttgagatcttgtgaatgaataatccattcccttgtctccattttcattaccatgccttatttcatgtacacatgactttctcctggatttatctggtaatcttcattcttaaactaggttccataaaggcagaatctggaacaaagacttgtgttaggtttatttagaggttgtttatcatgaggagttgaagtgaagaaacagagaaggaaggaatgccaacacggttttgctatatcgggttagccactaccacaacccactgttgctgagtcctgtgggaacttttcatctggggtgtgaaagggagaagcattgatcactcagcttccagcccagttgctcaagaacggtccaataatagtaagtccctggcaattccagattgtacttgcatgaatgcccagaggtattgatactccaaagcctcagaaattcctgggacaggagtgagaagtggtggcacatcctccagcagtggctccagtaggaagaggtggggctgagagggtttaaagtggcccataagacatgtctggttcacctttcaactgatcttcctgtactccttctgctagccactttttatagccagaataatcttaaaacaaaatgactatattatttttctgcttgaagtgttttgatgtcccttttagagaccttcagaaaaatattctctccttagcacatcatagaagccctccctttattatctggccctcttctacctccctaaaagtatgacttctccatataaacccttcccagctctttatctgtgctgtaccctctacctagagttaccttcctctccttttgtgcttgccta

SEQ ID NO: 109526 - DNA, 1049 bp, Homo sapiens
ccttccctccctccctccttcctttccttccttccttccttccttccttccttccttccttccttccttcgttctttccttccttccctcctttctgaattctgggtccttgccttctcgtttggtttcatctttcaataggcttccatcttctttccatctcttagaaatgtgtttaaacctcttgcctactgatgtatcccccttctgtccacttctaccggattatttcttcacactttcttggaattattagataatcatttgtgcttaaactgcagtttgaattagaaaccctatttggtccacatcctaaatagtcaaagtgatatgtgtatgtatatacgtatgtgtgtgtgtatatatatataatgtatgtatgtgtgtatatatatatgtatataatcttaaatgtgtacaaatagcattgtcaggtataaacagcatttgcttctttaaaattaaatggcttacacatagatgaatatttacttagaaatacctaaacattaaagaaaatgatttcagaaccttattcgccacctcctacccaacccaggctaataacacagagaaaactttgttatcagatccaccattattaattggagtcctctatcaacttaatcacacttttagcacaataaaaatggatgttcatattgatgtctttaaggcaaagcaagaccccaaagcatcttcagaatcactagaacaaagttaaattatgttcaagattaattttagtgcaaattattttaagctaggtctataggcatttgtgataaatgtatttattgccctgccacagtacagaaagaatttgagatggcttacataaatacatactacacaaaaagataaataagaacaatgaagaaaagagtaggaatggtaggatgaagctgggattgagattgggacccaaagttacttcagagtgaccggtgcatttgttaggaatgtaccacacattttattccgagcatctaacggctgaccaaaaccatttccacagccagcaggtcaagttcattaatccacattgc

SEQ ID NO: 109527 - DNA, 1071 bp, Homo sapiens
ttaattaggtctgtgctaaatgatatacacagaacttatttttaagattaagtgaaaatggtagatttctcctcagccaaagaaaccgtgttatttcttggtatcagacacttattattaattaattagttctccgaagtggtatgctggtgtatttttaaatcggttaagcaaagacatactcccagtgtcctgataaggagaattatgaaaatttataattagttcatgataaacagcttttagtgtctatcaggtctcctgtagtaacttagtaaaattaagggcttttagatttggacagcaaaagttaaccaaagagaagtcgactcagacattactatagaaaaaaagtacatagatactttagcaaatggatatacttaggaagatatacttagccatcatatgttgctatcatttttgaaatgctaagagtgcaatatttaactttcatatctattatgtgttgaaaagtcttttgtggatataccattgtcatacgtctgtggcagccataagcatgttgtctctctgtggctacaatatgcagatgtatggtaacagctccatgtaacattttaatggtgccttttctagtctactgtgacaagtaattctactcagcttgtcagcgatgacagctgagactttttgcttagatgccttgacagtgcttgtattaaacagccagagccatacactccattaagtttccgtaaaatgaactgcctgcttcttgctgttttgctgatagtggcagcagttgtaagctaatcctctccagttgtggattgctcgactgagtgctttcactcatcaacaggtagtagatctcataggtttagtagagtggctataaggttgatagctatgataggcagacataatttatctcaacacatttttaaaatggctatttactctaaataggctgcaaatctgtccctaactaggagaaaactgaccttctagatggtgaattgatggttcttccctaacacataattattcataggctcttggtacaaaagacataaatatgggaagggtgtgtctcagaataactat

SEQ ID NO: 109528 - DNA, 1047 bp, Homo sapiens
tcctataatatattaggcacaacttttggagaaggcagttgatatattctgtagcaccttgcaagggccctacataactatttaaacacgtttcataatttctacagtgactcgtgccttattgtagtggataacttctgtttaatttcaaaatatattttccctttgcctaagcccctcagtcttctaacatatacaaaaccaaaaaaccattagaaaattcaaggtatttatattaaaatgttaacattctttatgatgtttcctttactttgagttttcattaggtgacccaaccatactttaaactgctgttagtctattaggcaataaaattgtttataatccttgctgttttataatctcttttaactgcttctcttttctttttcttcagggttttaaataaagacaaacaaaaggatgtgggatttacacctggctttttgtagccatgtgattctaccacctgcctttagttccctgcttcctctcctgctggacgccattgctattatttccctgcttcactgtctgccctgtgtgtgcccttatatctctcattccccatcctcacttctctgcttccagtgaagaaaagggaaaatctaaaatcagatttaacattgagagccagatgacagagtattttatcgtataatccaagcactaaaaaaaaaaatggcactaataattgacaaggcatgactaaattgccttgcctttccatgaaagaagaaaagagacctcctagaaattcaattgattattttaattctttttctgatcttatgattctctccctccttgatacctgtatttgactaagatcaacattcatgtgattatatgagaattctgtcaaatgggtaaacagacagtcttcttaatgctaaagcaactgtgaaataagtttcttttcagtttatggtaaataaaaaagcaagtttccctgaggactggcagctcagatgtgagtgtgtgaatttttccccttcaatgtttcttaaaagaagtaagtagagaagttcgctgtagtacgctaca

SEQ ID NO: 109529 - DNA, 1063 bp, Homo sapiens
acatagtctgaaaaataaccagctaacatcattatgactggatcaaatccacacatatcaacattaatcttaaatgtaaatgcgctacatgccccaattaaaagacacagagtggcatgctggataacgaaccaagaaccattggtatggtgtcttcaagagacccgtctcacatgcaaggacatacatatgctcaaaataaagggatggagaaaaatctaccaaaaaaatggaaaacagaaaaaagcaggggttaaaatcctagtttctgacaaaacagactttaaaccaacaaagatcaaaaaagacaatgaagtcttttcttatccatcctgtgaacacaatgctcatgctgtcttaatacctcagcatttagtctaccagtttccacttccctgctgccttcttcactgatatttctttaaggtgtattgtactctattacatctatgttttatttaccttatcaaaataccagacatctgagaacaaaggtctgtattatttttatttgtatctcacaccatataaatcactttgtcttgcagaaagtaggcacatagcaaatattttgttaagttcatcaatagatctatggtgatatggaatggaaatgcaaaacttggattacaatggttaaatattaaagaagtaaacttttctatgtgcagatctttcagaattttgatgtgttgagaatattaatattcatgttcatgtaagttggcatttaacagtttggttcaacttttattaagctaacaagccctggaatataaaataagttttaaaacatgggttgaagtttgttagcatctaaacagcatgataataaatatttaacattatagtaatgcaaggtgctttgcatgccagatacagtgcttttagcaggttatctcttattaaacaatcacagaaccaacaatattattcaagggggaaagtgtctgcaaacacaacaaacactgtggaataacttctaaaaaaaaaatacaatacaaaagccaaacacagaaactgtggaaatcattcattcctttacaagatggtaagtggtggt

SEQ ID NO: 109530 - DNA, 1071 bp, Homo sapiens
tgtgtgtgtgtgtgtgtgtctcgtttatagtggggtcacatagatagaaatatagatcttagagaaccaaaaatagctcattggtaatttatccttcattaccccatcttttcaaccccctccagggactccttcatctaattctctaggaactgtagctcattaaacctgtgaacttgttttacaaaaaaatcaatagagtattttgtaaactcacaaatatttgagttgccttgtgtatatatttttaatagcaacaaggctgttcttcataggcaaagtgaagtgaaggagcgagtttatgaatttaatgattatagatggccaatctgaatagttcaagcaaacattatctcttacacagtagaaaaattttctgcttgaattactctgacaattgcctcaggtctccactttacctgagtaggcagtcttcagctgtctctatataatcatagttaaattagacttgactgaaagacttagccctctcaggaattttatgggaaatttggaagattcaaagggttaggcagagccttgtagctgggccactaaagaacaaagtgacagcatttttgtagtttcaattaaggtgtatgttctcatgtcagaggttaagttttcttttttgttctgtctcttaaaaatgtatattttatcattgaaaatacaaacaggaatatcttttagcagggaacacaatattctgcctattcaatattcagatattttgatatctgacaacataaaaatgagttcaagtaaaaaatagtggttcattgccctctcctgtcccctgaacccagtaacatggtactgtgtacttatgaccttggatatcatttgacaatgagaaacacaacagggactgtaagaggaatccttcagagtcagcaataagaatgttgtgctacatgcacacgtatgtttattgtggcactattcacaatagcaaagacttggaaccaacccagatgtccatcagtgatagactggattaagaaaatgtggcacagatacaccatggaatactatgcagccataaaaaatgatgagttcatgtccttt

SEQ ID NO: 109531 - DNA, 1050 bp, Homo sapiens
gcttccattgtggaagtgtcactctccaggaccttgcaggactaggggagctgtgtgagtcatgtggtctatggaggtacccagactttggagtcagggagatttaatcctgagtcccagcccagccacttagtggatgtggggctttggacaaattccttgacctagaatggtcatgtaaagtatctgaaagaaaatacataatgatattgattgcaaaaacagcagcagttcttcattcctccttgtatacatacatgtccttagccacgtagttttatagctccccccagtacagaatttgtttcccaaaacttcaatctcattggccttatttgctctggccaatagaaagctatgaatatgacagtgtaccagtttgggatctagagacaaaagttgttcaatgtgtctgctttttctttcagaactctgccatctccacaggaacaaaccaatgttaacctgctggagcattagataccatggggaggaaaaccaaagcacctcagttgacagccagctcaccactagaagcagagctacctattcaactggcagccaaccacatatgcctgaaggagcctagctgggaccagaagaatggcccagctgagcccagccgaaatagctggccagctcagtcatgaactaataaattttggggtgtttgtttatgcagtaacagctaactaatatgtatacccagtgcagataggatgtcaagattgaatgacagactgattactgtttacctggtaaacagaaggcaccctgtaggtactgatattcttcccccttttttaaggttgtatctcttgtcagatgttgttgagttatacagaaatgcatgtagacatgtatgcatgggatgtgcttaacctcacatggtccccatgccacagaaagaaccacagtgtgaccattaggaccagggtcaaattacaaaataacaagtttgcctttaacctatttcctccccatctaaattccagaggtcaaggctgtggataaatctgaagacctgggctcccttctctggggccttat

SEQ ID NO: 109532 - DNA, 1064 bp, Homo sapiens
ctgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattatgttggctgtgtacatatataaaacctttgatgtctatgtagtttatatagactatttactagtcaggtaaagagagagggatggtatttcttgtttacagtttgtttacattttaattgcttttacttctccagtgttctattgtagaataaacctttttttccaagttagccttcataacctataacacattcattctctcccatactggtgttactgattaataactgccatcagaacccaaaccactgtttttcataaacgtattgtttcccaagatatatactttaagcccataataaaattacaaattttactatttttattacttcttgcaggagataagatttttttaaatgaaggggttatttactatttttattaaagtataatagagcatctaatcagctaagggattgtaatttttaattcttttgaaaaataaatattgtatttaaaagacgttatttcacagaagctgaaaaagagaccttagataacatttgtttggttagccacacggttgagcacaaaacaatgtgtagatgtgttgaagattagggcaggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattgagcatat

SEQ ID NO: 109533 - DNA, 3198 bp, Homo sapiens
caatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatattttttttttttttgtaagctgtttcatgatgttttctttggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatc

SEQ ID NO: 109534 - DNA, 1444 bp, Homo sapiens
ttagccaactctttacaacaatgcaaatatggcttccaaagctgtagaagcaccagaaggtgggaaaagggtagctatttactgatgctgtagctgaatataatctgtgatatctttcattagggtccaatagataggaaatggtctgttttgagcattttccccctcctttttaatcaacagagagtataaaaatcctagccgtggttcttcccccacagtttgagctcatggttgttctcttgatctgcttaaatgatctgtctgatttctgtcagttaagtgctcatttccatgattattatgctttaccaattttataaacttggaactaagaaacatttcaaattgtactatagaaaagttaaacataaaatgtacaataaaattctgaatacactggttgattattttaatttcttacaggtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggt

SEQ ID NO: 109535 - DNA, 1156 bp, Homo sapiens
ttctatattgaaataatcaaatattgactgataccaaatactgattaaaatccaagcaattgaggcatagcaaaatcttcagtatctttagaaaaaaaaaagataaatggaaaaatgtggtcactttggtgttcaaaaccatgcgaaagagggattatttagacagagaggaatacagtaaatgagcacatttacgttttctactcctggacttgggagattcctttaagttgtttttttcgcttgtttagcttttaatttctagaacacttgctcttctttctaaatttcatttatttattattttcttgtcactgacttgaagatcacagaatattcttcctaacagtccagtcggtctgcttctcataaagaattttggctattagatttggctgaatatgggaggttgggtgggagcaaggctgggggagtatttccttacttataaattaactttctttccttcctttttcagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcaggtatgtcttcattatttaaatggtcaagtgctcttaaatttaggtagaagcatttgcctatacactctgcctcaccatttggttgtcattcctcttgtggcattaattgaattattggttttaaaataagatagaaactaatggaagttatatctttatggagactggaattttgaaatggattttgatcatttgttttattatttattattgtattcttttgtttttttccaacggttttgcagatatcagatgtgaatgtttaagatgtatttatttagataaatgacagattttatttttcaaaatagttgtctccgaaggagctatatgtgagcagtaaaagtcaaaggaccagattttatggctgaatgcaataatttatgagaaagaaacttacaactacattaccttttcaggtagtatgtatggtgtttcagagattcttagaagtggagaaaacagtctgttgctttcaattttttaaatcttctcaatgttttagttttttg

SEQ ID NO: 109536 - DNA, 1091 bp, Homo sapiens
acagttaggcatatactttacacatgtatgttaaacttctttccatgagtttatttttcttttccttttaatctcagactacaattatttgggacgcacatactggtgaagccaagcaacagtttccttttcattcaggtaaatttcttataatttacgtgaaagctggagcttgcttctgtttttctaattaaacttttaacagcatataatttattttaaatgttgaaatatcaagtatcagtcttgttactagtcctttggagagttgatgttccatgacattcagactcttaattgtcagaggatcatcaaacgttttctgtgaaatgtaccataaagcatttgcagcctggtgcaattagaggtggcattatttaatggaaagaacatagatttttgaatcagaaaatctaggtttgaatgtcagttccactccacttaagaagcattattaagactgagcaagtcacttaacctttctgagcctccttttcactgtctgtaaatgagggataataataataataatacctgtttgttatgggataaggctaaatgatatacatgaaaatactgtatagactcctataagtttaggtattgttgtcattttctcattttggatccaggtacctgagtatttgtctacaggaagtaaaaaatagactttcccaatgttgttggaatgttggtggcttagatggatttctcttttaagaaatactcaatgtggtacttttatctgattaatcagacctcgaaaatagtgctccgtccttcatgatatacagtcacacacccagacattcagcttgagtagagccagccatatttttgtgcccacgctccgtttaagcctagaacctttgcgccgcttttcagtgagtttcccgactgcagtaactaaatgatgttaaactggaacaagatacccagtggttttagtactacctgatttagctgtctctttgattttgttgtgctagaaaaaatttcagtttggagactgactaaaataaccctggttattctcaaatctttgatgacatccttttacaaacagcgagccagtggcacagcatcaactt

SEQ ID NO: 109537 - DNA, 1235 bp, Homo sapiens
gttagatctgtccttttattacacaattcatcgaggcaaggtgcacagcaagggaatataagttgagagaaatttatatggacttttcctcctggtaaagtaggcagttgtacttacttcattaactataaagtcagcctgtgctcttttctggctcttttccttgttgatctttttattggcaaatatttcatagtgggaagggattaataatagaaaggaacattcaagtatttaagaatctgatcattcgaaacaatgatattgtttggatcatacccacacacttcgttttagacagtaaaggatttagaggaatggccatataaaaccttctaatcatattttaaagtttttcttttttacttctaataaatcattgtaagactatgaatttgatgttcttcccagtccaccactctaccttcattcttagttgtgtgagtctgtgagaatacttttggcatgcatgaggtggggtgatgtagatcctggtccagagcaatcactgtcagttgttgaactttggatataaggcccccatacaacattagtgtcacacagtggaagggtttcataggcctttagtggcactcacaagtaggcaaaactgacaagttttgaagcagagaatgtcttcattctcttctgtacctgggatttaaacatgaaatactttaacaacaattaaataccgtatctagattatataattaaagaaatgtttttctctggcagagtgaaggtacacttctagcaactggttcctatgatgggtttgccagaatatggactaaagatggtaaatgaagcattttccttcttactttgttgttgatctaaagatagaaaatttaaaataatgttaatgtttttcttttgcattttaggtaaccttgctagcaccttagggcagcataaaggccctatatttgcattaaaatggaataagaaaggaaatttcatcctaagtgctggagtagacaaggtaaaagctcattaagttctgtaaaggcaaatgtattacagagcttaattgaaagcagtattttgtcttagctgccaattacataaacattcctatttgggaaattcacataggaatttatgctagaaatactccttaggtctatcagctcatttctgaatctacttaccaaaatgtccttatccttttatctatgtgaacacttttaattttacctggaatttgaaccataaacaatgtcatacgt

SEQ ID NO: 109538 - DNA, 1033 bp, Homo sapiens
tttctgctttaatatttgaatcaaatcacaagaaactcttcagctcaaagtttttagttttttaaaagatgtatttactataatggggcaccaggcctctgatcattatatgaactatattccatattgtttgttgctttgactaacagaatttcagaatctaattaataagcctttttatcagctcggcctacatcttattatctctttcatttcagctctatctgtacagctctatactgtaataatagtatgaattaaatgaaaaggaaaatgtaagcagtcatttccagttgctgcttgtagtttctttattccctccggacttcttatatgaattcagaaagttcctaaaaatgtttttttaggaacgaagattttcatttcatttctgattttgtataaatacaaataactttaaatattgcctttgatttttcttctctcacaattttccaaatccaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaagtgagctcagacaagaatttttttttaattacatggtttatttatttatttttttaaacttttaattcggggtacatgtgcaggtttgttatatagatgaactcatatcacaggggtttgttgtacagactatttcatcacccaggtactaagcctagtgcccaatagttattttttctgatcctcctcttcctcccaccctccaccccccaggaaggtcccaggagacaagaatttttaaaaattttttctcagaagaaatgccccatcttctatgctgaaataatttcatctgttaacttgcaccaacttgtttccctaacttgtatcacacagttcaattca

SEQ ID NO: 109539 - DNA, 1048 bp, Homo sapiens
cctattatataaatcaaaagctgtccctggaaaaagcctttttctgcatatatatatttacagataaatggaaatagcttctggcacaaaactagttcaagttttagatttttccaaggaagacttaagtcatatgctttttctggagtcacagatttttttgatgtgccaaaatacattatagtataattgcattctaatttaaaaaatgtttattgagtacttgttgactcaggtaatgtgctagtttcccagaattaaaggattactagacttaaacccttttgtcaggatcccagtctagtagtcacacacaggcaaacaaccatagccacacagttgataaccagtgtggtaagtgccacacatacagaaattctaggatcagcgtaggagagactggttagccctggtgtagtgaaagaggatttcacctccattcagataggagaaagagcaaaggaggacataaggctcagaggcatgatgtataacacagcatattcaagatgttagatgtaatttgccaccacttgaatttattgtgtaatgggagtgagacggggtgtgtagtattgagatgagactggagagacagaagagccagattacagaaacaactgtgtgccataattaggcgtttgacctttgttatgaaggccaaggggatcattgaaaattctcaagcaagaagtgatatgttcagttttttgttttacaagtaatagtctagctgtagcttggcatatatactgaattgaggaggaggggaaagaaatgtgtatagcaaagggtaatggggactaaacgcagatctggcagaaaaggtaaggtgatgagcatctacagatggtagagtggtaggatttggagtaggatggtaggatttggtaaattgtcaaatgccaagggaccgagagagaagagggagttaggatgactatgactttcaggtgtagtgaaatgagatcagaagtttctaaggaaaagtagttttagggaggggaagaagaaaattgattttgaacatagtaattttaaactgcta

SEQ ID NO: 109540 - DNA, 1480 bp, Homo sapiens
ttaaagctctgacctgtactaccatgtaacatatagctcattcattcatttttttgtttcattgtagcagtttcacattaggtctgtaatggctaatgaatattacagtgcagtttctttgttgactcagataaaggtaactgggccattccttcctatgtaccttatgcccagtgccatttatgaacagacattaccagtgtattcgatggagtcaggttgaagtggttatcagtaatgtgcttctagtcatgaagaactgcagtgaagagagctcagcgtctggtatgtccgccttcagtctgccttttagtttttatcagtagatgaccagctacagaagtgcaagtaggtatatagttttgttttataatcaaatgaaatacagaataaccttgattttacacacatggttgtatccatgactaattgacaataaacagcaagcagttgtcataaatgctgataattacaattctttttttttcccaaataagtttttctcctctttttgtaagctgaattaccattttttgctgacacaggaaattcgtattacacattcctgctagcacacttatcaaagggacaatggtcctttaatagttgccaaacagagaatttgttcaatgttttttaggactagccagcatagcgagagtataaggaaacatggaaattgcttttggcattattaataatctttttggaaagcaatttggcaatgatgaaaaccttctttaaaatgcttatatccccttcagcttttgagggaatccatcctaaggagaaaaaaacaacacacattgtacatggcaaaagcctatacatatagatatttgaggtaatattcttttaaaatagtgatcattggaaaagttcgaaggtccagctatggcgtgaataatttactggctgaatattatgatgctattaaaattatttcagaaagtattatttatataaaatgttcatagttacatgtatttttaagggcaaaattagggcacgaaattttatagctagtgtatcagtactagatctagctcttcaataacaaagatcccctgtgtcattttttccccatcctatttaccttttctaaaatctggatctgtagggcagagttggagtcaagaaagcatttgatgatgagaacatgagtataatttgctgagcttttctgacttgaagcttatataggaccttggatcaatcagattttcgtttcagactagggcagtatgttgtggtcatatttaagctttgccttttttaccagtttgtctcatctagtcatcctgtaccataatcatggtgttcagagtccattttcttattcttgtattgcctatttgcaaggtagagttggcaggctctgtatgactaactcccctttgagaacacagtccctaacatccttacagaaagcacttcctgaaacaagcgatctatagaaaatggctgttttgtgatcttc

SEQ ID NO: 109541 - DNA, 1522 bp, Homo sapiens
gaatcaccaagtacagtaatgtctgggttgttttggggattcatcatatttatcaccacaacctacaaatgatacttattgagaattagtcattcagtatctaagaaatgcgatataaattactcttaggttataactatgtttcttgaaagatctaaagtaataccgaagaaactggaatctttatactgctgctttccctgcaatagagcactgaattggattaggagacagcagaaaaggaacatcgtggcaaaggaagtatttgtgcagggacattcaaaggactggtttgtgaagacttccaaaaagcaaaactaaaatttccgcctggcctgtctcattatcaaagactgtccaaaaacacattatgaaagtttttatgttttgataaatatgtggtttagtaatactttttttatgtaagaacttttaacatttgttctctgcatattgttcagtgttgactgtgttatctatctgcagggggaaaatcacttaaattgttttaggcttaaatattttttactgttgtcaatactataagatactatctgttgaaagtttcccacctccaaaattacataaattctcagattcatttttctcacctataaaatacgttgctgtggagaagggatttacattgtgatattcagcctcaaatatttgatggacatctctgttttaaataagccatccctcagactcatcaaaactaattaaagaaaaatatatttattgtagggtttttattaactattgtaacttttattttttgcaattttatcactagaaagttcaccctacgcaaattactttggtcctcaccattctgcctttttatgaagtggacttccctattcaacaaatatttcctagggaataaaatgatttttttctctttagagatgacttgaaaactgagcgtatttaatatataatactgtaagtaacgattaacttgattcaaaagtattgttcctttaattagtgtttgcccaggggcattaatttcattgccctaataacttatctagcaaccatatgcagataaatacttagtggtacatgccaagttgcatatagtagaacctgatacagtgttaattttagaggcactaagctggtttggacctttttaatctctcccccaccttttgcgtcaccattgacttctttagttatttgcagttgtggtttgaatagtttctggcagttatttttgaactttctgacacctggttttcttataagacaacctgttttctataagaagatgtcattttatccagcttcagttgtatatttgctttagggaaagaattcttgatactaggtttaactattacatgtctaagagctctgtaacttctccatttatattgtacttgactgttggaagctatgaaacagttgcatcttataattgaacgacttaactggaattgcaaaatcaaaatgtccttgttactaaaatgagtaactttctagatagtgattctgaatattattacttttt

SEQ ID NO: 109542 - DNA, 1994 bp, Homo sapiens
ttatggttttgagacttgaatcattcttcttgtatggcatagttagttgtcctttcctatgcaaggaatacaaacatggctttcggtctgagagcctgttgcttgctgagatgttcccagctgttcttcagtgctgagcattttttgggggtaggggttttctattcccaagcaccatcactgcccctctctgaggtgtaacagctgtgaaagtgatgtccagaaggacagggagggaaagagagattagtatccaagcccacagagaataatttataatgaagctttgaagttaatagctcttgttttgttttctttgtttaaactggtagactggtactgaaggcagatctaaagaatgttttgaataagataaaatgattaataaagtgaaaaagtagtgactagtgattgttacgtatgtaacttgtaaacaagtttaacaatttcaaatacttgtgtttgaaagttgtgtagcactttcaacccaaatggaaaaaatttgttgggttaaagcaaactcttctttctgcttttaaatttaatcaccttttaagccagagctttgagacttttggacactggagcaaaaaccattgtgaaggatcagtagatgggaaatatattgtaaaggcttgttggtgtatggtaaagacaactatttaggttgagccatataaaattactgcttttggaagttagaaacagttgaatagctcagcactaccttgtcgttcagtggtgttaatgagagcagtaatatttttctttttctaaacaaaagtccacaaattgatacttgatgttactgtaagaaaacagtaaaaaggagcagtaaaataatattctcggttaatttctgaacgagtagattaaatattatcaaaagttgtgggtttttttgtttgtttgttttttgagacggagttttgctcttgttgctcaggctggagtgcagtggcgtgatctcggcggcgggttcaagcgattctcctgcctcagcctcccaagtagctgggattctaggcatgcaccaccatgcctggctaattttgtatttttagtagagttggcatttctccatgttggtcaggctgatcccaaactcccgaccttaggtgatccgcccgccttggcttcccaaagtgctgggattacaggcattacacccggcccaaaagtcttcttaaacttgcttttcttcttagagaaaaaacccttcaaaattccatgttttaaggtgttttatgttgaaataaaaataaaccaagaattaaaaaaaaatttgtatggtagactgatatatcaagttctccataattgtttagtatgttcttaggtgtcctttgtgtattctttagaaagttttagactttacagtgtagtggtgatgctaaatcacatctctaaaaatgtgaaaatcagtcccttggtaaaaattgtaacttcctgtttacattatgatttatagggaaagatcagactcaactgatgacattttgacttatggcagttttcccaggactgcaacttgccataaatttaagaactgcttatgttaagaattctgaagtttgagcctctgactacctgcatcagagtcacactgagtggggcctgggaatctgcattttacaaatgccccaggtgattcttttggcttaataaagtttgaaagccactggtctatattagttgtaggacaattagaacttgacaagacaattggcaagcatttagcatattcacaatatcttgacagaaaaattatgctgagtattcaagataaagtagaaaacatggaatacatgtacatctgctgaggtttgggctatgagagcatatcctaaagaggggctgccactgaaagtgtatatttgtgtttgtgggtcaggcggaataatgagatagcagaaataatgaggcgtttttatgtcttaaagggtgccatgagatatttatttgaaattgcatccagaaataggatatggaag

SEQ ID NO: 109543 - DNA, 1087 bp, Homo sapiens
gagaaaaagtgagcaacattttatgctatttgataaaatcattaaaatattatgctaaagccctctaaaaaattttgttttatttttgccagtatgttactttgaagaaaaataacaccagccatgttttggttgtataatcattttcctaactattggaagcaactttgtcaggttttattattaggcaatgtagaaccttcgttttacatcatttaataaaatcaaatggtttttacaacattgtttacatcttgtttaaaaatattttactgagaaaataattaactttgttttatttttagggttatatcctgtgttgtgacctcatggtttaagtgggaataaagatgagtataagcagtgatgaggtcaacttcttggtatatagatacttgcaagagtcaggtgagtacttttataaagtaaataggcctcaaattattttaatattctcaaaataatcttttatgcatttgaaatttgtatcagtccaaaccgttgaactttgtatgttttcttaatgtctggactgccattttaaagctatgttttactgcatggtttaactctctgactctttcaaatatgttgcaaacaaggcaattatttgtaacagtttggctttcgttgttcaaagaccatttttataatctgttatgaggtgagattattgcatatgtagtaggaacataaaaacttttagccaccatcagtttgataatgtatatccagaattctcaattaaatgttgttggtcctaattgtagttagtattttggaaattaaattaacagtattttcctagaatgctttcaaaattattatttgaattaagtgtatccttgatctgaattgttattattgtaatgggagtaattataaatagaaatcattgaaagccatttgcaactaatattaaatcaatcagtgatcttccaagttttattgatagataaaacagaaggaatactgcaaggggaaatgtggatggattaagcaaaaatttaaaagtagaagagggaacatggttgggtatgggtggaggtataggatggtgagaaagattaattgcaatggaaatgcc

SEQ ID NO: 109544 - DNA, 2011 bp, Homo sapiens
tatgtctttattgtgatataagtaagttccttggaaagcaaaacattaagatattattcattaacattttgttatattaggttgttcagcctgtcacctacctggctttaaggaacgaaatatacttggtggcggtgagggttggggaggtagcatagaaaacttggaatataagtctgtttgaaaagggcagtgggctccgttgatgttagaatgccggggatcagatttcaggctcacgagaaggtggggatgaggaagttgtcaaggcagagaggttaattagtgaaatagtgcccgattttgaggtggttggtaagaaaaaggttgatctagggaaagcgttgatagaagcgtagggagagctgtgcttactcacatttttccctaggcttaggcttcctgttggtaaagaggttgatcatggctcatacgcaaggactttggaaagaaggaaaaccctatcttatgcttgaatatcttctaatatatccacagcaattattgatgcagtcaggaatagcagtgtgagtgtagactagtttcttggcattattaaacacatatgcctctctattctctagctctttcactccctacatctcctctgttctttcttacgtatcctcaaggtacacagggatgggtatggaaactgtaccaggtataacttggaaatctggctataaagaatttcagattttttgcccagctagccctgctccctttattccttatgtagcaaacaggttgagtatgtaatgaatcaattctccagtaccaaagacctgcattctttgttgctgtgtatgtggtaaagaacgctaccccatgtttggagtcctgaatgggttttcttgggaaataaatgctgcaagagagagactagtttcaagttttggttagaaggaaagggattgcaaccctttggcaccttctacaatacaagtgatgagtctgggcaaaacaaacaaaaacgtgctgaatcccaccagaaggaaagacagtgtgttgcgggagcagtgcgcctttactgcagcttccacactccgctacaccttctactaaagtttggtagcaaatggggtaagtttggctatgaagcccactcttcactgtattgttcctttatattaatggatttctatattgctacagtgttaagggcctagaacagtggcaggcgtgtagtgtagtactcagtaaaacatttgttacatgcatgatagaaaaactaaatttaagtaaaatgattgaatctttccaaatagaagtccatttatagaagtgtagtctcagaaaatttataattttcattcctccaatatgttttagagttagtagatgccatgtgttatatcaaaactagagctttgatactctgatatttatggcttttaagtaccttttttgtttattaagtataaacttatcaatatgtattccaacatgaacacaacagaaaccaaactaaagatttaggttgtgttaaaatatgaccagtactgtgggctaaggagcctgttttccagtttttccagagaaactctttgacaaaaatatttgtcaccaatattgccatgagggactcaataggtctcaaacattttggtcttaggatcttgttacaatcttaatttattgatgatctcaaagagcttttgtttatgtgggttatagttatcaatattaaatgtatcagatattaaaatggaaattttgtattacttactaatgtattttttttctttttttgaaatcaaactctctctttgtcacccaggttggagtgcagtggtcctgtcttggctcactgcaacctccacctcctgggttcaagcgattctcctgccccaaccccccaagtagctgagattacaggtgcatgccaccacacctggctaatttttgtatttttaatagagacagggtttcgccatgttggccaggctggtctcgaactcctgacctcaagtgatccacccgcctcggcttctcaaagtgttgggat

SEQ ID NO: 109545 - DNA, 1512 bp, Homo sapiens
gtttcaaagatttctatcacagagacacattgatattacatccatcttaagactggccaagaacaagagagaaatcttattaatgattctgaatgtcgtattaggagatactatgtattgccaaggtgaaatgttcaaatgactaagtagtggacttgcatgtgtgtcaagttattttataatcactttaggtaatttgcatttaagaaaaacttttaaaaacaagctttttccatatgaatgtttcatcatatctttacatcctttaaaagttgatttctaagattttcttgattgtagagatacgtttactggttctcatatccttgaagtgttaagtctgccaggtaagaaccttagcatcaacataagcaatgaagtataaaggaacaaataaatataaagtagaacatcagctgatctttgaacttaaagctagttgttaagtttgtcagaccctggaggatttgctagaaccaggcagttaattgtatttaggtaatttagttagaaaaccacagtttttgaggtaccaggacctattgttactgatagatgtttgatttctttcagtatagaaaacttaaacatggagacactcttttaaaaaaatgtttctgtgtgtcactgaaaaaaaatatatattttttctttcagttagctttattgtcagaaggagaagccagatttctattttgagagaaccagaaaaaagtattatgagtagggaaaatatgctcattaacacagaaggatatcacaagcatacttattgttttattgcatgttaaatttaaatagtttaatttactctaatcatttttcttgtcattttattctttgttcagttatttcatcaggggcagttatgggcactttatcacttaaagtaagtactagcccaaaggtgtactattttctagatttacttgggcagtctggccaaaggtgaataggtcttttcgggccataatttgggttactcattactaattcagcttagatgttaatgataaagcctgataatgttactaaggctgatatattctaaaaacctttctagcagttaaaagttagaaagcaattgctttttgcaatttaaaattttgtgtatgtcctttttattgaggacataattatgtccttatgaaaattattttcaaccttgttccctactgctgtttccagtgttaacagttaaaccttactgttaacagaaatcttacatttgattgattcttcctaaattcatctttaggatcactcagtgttaaagctagaggagccctttcagattatctaattcagtaccctcattttacagatgaggaaactgaggccttggactagaacagaggtctcctgactcagtccaggactctttctattacatcatgcggcctgatatttgtctttatggaactcagcaacatcacatacagggtgagcttttttttttttttttaaatgaacacataaagtgatttgctaccctcattagttactagtcct

SEQ ID NO: 109546 - DNA, 1044 bp, Homo sapiens
tagagatggggtttcatcatgttggccaggctgatctcgaactcctgacctcgtgatccacccgcctcagcttcccagagtgctgggattacaggcgtgagccaccatgcttggccaagtttttcctttaaaaaaacaaaaacaaaaacaaaaaaaaaccattacttgatgggcaagttgcagtatttacagaagtatactgatgactgcaagttctttgaatagatgtattaacaacaaatatgaggaaatgttaattttaaattgtaggtggtagctatgtggatattcattttttttctatatgtttgaaaattttcatagtaaaatgttaagataaaatagagaccagtgaatgatatttctcgaagtcagattcctgttaatatgttgtttttttatggcattcatcaaaattgatttctttaaatttgaaaatagtttaaagagcttatcggtaacatttttctgcctgtgcattaagctgtgacctgcttatgatgcagaaagatagagaaatatgaataaataaaagcaagaagacaaaacatacatactaacttgatcgtttcaaaatgatgtagcaaagactaaggtcatttctaatacagacatttggaggggatggatacataattagactgtgctcagattcaagtatgattaatgggagatggaattcatggaattggtaatttcgaacaggtttttgaaaatgctatgggaggaaattattaagagtttgtttccactctcttaattgaccaatagtcatttatggattatggcttaggacacttttttcagtgtgttgtatttatttttcaaaaaaaaatgctgtatgatttttattgtggaattattagcgagattggattgattagaatttattttaaaatatctctttggaggccgagacggatggatcacgaggtcaggagatcgagaccatcctggctaacacgttgaaaccacgtctctactaaaagatacagaaaaaattagccagatgtggtggtggtcgcctgtagtcccagctactcc

SEQ ID NO: 109547 - DNA, 1190 bp, Homo sapiens
gctgcaaagtttaacttttatatttacacaaacggtttgtggaatataaggtgccctgacttagcaattgagaaaactggataagccctataaagtttaaagagaacagagttaataagttttgattgaaattgtttctaaaccaatgatatatttctctttattattaaacaatatagaatgcaagtttatgccattcttggtggcccatgattatagattatgaacatactaattggaccgtaatgcaataatatttacatgagttgagttgcctggtggtgagaccacttgtgtgcagatgaatctctttgagtctcattttgttcactgtgccaacctcttatgaacgttctaaagacttgccaagtattaagcactcaaaagttgctgctgttgtttatgataacaattacttgggggagaaagaaattcactggtggggaccttaaagaatatttcaaacatgtaacatttggtatggaaaatcttttaaactgaatttgttttagggcacattgaatactttactttccttttcctcagcatcaacaacagcaacttgtgattggcggtgaccggatattcagttgcacatccccacatcaatgcactgccaatggtaagactctccaactcccaatgtcagtgtttcttattctcttgtttttagaatcttttgagaattttgaaagtttctcacaatttgacaaaatacatgtgttcccaagctaagtaagtgttttttttttaaattttttattctttttaaatatatgtagtttaaagtatttaaaaataacttttgaatattttgtaaaggaaaaattgctacttttgaaaatttctattttcttttctttttatgtttttttgagacggagtttcgttcttgttggccaggctggagtgcaatggcgtgatctccgctcactgcaacctcctccgcctcccaggttaaagcgattgtcctgcctcagccacccaggtagctgggattacaggcatgcgccaccacgcccagctaattttttgtatttttagtaagagacaggatttcaccatgttggccaggctggtctcgaacccctgaccgcaggtgatccgcccacctgagcttcccaaagtgctgggattacaggtgtgagccaccgcatccagctgaggatttctgtgttctgtagttttaa

SEQ ID NO: 109548 - DNA, 3108 bp, Homo sapiens
acctgactagtaaaattctccatcctgtcccttcccttcccacccccacccagtggttctcagtccccattggaatcacacacatgcacacacacacccacacactgacacggggtgggtggggaggattttaaatgcaagtgatgtagatcctaccctagaccaattacatctgagtgaggggctcaccacgtcatagttaggttctaatctggggcatttctgtaggacagagctaatcaaagacagtcttcttggcagagccattctcatttctattggaaatgtgttcaactgaatgatttgtgtgttgtagcctaattagctattcagattcttaataccttgaatcagatattcaaaccttaggaagagtgagaaatctattaagatgtaggaatgtcagttttcttttctaacttaagtgccagtgtacccacctgtgtggtcttaggcaacaaagcttgatatccccccttcatattatttcttagatcttcgttgctgtttctactggtccacccctccttcggccccccacacttgtttctttcttccaaactgcttttttaacaaagggtttagcagctatcaaactttatgtaaacaagaaaacagtgtcatatctgtcgtatttcaaaggcactgtaagttacaccattaatttaataacattttggggaaaacagttatagttacacattaatgctctactcactttaaagaaaaaataacttaaaatcatagatacatttttatattagttttcaagtatccgtaaatttggagtgtaagctttttctcatgttcaaaatccctatcactgaaggtttgtgaaccggaagcttttgatgcataggcgttagtgcctaagtaatacacttgacttatgttagcattagaaactgttcaaaccaacctttaattttaagaactctgtgggtcattgtaagagagtttgtgctgttgtctttaattgcattgcttaccctgtgacagaaaaatttagaaatacttgagagttttttgttttattcttgcacaatagtttatttttgtataatcttaacataaaattcaatgacatgtgatgttaccagtgaaactaattcaactaaggtagtaattaggtgattagacaccagtgcatgtttaaattgttttctttttatgtgagtatgtggtcttgagaatagcttatttttaaaaattggtgtcagataacttttgaatcatttttcccctaatcgcttaagtaacaatgggaaatgaaaacataggcagtaattgcaaagctgtgcgtgatctgacagtgagtctgatctcagagtcacttaagatatccctgctgttatagctccttctgcttttcacctgccttaccttctggctgtctagaatattatctgtatgtgtaattccatgggaaatgaggatcgggtgaggacagtggaggatgtaatgcttagaggctttgacgtatgcgtagtatgttgttggagataacatactaacattcctttttgtaaaacggattaagaagattcagttgaaactctgatttacaaatatgtatatatttaattgttccattaggaggtaatactgtttttgtttctttcttaattgtgctttcaatcatgtgctaagcaatttaatttgaactttttctgtgacttttcctgggagttaatttaataaaaatctttctaagcagggtcaattctggtagaattcttatatatttctctctctctcttttttttttttttggagaccgagtctcgctctgtcacccaggctggaatgcagtgatgtgatctcagctcactgcaacctctgcctcctgggttcaagtgattctcctgcctcagcctcccgagtagctgggattacaggcatctgccaccatacctggctaatttttgtattttcattagagatgaggtttctccatgtttgccaggctggtcttaaccttctgacctcaagtgatctccctgccttggccttccaaagtgctgggattatatttttctcttaattcatggggtgactttcccaaattctgtacattaaaacaaaataattttattttttaaggataccagatatacttccttgaacttgttactgaccactaggttctagattagagtgtgttgctaccttaaataataagtttttattgtgtttgtacctttgtctaggaaaagggcccataatgtccattagcttttcaaagttatctataaattaaataaatttacttctagagactgcaatgtagtatttttgaagaacagtcaaaatatatcatttgcttttctttagaatttttccatgttaaaaaaacttcctaattgtgtgtaggtggcagatcttagaagatgtctgctaagtcaacagtgtctttctatgctgtaagccttatctaaaattaatacttcgtttactttagataaaatgctctgaaatacatttttggaagcaaagctttttgtttggagacaaaacacaaaccttacagccatttattttattacaagaagtaaatatatttagtttatgtagtacacaaaggaggtgatagtttttacactaataatgtgattgatcatgtacttcttgagtttcttgttaatgatggaagatccacctttattggtcaccttctggaagtggtgttaaagttactggtatataaccaggttctctcaagcattttcaaagtaacaatccactggtgagtttttccttcccagtgtgatttatttgttcagtaattcagtgtctactgcattttattttcaaatatgtttatatctatttctctatatctagacactaacattttatcagcatatatatcttaagaatcatgtatgttcaaggcattattcttagttctgttagggaacagcaagatgattaaatcagtcctgggtctctagaaatttgatcagagaggtatgatagaagaataaggcactatgcggttgtggaaagggagatatgttaagctggggctcatttctctctctggatggtggggtggataattaatggaggaagctgattgggcctgatctttggaggagggatagg

SEQ ID NO: 109549 - DNA, 1024 bp, Homo sapiens
tctcattaagttctgaccactccttcctctcatctcatttaattcttattcatatctagaattgtgttttaggtacaatagtaggcataagtcacagacatactgtcatttattcctgtgcatttacaatagaaggtattgaaaaaattcagcttagtgtcttcatagttctagctttatgcattttcacagacatttatcctttgcctcctctttgtcttctgctgaagaatagtgaacacagtagggaaaaaaaaaccacaaaaccaagaccaggtgttcttaagcaaagaagttctggtttgtgttttgttatttttccctagtcaggtattttaaattcgtaatggtgggtgtatagccctagatacattgtaagctttgctggatatttacaaattgttgcctaaactgtagaagggcttaagtcattagacattctattttagtgacatttttctgtttttctgtatcatgtgtcttggaaaaactttgaagttctttgatgttaattttgtaagaatgtgtgtctgaaaatattttgactgaatagactctgggttacagttaagaatttctttgatttggcacatcttctctttagcatttcatagcttttatcatggcctgcatatacaacatgtcaattataatgcctgataggtctcctaggagttgtagcttcacaatatataggaggcatcaggcacaaatcgatactgcagagaaaaaattagagtaactaaaacataaatgacgtattttgtgaataaggaagtgttctaggtatgccttccagtagtaagcggacaacaccaagatataaggcacgtcttcatacatcattgtctgtacacagaacatcgagcatacaggaagcttcctgagtatcttgctgtctctcaattgaaatacaaaccaactctggctctgaccatcctactttaatattgcaacccaggggttcctctttcacctctcttccccccaacttctgaatccctttaccctgcttggacttttt

SEQ ID NO: 109550 - DNA, 1050 bp, Homo sapiens
aggttacagtgaaccgagatcatgccactgcactccagcctggggtacaagagtgaaactccgtctcaaaaacaaaaaacaaaaaaaacctgattatccaggtttttctttgtttttatgagcttatactttctataggtcccatttttcttgagttattatgtggagttgctgtctggtttgcaggcaatatgcctgaatggttacaatgctaaatcgtatctcttgattttataaaagttcagtttgagaaactgacaaaatacgacacttgccatatattataatgtattcattttgtctctactcccccattaaaatacaaacttcagggtggtttcttgactgttgttcttagcatctgaaatgaagcatggcaaatagtacacattcagtaactagttattaaatgaatgaagaactatgatatttgacagcattacatgcaactaagcctcataaagaagggaattcacaaatggattctctttaaagtcttcctaatgtctgtctttttatttcctttcttcttccttccgttgtgggctttgttttgatcagtgaaagggtgagtataagaagctgcattttaagttttcaggaatctagtcatgcctttggataaaaataccgtggtcacacttttagctttgatgagaaaagggcctcattaggtcattttgagtcattaggctcaatgttaaagctactcagcgatgagggcatgaaagacgtatagttgtttgttcacagtgcttgtccttaaataggctcttaaatgagttaatgaatgaatgaatgttcaagaactctttagagactttgaaaagatcgagtgattttgaaataacagactctgggatctggaacttctatattcgcatggaatagaactagtttcttagaatgtgggtagtcattgcttgagctttctactaatatgtcctgagtctctggctgagaagagtggataaaatggtaggtgaggtaaagaaagaaagtcacaattcgtatactacctataaaagatttataaatggccattggccc

SEQ ID NO: 109551 - DNA, 2765 bp, Homo sapiens
gatactgttgatgctcattgtttggtatttgtggatgagcctgaaacgactaatatttaatcatgagtcttttctgcacttatgtgatcttctgtgctttgatttgcagctatctccactgtttaaagaacctgttgctctttgcaactgccttatttagccctatctgctagaagccattgatccaagaactctgcttttcctcacactcgactttaataacattatgaaagctagcccagtaaaactgaatttccaacaatgtggcttcagttgttggtggacttgcagtattttaggtcagatatctttcttcaagtgcacaagaggtatagagtaaaatttgacatctgtgttagaggcagatctcatgataatgttaagggatttcggtcattactttgcaattttcagggtacatgctgaacttcttgatgctcttctcttagttctattacatcacctcttctatgaccccaatcaggcgtgacattcttaactgaattcctagatgctttgacacaggcttacagtgtttttttttttttttatctgtcttatataagttatgtattagaggaggagggaatattttaattgttaggtactctatagtacctaacaatgtattccatttagtaaacacagtcttaagtaataagtaaatttgacagtaatgctcagaagcagcattttggtgaattaatcaacattgtagaaattattgattaatgtacttttaattaatagaataaaacgttgcttattaatactttagatttcaacacttcatggtttcaccttcacatcagttaattggaatgctgggatcatcctaaatgtatttatttgtaggattgggatgagggttgctcttgcattgtgattctttcaatcccattctctctaggacttctagtaattctaggtttccagtaattaatggctctttttattagttggaagtttcatggatttttttttttaaatctttagctaagaacattctaaaccacttgcagtatctaaacgtgtcagacatgaaggtagccttaatggaaacaggcttgccttctgtaaacctcacaaggaacagcctcgatgggattgtgagtttcatttcccatgtgccaaaaagaggcggagctcagagccaatgatgaaagatgttacttaatccttttagactacaaaatttatgttaattaccagataagaccttttccctcagggagtttagtatttaaagagaacgttaatgcatgtaatttataatctgcatgaatttagtctggctaaaaaaattgcacattgtttggaagggaggctaatgtttgaaagaaagatgcgtgtgaagtcaaattgggacttatttctagaggagataggctatggataggctatggaagggaagaaaaagattgacatccagcaagatttctcaatggactttatttttaaatttttattatgacaaatttgaaaataataaaagaataatgaattaccgtatcctgttagcttcaacagttatctgcatatgttgaatttagttgtcacatttcttgagactttaatctggcatagttcctcagccattctgtcttttatgacatcgatagttttaaagaacattcctcagtttatgtttgtttcctgaggacaagatttggattatgtttaactgtgattttataggaatgaaaatgttagaattctatgacaagccgtaggttataatggaactaattctggaccaagaatcaggagtcctgagtcctggctcttagaaaggaattgtagtatgcagtatttaaagaatgtagactttggattagtgacacagctttaaatctcagctcttttgtgtagctgtataataattgtataaatttaagcaaattggttaacattttagggccatgtataaaatatgaccagtaaattcctgtcttttcaagttgttaggagtaaatgagacaacatgaagtacaaagatgctacactatgtgatagtgattaaaatactgtaaatttgagctggtccgaaggtagtgagttaactcaattgattatgtagtcagtaacagatcgaacttgttctattctgttgccccccttttcactattgcactcgactagtctaaaaataaaaaaagtaaatttgggaaagaggaaaatcagtgagttaaagctgcgaaaaggaagtttgagtggaaaagattgcacgtgacctttgattttaaggatggattgactttggataaaatatctaggtgtagagtatccactggaaaatcttaagtgtaagggaacgtagtcagattagtgtgggaaataatgttagagtgaggaagttagaagactcttgggaattagagtttgaaggtctgggttgtagtccagcctttgccattagctggttgtatgatttggggtaagttatttaacctgtctagaccttgttctctaacactataaaatgactggtatgttatcagcattctttagaaacatcctggtaagacagagtagtaagagaaagctttcatcaggaaggaggtcatctgcatcttgaaaggtagacagcctctagataggagaagaggaaaagggaaagccattagaacaggaatgccgaattaaagaaggcataactggaggtaaagacctatactatcacagggaggagtgcatgttggaaagtaatgagaagttaaggttatcaattctgtgctccagaagtaggctctatatagttatgt

SEQ ID NO: 109552 - DNA, 1459 bp, Homo sapiens
agagtctcgctctgttgcccaggctggagtgcagtggcgctatgtgggctcactgcaagctctgtctcctgggttcacccgccattctcctgcctcagcctcctgagtagctgggactacaggcgcccaccaccacgcccggctaatttttgtatttttagtagagatggggtttcaccgtgttagtcaggatggtctcgatctcctgacctcgagatccgcacgcctcggcctcccaaagtgctaggattacaggcatgagccaccgcgcctggcctgaataacttattattttaatgcttcattaggtcaccaaaataagtaaatgggttgccatgtagaataagccttttgtgacttaagatatttgtttctggatttcagttgcttcatccttaacacgttatgttgaatctctgagaggttttttctggacctaatgttctttaaccctatgattgcatatataatttaaaaaattaagtgtgttcacccaaattacagggagtgtgtacaatactgatctctgcctgcactggtttttcttaaaacatttgcgttttccaggcacgttctcaattttgaatacattagtctcaaaatattttttagatatctgaagaggaaacttctattttattcattaaacttgtgagttcaggtgcatttgttacattctgtttcatggaagagagaattaaaataatatcaccaaacacatttttgagaatgattttttttcctttaatatctttattttcatggtatgattcctgaatgtcaaagccaattcttcagcagctaagcttttattttgctttgtcttggaaattgtgtactaaaactgtgtttgttaagtagtacaatacaatgttattcacatttataatcttctaaatactaaaataagtttcaggagctgcttatattaagtgctaattgagaaccagtgtacattaaaataatttaccataaaaaataagacatgagaagaaggcaggtgtcagggaataaagatgccaaacagtttggtcttttctggcaaacagttttgtttatgtctagcgtacagtttttaagttggtaaatgatgagaaggagctggaaattggtaagcagggctcatatcataaagtgacttctttgctgtgcctaaggacattcttctgaccgtaataggaactagtgaaggattttaaacggaacggcaggattatgtttcaaccttggatgtgtagtgtgtgaaggatgagatgaggatttgggagggaagggccttagctctggacaggggagaaagttgagctggtagtagtgtaataggtgtgaatgacaccagtaattcttggagtattgcaaactagttcatgtttctgaattctgcaaaaaatgcaattggagattcataagagagtggtattgaaaagagctaagcatccgggtctcctttctggcttgc

SEQ ID NO: 109553 - DNA, 1227 bp, Homo sapiens
tcccggattcaggcaattctcctgccccagcctcccaagtagctgggattacaggcacgtgccaccatgcctggctaattttttgtattttagtagagatagggtttcaccatgttggccaggatggtctcgatctcctgacctcatgattgcctgccttggcctcccaaagtgctgggattacaggcatgagcgactgcacccagcctgtagtgggtatgttttttaatttgttgcttctctacttggtttgttcccttttttgtgtcagatatgctggtgaatctagctgcctcattttatctagcctcatttgcctttcttgcgttttcttccagatgattcatgtgtattttgctagtagatatatcggttggttggctcctttgttctgacaaatcaacatagaagtgacttgttacaagtgagaactggtaatgacaggaaccataacagcatgctaatggtctttgataaatatggtgaatgcacatggtagaatttaaaggtcttggtttgaagccctcccaagagtagttgcaactttgaggttgggtttaggaataacttctgcaacctttagcttcactcctgggagaaactttggatacattttacctgcctctcttgagcttcagttcccatatttgcaaaatgccatgacttatctcttaagaatttagttagaataaaacagataccgtaagttaaaagaatacttggttgtgctccagcgtgtgtctgtatccggaataggctcatatgtaattggtaaatacgagaattatgtcagtacaacaaggagattgctctggttcatacgtgattttccccagcatattcatgttttgcatcaggtaacaatagtcgagctcaaagtacactaagagctgaatgaaacaagccatggtggccacttgtgaattcttcctgttggcctagtttggccatgtttttagtctttgaagtttttggagggggttgttgtgcgattctcccccatctcttcacagccccaagtatcttttttttttttttttttttttttgagacgtagtttcgctcttgttgcccaggctggagtgcaatggcgtgatcttggctcactgcaattgccacctcccggcttcaagcaattctcttgcctccgcctcccgagtaggtgggattacaggcacccgccaccacacccggctaatttttgtatttttagtagaacggggtttc

SEQ ID NO: 109554 - DNA, 1009 bp, Homo sapiens
tgacaatgagttgcgacaagacagagttggagaatagaggaggttcagagttggaagaaatgggagtaggtgatggcaacaccgagttgtcagagtgagctgaggcaacatcctctacttctagctcactgatgaaaatatccaggatagcgggtctggggtccagtgccatgggtcacgcctctaatcctagtacttggtggtaggccgaggtgggtggatcacctgaggtcaggagttcaagaccagcctgaccaacatggtgaaacccccgtctttactaaaaatacaaaaaactagcagggcgtggtggcctgtaatcgtagctactccagaggctgaggcaggagaatcccttgaacccaggaggcagaggttgcagggagctgagatcatgtcattgcactccagcctgggtgacaagagcaaatctccgtctcaaaaaaaaaaaaattccagggtaatctgagatcttggtatttagagacatttggttgggatgaggggtcttggtagatttgattctgttatcatttggaaccttccaaagtagaggatgacgcatttgtttttgagctactttctagaaaccagaatttactgtcagagaatataggattttcggttttaaaactttgaacttaaaatgattgcaacagtattttagtgatattctaaaaaatatttaaaaataaaagtttaaaaaagtcgtcagcagattaaaaaaactccaaggagagtaatatttaaatgagtaacatttttgttttcctctgaatgttgttaaaacagacaaggtactattaaatggggggggggggaatgaacgtatttatgggcttttcccttttttaccctttgtttacttgtctgtagattaaagtaggtactttaatcttttgtatctctgggctctgtttcttgtagtgggtatgcttttttttttttttttttttttgagacggagtcttgctccgtcaccaggctggagtgcagtgacacgatctca

SEQ ID NO: 109555 - DNA, 2299 bp, Homo sapiens
gcactttgggaggctgaggtgggtggatcacctgaggtcaggagtttgaggaaaaaattcgcaaggtgtagtggcgggtgcctgtaatcccagctgcggaggctgaggcaggagaatcacttgaacccgggaggcggaggttgcagtgagccaaaatcgcaccactgcactccagcctgggtgaaggagtgaaactccgtctcaaaaaaatttttgctttccggagtggaatccctacttttctccaggcaacactgctctggttgacaactgacaactgctttatcagtcacttcaaatatatatgttaaattttacacaaacgttaacatggattctcactaaaaatccatatggcacaacacagggtatgtatacatgcagaaataactgaagggttatcaggaacttatgcacacacattttctgtactcttcatttaaaaacatgcttttataaacctaaatgaattttattacttaattttattcagtgaatttagaaaatactcgttcaaaggagtatagaattgtacttttctacttttatggatttagagtcagtactcagaaacgtcgacgttctgaatgacagagcatggatgagttacatttattggtgctaatgtctttaggttgtattctgaagctgtatgaggattctgaagttatggtgcctcaattttgtaaggcatacataagaagtaagatacaaatgataaggaattttgattgctcttaaatgtaaatttaagagttttggagggaaaatctgaacagctgtagcttaggaaccctgaatgcttctcataaaggacagtacttagaagaatgaccattatataaagtttcttatatcccattagagaagaagtttggataattatattgttttaaaaaaatttacatgccataacatgttgcctgcatgaagttacactatttgattgaagattaagcattaggcttctttccgtgacagtcttaaattaacatccttgccaatgatgaccactagtcatgtgtttctagcacaggcctctccttgattgagagttatttgttgcctcatctcactaggcagagatccttccttgaaaacaggtctctctcacccatcttgaccctcagcatctggtacagtgcctggcactctttagcctttccattgttgagttgaatcctatgaggctctgactgaggtatacgtttgctagtacagtagactcttgttgcttttgtgagtgattcacatatacaaaactggaaaggagatacatccagtttcacaaattaattgtccttagaacttactgtgttcctgctgtcagagttttcttctttttctgagacaggatcttactctgtcacccaggctggagggcagtggcacggtcatggctcactgcagccctgaactccccgggctcaggtggtcctatcacctcagcctcttgagtatctgggactactacgccaccattcccggctaatttttgtgttttttggtagagatgggggtctcactatgttgcccaggctggtcttgaactcctgggctcaagtgatccacctgctgtagcttcccaaactgctgggattacaataggcatgagccactgggactggctgtgctgtaagaattttgagggtctgcttgataacctggcaccctgctctttggtttttgtcatctgcagaatccttttggcttgaaaacagtgtagaacttgctaggggaaacaaggaatatactcaaaatgtgggtaaaagattcaaagaccttggcctgaccgtagcagttaaacctgaattggggtgttatttgggcttgcccacttcttcctgatatttatgtattctgcagtctctttagacccttcatcatgtgtgtgtttttttttttttttcctaacttgaacccttacgtttacctgatactggcatatgattcttgcctggctttttttctgattcatggtcttgcatacccagtccatacatctactgctgcccttctctttgactgtggttttccctcagaggtcaaaggatgtgtatactctgtgtcctttgtctctttaaaccagttgcacaagtgattctgtggcccagattggttcttccgacctcctcctctcctgatctgctagcatggaatctatcacaatctagcatggggacatcttgtattttcccgtgttttctactgttgagtgtaggctggcagaggcgttctttttttttttttttaagacggagtctggctctgtcactcaggctggagtgtggtggcatgc

SEQ ID NO: 109556 - DNA, 1047 bp, Homo sapiens
ggctgcagtgaactgagattgcgccactgcactccagcctggtcaacaagagcatcaactccgtcacatacacaaaaaaagaaaatggatggttttgcccttttaattctggaatagtagccacagtactgggggaaaacctagtctagttaggaattgtgtcacagtaagttgactttatctggttatatatgtgtcaggtagttaggtataatgatgcttaagattttggactctttttttttttttttttttttttttttttgagatggagtttcactcttgttgcccgggctggagtgcaatggcacatgcttggctcactgaaacctccgtctcctgggttcaagcgattttcctgcttcagcctccccagtagctgggattacaggtgtccgcttacacgcccagctagaactttattttcttaatctgttaggttttttcttcattatttccttagtagtgtacctaagttaagatagtgtttttagatctcactgttttacagcattctgactgcactggagtttcatttgagccattactattaatttattaacattcagtataggatatatgtattatacaatgtaagtgagttttatctaccagaagaatgtctcttaaccatctcccttcagtaaatttttatggtaagactgtgctgtattagttccagccaaccagggtaattgactataaaggcaactaatttggtgttacatccttcttttttttttttttttgagatggagtcttgctctgtctcccagactggctggatgtgatctccgctcactgcaacctccgccccctgggttcaagcgattctcctgccttagcctcccaagtagctgggattacaggtgctggccaccacgcctggctaatttttttgtaattttagtagagatggggtttcaccatgttggctaggctggtcttgaactcttgacttcaggtgatccacccaccttggcctcccaaattgctgggactaacaggcgtgtaccaccacgcccagctaatttttgtatttttagt

SEQ ID NO: 109557 - DNA, 1057 bp, Homo sapiens
cacccatgctggagtgcaatggtgcgatctcggctcactgcaacctctgcctcccgggttcaagcgattcccctacctcagcctcccaagtagctgggattacaggcgcctgtcacttgcctggctaatttcttgtatctttagtagagatggggtttcaccatgttggtcaggctggtctcgaactcctgaccgcccgtctcggcctcccaaagtgctgggattacaggcatgagccaccgtgccaggcaaactctttaaatacaaagggaactctttcaaggtttgggtccagcagaacctagggtctgccttttaggctgtagtgattactttgggtaggtggttttattttatttttcctgaccactttttatctgtgtattcttttccgtattatcagatgctgtctagatagttgtccttagaagttcagttcctctatgagccttatcttatgttcacttcccatttttaaccatacttaatttagcactagtgttcactttgctaatagtcaaaagttctatgtatcaggactatacaggtgctttgacaagtactgtgacagtctgagtgctgatgcctgaatttaacagtgagaaaattgaggctcaggtagtaggggacagagcaggaatttaggcccagtttgtgtgaattctaggccagtgttgttacctagcagtctgtcttctcaatgaatgaatggttgtaggtctggattattaagtttttatttggttgccctgagcaacctttcttattcattttatcttctgtaactactgacagtgtaatttatttaaagtactggtttcatcttgtcagttcccctgctggagaacccataatggattctctttgccaactggattgaatttgtatgcttcagtctggcttttaagaaggttccattctacctattcagctttatttctcactcttagttgggattcttgccggcctctcaaatacggtagtttttgccatactcactactttgcttttgtgcatgctgttgttccctttgtccttcttatagcctagtttcagt

SEQ ID NO: 109558 - DNA, 2783 bp, Homo sapiens
ctattttgtgaaacctcgggcggcaatggaaatctcccctccccgggcgcgtccccggcccgggcgcggcgaccccggccggcgtgctgggggctgcgggcggctgttggggccgcgcgtccggggcgggggcgccggccgggggaggggcgcgcggcagccgggccttgctccgggacgtgtttatttgtaacttagtgctttttatcgtcttaaggaggtatttggtggaggctctttgaagttgggttcaggagtgtagaattggcaaagttattgccagcttcctggtaagttttgggtggcacagagtcacgttattttctgacagtgtaaaggccacgttgtgagggtggtttctcggtaacttcctctttgcaaccgatttaattttttgaacagaagcagacttttatttaagtggaatattaatcttaaatggcagctcgagggaagccatgcatgtgttaacgtgttcagtatttttggaagttcttaatttgctgaaacaggcatcacttcgcagtggcaaccgggattaaatttaggttgtgaaaatggtgtatttcatgtaaaatttgggttgtggcttttaaaaaatgctctctttgttaggttatctaagtgtctctaagataatttggtgattacaaatgagaaatgttggaaactagttaaaaattaggtgttctcagtgtctggagtttacttgaaatcttggactgtgcaggcaccaggggtgaagagttttagtacctatgtgatttacagttgacttaggaaagtttactattcactttcttgttttccaaacaggaaccgtatgctgatctaaacaagcttgttaataaaatgtggggggtgaaaatgccaggttatttttagtttgaattttaagactgaatggttgctctaccccccacctcatataattaagtgatcttccccctccgtttttcctaaaggcttcttcaccagtttggataataaggccctcgtggtgtgttcatctacttacctgaaataacttggaataaataatttcgattacacgttgaagatacaatgagtgactgtttgggttttccagtgtgattcattttcatttttgttaaaataagacccatgctacattgatgtattttagtaatgccgacttcctgggattgtatgttctcaccattttaatagtttatagtctggggaagtagggcacctttgtctccccgaaaacatggtgtgggttgggtggtatcatgggagttgatggcaagcttcccaaatagttgagagttctagaaatagttagcatttacctgtgggggaggggctgcaggaagaaagtatgcctgagagcagttaggcgtgtgatgtgtgattaggcttcttgctcttaaatccaggttttcttgtttggaatatgattttttttttcaaccctatcctgcactgagatgtatgtaatcgcaatcattaaattcataaataactactattttttttgacgtttgagttgttggaatccgacctacaggacaaaatactaaactgtatgggggacgaaaactacgtgcctgggaaaagtttttcttattgctaaggaacttaataaagtgacatgttaatggcataaaaattgttgcaaagctcaccgtcagtttatgacatttttcttttaacgtataccagctttgggtattaatgtgggagacactggtggtaaatggagtgaccccttgcagagatgatatttttgcattggttgcttcaaagaagtgttaagcattttaatacgtatgtctaagaatctttttgatatttgtattctcgacacctaattaaaggttttgcatgattaccatgacaccagtctcccgaaagaattagaggtaactgcttcctgtgttctaggagcctttcaagctaacagaaggtaatataaatataaggggtactgataaaaggaaatgtattaatagaccttttgaacatcaacttgttgattaaatctatcagtgcagtatatatacaaccttgtcagacgagtagctgacaaaggaatctccctagtacaacttgtagcagtactattataaagaattcctgacttgacacattttgatgaagttggttgaaataatttgttgggtttgttcaatttttggtgtcatttatataaaaagaataaagaagaatgtgaatggtaggaagtcaggggagaggcatggcagaaacattggtattcactagaacttgtatttttctagtgcatgtgaattggactcatttcacaaataacatttacagtataagtcactgaaatgcaaaaaaggaaagcagctaacacgagacatttatactttatgctcagacattctggtagtagaggagggctaggaccctagagctgtgtagtaaagaattgttgagtatcgttcagtttaggtaccacgaaggtggtatctcctgctctgccaccaatagaaacttgaagttaaaaagaaaagactctgagagcgctgatgctggagagatttggctgtttacccctctgggattggattcggtaagagtgcaattaattgccctgtaaccatagagccagaggagagggactaggtgctccgggctatgctctaggaggtgtgaggtgctttctatgctgtttataccctaggctaatcctatgaggtagatagtgttgggctttttttgtggatgatgaaacagagatgcaaagaagttaattcccttgttcaaggccacaaaattattaaatgaac

SEQ ID NO: 109559 - DNA, 2150 bp, Homo sapiens
agaatcatctctcatttcactgatggttctttatatgctttttcctttcactcatgggtactataaatatttattatagtcaatgatctatttatataacctttcaattttttattatccagttatctggatgccctctataagacctgctgcttccatgttatcaatcttaaattataatgggaaaagaagatatacccgcaaaatgccttcttacacttggagtcctaaaggtgtcttttccaaggaaagatgggccatccatgctgaaacaagcaaaatacaagtcagtatggaaaatttcttattgtatcttgagtttcaagggggattggtaaggacaacttcacacatactttcagtggccagttgcataaatgtaagtatgtacggaccattgcactggcctcttaactcatctacctgtttccactatgtacccctgaaatctgaatgccagaaagatctttctaaaatgcaaaggatcacgtcgcttaaattcttcttcttttttgtggggggggtggggggggggcgtgtggggcgggcagggacggagtttcgctcttgctgcccaggctggagtgcaatggtgccatcttggctcaccacaaccttcgcctcctgggttcaagcaattctcctgcctcagcctcccgagtagctgagattacaggctcccgccaccacgcccagctgatttttgtatttttggtggagacgggattttgccatgttggccaggctggtcttgaacttccgacctcaggtgatcagctcgccttggcctcccaaagtgctgggattataggtgtgagccactgtgcctggcctttttttttttttttttgagacagaatctcgctctgttgcccaggctggagttcagtggcgcgatcttggctcaccacaatctccgcctcccgggttcaagcgattcttttgcctcagcctcccgagtagctgggactacaggcacgcgccaccacaccaagctaattttttttttttttgagacagagtctcgctctgttgcccaggctggagtgcagtggcacgatctccgctcactgcaagctccgcctcccgggttcacgccattctcctgcctcagcctcccaagtagctgggactataggcgcccatcaccacgcccggctaatttttttgtatttttagtagagacggggtttcaccgtgttagccaggatggtctcgatatcctgacctcgtgatctgcccgcctcggcctcacaaagtgctaggattacaggcgtaagccaccgcgcatggctaatttttgtattttaagtagagacggggtttcgctatgtattttaagtagagacggggtttcgctatgttggccagctggtctccaactcctgacctcgtgatctgcccgcctgggcctcccaaagtgctgggattacaggcgtgagccactgcgcctggcccctcccacttaaaatctttcattggatttccaccgctcttggaaaaacaccaaagtcctcactgtgacctgagaacccccttgggaccctaatcttcctatgcctccctctcctgtgctcactgactgcctctcacatttgtctttcttcaattccttccaaactactatcttcttccttttgaagaacctttacaaaggttatttcttttgcttgaaatagtcttcccttctcatgcctccctcaacttatttaactcctactcaaatgtcacatttttagggaagtaagcctcttcagacttatttgcattccccatcatgcaaatttatatgattacactttttcacagaacttttacagtcgtaattttctgtgcatttgtaagcatatttgattcaagtatggccacaaggctcatgacaggatggacaacgtctattttgctcacaattgtctcttatggcttatgaggggatttaataaatattggttgaataaaatgaataaatgaatgaatgaaatataatttgtaaggtaaggataaaaggcttgttcttagagcctggaattctcttcattgtttaagtctgatgacataacatgaattgggaaatgtattaagaatttccggaattttttttttttgagacggtgtttcactcttgttgcccaggctggagtgcagtggcg

SEQ ID NO: 109560 - DNA, 1002 bp, Homo sapiens
aggatggtagggggaaaaaagaaacacaaaatacattttctagttctttgtctacttgagaagacaagaagtatgcctctgaatccattgagtggcaacaaagcttcaggtagtcgatatgacagtatccggctacgtatttgtctaaggacctttggataactagcagtaggaccttggacaaattacttaacccttctaatgttcagttttcttatctgtaaacttgacataacattatcttgcccacctttcatggttgttgtaagaaccaaagtctaaatgaaacaatgtgtattaatatgccttgtgaattatgaagtgccatacctgacttgaaaactcatttattagatgttattaacctaggcagatataggcccattgttttttggggggccattaataaatccacagatgttgtcaggcttctaactcattcccaaaagcacctgaatgtgaattagctattacaaattattgagcacataactaattctcactgcttacaacaatcctgtaaagttggtattgttatactatttggctaacaagaaaactgcagctccaggtttcagtgactctaattagtaagtgtgagatgatgatctgaaatctatgctctctgacacaggttctgtgttctggcctctgactcccagagtctgattctctgagtctggagtatctgtatatctgttaaaatttttcagtgattttaataggcagctaagctaaggaatcactgctctagcaagctcttggtgacaggagttgtcttgtgaggcaactcagagctctgactgtgagaaaagtcacaatctgcctcctggagcttctactgattggccccaatcctatcctgcagggacacagaggtagcctgaaaagctttcaatgacagtccttcaggcacttatcttcaggggcatctgtttagggaatctgggggccccgttcctaagagtcatattctactagtctttagactccaagtctaaa

SEQ ID NO: 109561 - DNA, 1003 bp, Homo sapiens
tagttaaaaaaatgtacattgacttgataatgatgagcatctttataatcctggacttttaataccatattttttatctcattttatggaactttgtgtactgttaaaaagggtgttaccagctagaaccgccttgcatttgtatagcatcttagaagttataagccgggcacagtggttcatgcctgtaatcccagcactttgggaggctgagatggggggatcacgaagtcaggagatcgagaccatcctggctaacaaggtgaaatcccgtctctactaaaaatacaaaaaagttagctgggcgtggtggtgggcgcctgtagacccagctactcaggaggctgaggcaagagaatggcgtgaacccaggaggaggagcttgtagtgagctgaaattgcaccactgcactccagcctgggagagagagcgagactctgtctcaaaataaagagaagttatggaagaaagacatccagatgatctgatttaacacccaaatactctggaaaatacctctttctcccttcctttctctagaaaagaaaacatagaccttgcatggataggacttaaagtgagtgagtagtaaaattgtagcttgaacttgggtcttctcactctagtgacatgttcatacactactctgcaatatctccactgaaacaatacaatattactgtggaaacttaccaaaggaaaagagaatacatcacctatgttttcttctccagacaaaggaaaggagagagaccttaaagtgtagtgtaattgacattttatgcaaatttagattgtgcaaatttgaaatagtgtgatatattaaaatcactgtatacacaaaattttatataataaaaatctgtgtttttagaaatcaggaaatgtgttatttctgaagtagaaagccaagtgaattataaactgtattatgccatcaccaaatggcaaaataacttatcctttgccaaaatcatgtgaatcttatcattgtatgtatca

SEQ ID NO: 109562 - DNA, 1051 bp, Homo sapiens
cttttccttaacaattactgcatgtcaacaccctttctcctgtcagcataccaaaccctgtacaggaggctggcattgttccaagtagactaaagttgggctttcctcttattacagtcttttaaacccaagggagttgaatgatctttgaacattcctggggattccatttcaagatacttccctacaggctgtggcaatgccacatttaaccttgatccccagaaactaggaatggcctggctttataactcataggtaacagcttgtgtgactctgttctgggcctctaggccacttcagaagtgattaaccctgttatcagaaggcagtgggaagcatttggcttcactatattctgtctccaagtttgattcctttttctttctttttttgcttataaaacctggctgaggaatagttataattttcaggtggaataaactcatgatttttatgttctctcctgtcccacatcaaaaataccattgcaaactggagacataagcaagatttttcagcttctaccatctttatgtccaaatatacatttttctctttaaaaaataacatacagtaaaattgactctttttttggtgtttgattctgtacattttaatacacatagtgtgtcatgtaactatcaccacaatcaggatacactgttctctcaattccctcaaattccctcctgctgtattcaaatctctgccgtttgcccagtacctagcccccggcaaccactgtcctaaagttttcccttgtccagaataacataaatggagtcatagggtatataatcttttttttcagtgtttttttttaaattatactttaagttttagggtacatgtgcacaacgtgccggttagttacatatgtatacatgtgccatgttggtgtgctgctcccattaactcgtcatttagcattaggtatatctcccaatgctatccctccccactccacccaccccacaacaggccccagagtgtgatgttccccttcctgtgtccatgtgttctcattgttcaattcccatctatgagt

SEQ ID NO: 109563 - DNA, 9413 bp, Homo sapiens
tatgacttctttaaaatagaaatgggatcctagtttgggatattcatagtttacttaatagcgtaagagttttctatagcattattatatttagcaatggcatagttttccattgcattcattaccatactttctttaatcctatttttgaatctcttcttccccctaaatttttgcttttataatcactgctgagataaacatattgctattaaatctcagtgtgaaaattcttagtattttcttaggataattcttacaagtagaatttttggattaaagggttagcataagcataagacttctgatataatgcttggaaattaaagtatttttaaaagcgtattcacttttttagagacacagccatttggaatttgggtttggctctacagcaatttttctgacaatggttggaggaatcattttatctttttagatcgaacctgtgtaaaattgtaattttaaaaatccattaacttcacattcacttaaagctaagaatctgtgaattttataatttgaacttagaattacaaattacagtgataattggtcaggttgtcattcacttaatgaatattttgaatatattatttttatctcttgctttagcaggtccttacttcaatccccgctctcggcagagaattccacgtgatctggccatgtgtgttactccaagtggccagttttactgctcaatgtgtaatgttggagctggcgaagagatggaattccggcagcatttagagagcaagcaacataagagcaaggtgtctgaacagcggtacaggaatgagatggagaatctgggatatgtatagtgattatcatattaagatagagcagcttttcctgcctgttgtttgccttttgtcaacttgccctgctttgtggtctttttgatatgagtacattcctctgcttaatgttaatacatgtaacccacagtggtaccatgagatgtcaaaacctgggggcccgggggcggggcggggggaggtgggtgtgaagaacgtgcttcttaggtcataacgcttttgcagggtcaatggtgttgagccgctcatagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaaaaaaaatatatatatatatagatatattttccagcagtttttaggaaacaaaggtgtgtttgattttccaatttagagttacttcattgatagtaacatgcgcttatatcatgatctaaaccataagttcagattgcttgatattttgttttgccagacttttttgataatctgattcttacggtttacttacattttcctctgtcttgccagtctggtggccatcctgaaaaatatcaccacctgctgttttatacacagaggaattttttaaaaagcaaataaagtttcactatcttcgtttccagtagaaatatacacgaactatggttttattctttgtaattcggctttcttgaagatactaacaagtatatgatagatcactttggcatctgataattatatcagtattattatttttgtttttttgcgtttaaaataagaagttgtatgaacccaggaggtggaggttgcagtcagccaagaatcgtgccactgcactccagtctgggcgacagagcaatactccgtctccaaaaaaaaaaaaaaagaagctataatatatatctagattaactaatggagtgctctgtgaatattcattaactacattttatctatttactatattttatatgggtaagaccagtggtcatccgtatttcttttgaaagcccacttgatcaggaagtttatattttaagcagtatgtttgcacaatggtcagttcacatttgattgcttgtattactaattagaggtaaaacttctattttttcttgataattctgtaggcaaaaaaaattggggaaggcaaattacaatcattcttcttctgtaatactttgggacaatttttaaacaactcagacccatgtttaaaaacgagttttgtgtgattaacccttgtatagtatccagttactgtcttctcttgaagtggtggttctttgagaagtagaattattttgtaacttttcttctcccagaaacagaagaatcaaatactattctgttaggattctatctagacctgtgactcttagtataataacccttttattattattattattattattttttcagtaatctataaagtagagttgcttagttttgagcaatttagggcttttcttattggccagtaggttattcattttgctgctaaatataattttttggttaattttaacattatagtgctggccgcttggttctatgattacctaaaaatctagtttttttcctccataggtagatgtgtgtgtatgcatacccccacacacacacgtacatatatgttgtcatagagaggtatttcaacccttatttcaaataacagtagaagatacgaacatgaatttatattttgtaaaaatgtcattcatccactttgttttccattggaaatagttttataagaagggttccccttgctctctccacttaacaatttcattatatacgtagaaaaagcagccgacttaagggcttgatgttttttcaggccttgtggattcaggtttccagtttcccagtgcccttaatggatgttatgaatgcataagcacattttcttttaaagaaagaagttagatttatagtgttatttcttacttgctatatttctttgcactaaaaaagagctatgtgtttgttttataggacactttagtaccgtattgcctacaataactcagtttgctccttaaattccaaactctgggaagttgataaataacttccatgatcacttgtaaaagttacatgcacatctgaaaaaaaatcacaaatctctatgacagtaggttatgttttgagcttgttaccttgcagtattcttctctgttccataggtgaaaacaaagggtgacagaggttatcaggcaggaaatgcctaaatagatacatctctgcatggtacaatttctcatattcatgtattccataaacagtgttttttctctgtttaagcagactgttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagaattcttcttaggtattgagggtaagaagttgtaaagaaagaaaattcgtgtttcaactaaaagattggattgcatatacctttgaagtggttttgtaaaaaaagttcagttactaaactgagtgtgccctgtaatccttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaagaacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattctgttctacgtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggacttttgtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttctgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaattgtttggttatgagttgaagatcaagggaagaaggtaaattgtcatcactgagacgttattttgatgccgattctcgatgactgtgggttctccattcatcagtctgcacacagtctgccatggtcttctggaaatcatgcaagtactgtaagcttttaggttggcagtagaatcaacctagctgcccacactgcccgttctccccatcactggagttagcctgggactggagtgagttctcaattttgttggtagattttaatatttattttcccttcaaattttaagaaagttggccttagtaccataaacactgctggaaataaacacattattaaaaagcatatacccattaatcttttgggggtgttttacatgtaaaatactcttacaaatataatcaatttatatatgcaatataattgagatgtggtcctttaaacagcctggttttctgtatacagtgtacttttgaatttaaatgctcacttaaaaaagtagattataggctgtaagatgctgttatgctttaattaatcaggatgcaagacacatacccttactgttgtgggaaaaattcttcggtctgcacacacaaaaaatgtttctgaatgaagtgaatagatcacactgaatttgtgtgttgtaaagtactcaaggcatcagcacattttattaaatcatctccaggagattcttagctttaaaaaagccatgataatatgcaccaaaaaagtcttaaatgatttcagattttcagcctttttaaaggcatttctgaggctcattc

SEQ ID NO: 109564 - DNA, 1071 bp, Homo sapiens
atgcctccttcagttccccagctgtggctcaggctcactatcaagggaagaatcatgccaagaggctgcggctggcggaagctcagagtaactcattctcgtaggtattgccattttctctgaggccaaagtgttatgtgagattgactgtctttaaagaaaaagagtagaaagggattcttgtttagaagactcactcttttttaaacttcttttctccagggaatcctcagagctgggtcaacggcgggccaggaaagaagggaatgagtttaagatgatgcctaacaggagaaatatgtatacagtacagaataattcaggtatcttgtctgtttccacataccttgggtacattctgtacctagtctcctttgtttttatttcttttaatgataatagatagccctgagaatttggagttagtcagtgttttattgaattagtctagtggcggcctttcaggctggtgtgtatttcaggtctcatttatttactttattgttgtaaataatatattatttattttggttttacactatagtctgtgttttaggatctcttatctttgtccccttatgtttgtttatatttccagctgagaaatgtaaaagacatgataaaaatgggctacttggtttaaagttgtaccatgttaaagaaaagattctaaagcagtgttttttaaccaggctagtgaaacagaattacccaaggagcttttacaaaatgcctgaaccatgacttagagattttcaatgaataaatttggagtaggacccagacatatgtgtgttttgaaaatgcttgcttgatgcttctgatatacacatttagttcacaaacactgatttataggaataaattctgcattttctgattgtcttcagtagggagagtgggctgagtagtccctcaccctcccctctacttcagcctctgattcatgcacatgccagcagaggtcatttacttgaacagtgaaacaaatagaaaacagagctaactgaaaagccagagaagcctactaaaaaaaggacatatagaaagcacaattcaggccaggctcct

SEQ ID NO: 109565 - DNA, 1023 bp, Homo sapiens
tgcgttttttttttttcctgtacatacataacccaggagaaagtttaatttataaattgggctagtaagagaataacaacaataattaattagaaaaaagaacaattataaaaatatactgtcatggaaattatgtgaatgtggtctctctctcaaaatatcttaatatttttggaccacagttgaccatagctaactgaaattgctgaaactgcagataagggtggactgctgtactcattttatttttatttctagggtaaaaatcatggtaagaaactccgaaattactatgcagcaaatagctgtcctcctcctgctagaatgagcaatgtggtcgagcctgcagctactccagttgttccagtccctccgcaggtgagacatgtgtgtcagggtgaagcagcattagggtggaagctgtaatatgcacaaatggttatagatgacatttgtcgtccatgtgtccattagggtacagttgggaaaataatcctgaaagatgctgcttggtacttttaactccttgaactacagtgctggatttaatgcaggctattgttacgtgagtctttatacatttcttaaaattctgggctaaataggccaggtgcggtcactcatgcctgtaatcccagcactttgggaggccgagacgggcgaatcacgaggtcaagagatcgagaccatcatggctaacacggtgaaaccctgtcccaattaaaaatacagaaaattagccaggcgtggtggcgggcacctgtagtcccagctgctcgggaggctgaggcaggagaaaggtgcgaacccgggaggcggagcttgcagtgagctgagattgcaccactgcactccagcctgggcaacagtgcgagactccatctcaaaaaaaaaaaaaaaaaagaaattctgggctaaatgatcctgaatgtctaggctaaccccaaaatgaaaagagagattttcaaacatgtgttcctttattgcagttcatcccatttatttcagattttgccttccagt

SEQ ID NO: 109566 - DNA, 1580 bp, Homo sapiens
aaaaggaccccttggcttttcttgggtaattttgtggatggtggtgccatttacctactgtggatgactagtggtggtggtgatggtggtgatgagaaagttctatggaggaggaatcaaaagttgttttaagttggatatgcctcttaagacgtgaaagtatggatgaccaggaggaagctggatatgtggttctgaaggtcaaagatggagattgatgatttggggagtcaccaacttactcatggtatttgaaagctataggtctgggtagaataacctagagtcagagaataaaagagggctaagggtgcgtccttggacattgtagagtttagaggtctgatagaggaggagaggtggggagggaagaaggagtatagatgatagtaggaggaatgtttcaagaaggaaatgaactgtgtcatgctactttgagttccagtaagatgaaggcacatatgtgaccactggatttgactctggagttcactgtgaccatggtaaaagcacctttagggtattgaagtgaggagaagatggatcttagttcattactctatttagctgcttaggtatctgtctcctcctctatgtgctagtccttagtttatttctagggcttagcatataaatagatggtgaataaatgtttgcctgcaggtttgagttttacaatgcagtttaaagaataatatactgttttacccttatttagaatgcttttgtactattgacccttgccactagtttgtgtcagttcaaggaatataatcatgtgactaataaaacgtgatgagaaaggcaagttgatgttagtagaggttcctagtgcatcttgaagccatcatgctgtagtggaaaagggccattctttgatttggaaggcctgtctcaggctttggctgtgctatttagcccttgagaagggagctgggggcaagctccttacagtctctggattgcagttccttggctgtcataaatggacaatattaacaaattcctcttacaagatttttgtgagcagcaaatgaataaatgcaatgaacatcctttgtaagtaaaaagatactctgtaagggcaattttaaaagaataattggattatccatttcattactaacttataaagtacattagatcagagtgtcatgaaattcatatttatctgtggcatataaatggcaagaagttgggtgaggacataagtcactggaaaatgtgatacttcttttttttttttcctaaaatcccatattcttttcttttcttttctttctttccttttttttaaaatttttttagtatttattgatcattcttgggtgtttctcggagagggggatttggcagggtcataggacaatagtggagggaaggtcagcagataaacacgtgaacagaggtctctggttttcctaggcagagggccctgccgccttccgccttccgcagtgtttgtgtctctgggtacttgagattagggagtggtgatgactcttaacgagtatgctgccttcaagcatctgtttaacaaagcacatcttgcaccgcccttaatccatttaacccttagt

SEQ ID NO: 109567 - DNA, 5621 bp, Homo sapiens
acatttgtttttttcttttattttacatttttgcgtatgttctaaactatgtagttgacaagattagtaattatacttaatttcagtttcctcagtgatacagtgaataaataaattagaaaatataagaaaagggaaatacaatttaggtaaatttctcaaaaatcagaatttttaagtggaaaggttgaaggagaacaggatgtaatgggacaatttaagcagctaaaaaccagggtaaagatgggaaagaaaagaggcaagcaagtaatcagaaagtaggagcttacagaaaatgaaaagtttgggtataataaagtatattgctaagacttcagaagcaaagattcgaatgagactgatgttattggtaactcttaaagagagaaggttttaacagacaactaaggcaaagcagttcatgtgtaaaaatacagagcaattatgttagggtaacatagaagaaaggtaatcttagaagtgaaatctggatttcaataagatagaaatggtcaagatgagagtggatagtgcaaagtgtagatcagaataataaacagagtgtgaacataactctagaagtgggtgagctaccaaagaaggaaagcgtagaaatgttagccaaaaagatgcatcagagggtgtacatgaataagcagtaataaaagaaagattactgaagacaaggctaagaccaggccaggtgtggtgcctcacacctgtaattctagcactttgggaggctgaggcgggaagatagtttgcgttcaggagttcaagaccagcatggacagcataacaagaccctgtctctacaaaaatacaaggaaattagctgggcatagtggcagacacttgtagtcccagctactcgtgaggctgagacaggaggctcacttgagcctgggagattgaggcagcagtgagctataatcatgccactgcactccagcaaacaaagacaacaacaaaaaacacacaaaaaagagaaggataagaccaatgagtaaggcttaccaagcacaggaataagtagaatgccaatgattgtagactaataaagtggtttaggattaaatgagatgatggatgtaaaattttatttcaagactaaaaacttactaatttttaatacagagcattaccaagctgtaccttcattatttcagttatgtgtgagataaaatgggtcacgggtagcctgtttatgagctagaaacacatttgtgtgaagtgataaatcactgtgattacattactcaaaactttttagtcagttgatgccattgttgaaatcgtggagtttcaaattgcctcgggtattgtaaacaatggtggttacactagagccggactgtatcatgtgccagtaatccaggacacgcagtggaaactgcccaataaatacttccctttaagctcactagcattttttcctgacatcccagtgttcccaagctggggctaccttagcagtgacccatgtgtatctgtagtcatcacagatttagttttattccaaggacttttaaaaactggtcagttggcttcaaaacatcattagctattgttttatttttaatgaagccatcaaatattatattcttaaaattagggctttggatataacttaatttaaaatccaatctttggaggagaaacatattttcattttattaaagtctatctgcaggcttcaggttacttagggcaaggctggcatggggtaacataccactgtttcatcagcataaatgcccagaggaagaattgctttagcagggaaggttattaacagaaataaagaaaagcaaaaagcacggatgaattttgctaaggcatccacagtttaaagtcaccagtttatttgctaatttgcatgtatatatttaaaaagatctacttactcaaagtacatttataaaatttgtcataaacatggctttctatttgtaatagttagtggccagatagcaacctaccatgaattagattgattagagaaagagaacacaggtgaaagaatagttttagaattaggatgctgagtgtagtggtcttaattcataattcataatgaagagaatgctattagatttttcccaaaatttaaagcactgattttggcacttacattttaatattgatcacccaggtttggatcactgaattaaatctcagctaattttcatgtattcaaaattctcctatctgatttttttccaaatggacttgcagtggactgagaatggccaaaacacacttcagatttggttttaatgcatgtgctttacacgtggcatatatgctttggaatctaacaactttgggctaggatcttggctcagttactttaggcaagacactgaatctctctttattcaatatctgtaaagtaggggtcattgtacttcctctgcaggattgtgagacttgcatatgttatcttaataaatgctggttgattgaaataggttgctattgtttagaagtgtttgggtctcaaatgagcagaatgagatggcacacagctgtcttactgttgttactaccttgatagtaacttgctgtaggaccttgtgtaaataagcaaaactttgttttccttgattgttctcccgagatagtcttttagatccagataccaggttaccttaaaagattctcatgaagaataattcaaccaacaaatgaggcaaaataaaatgattttcaaatgtaaatatgctttcaaccatactactcgtctgtcagcttagtccatttacccaataatcaatccttgttggttttcttgttctgctctctgaaatcgccagctctgtaggcttttctagctcttgctttgatcactttagaggacagaagctctctgtgatcctgccagttttttgcctcctcctctagtctacccctacctcatttcttcttatttcgaaatgatagataccctttcttttgtccaagtttgattcctcatcctgttttctggatttcatcaccttttcacctcaatcaaaaactatgcccaagtcttttctatataaataaaaatagcagcagcaaccttctgtttacttttaatcccttctattagcaacctttctcctctcctctcctgtccttagcattctgcaggtagaattgttctcttcaggtctttatttcccattcattcctcagcccactgtactctgatttccattcctataggccgctgaaatggtcctttccattgtcaccatgatcttacaggccaaatctaactccttctcacttgacccctttgtagcattagccaatggtaacaactttctcctaaaaaaatttaaaaatatttttatttaaaataatgcctgaggaaccaaaggatttataatgaaaagtagtaatcacctgttctccacccattccctaccttttttttcctctccattctcttctcctttctgactcccaacttgagctggctatagttttactttgacactgtcaagattgatcacatttttatccattctgtcatcaaattaagttttccatgctctatttgcaggttgatgccaattgttgaaaattaacattgagtttttgcattattgtgaatagggaattttgcactattatgagtggggaaatattgttcactgcagagctgtttccttccctgtatttccagtgtcatgatcccatgctactcacaagagatgttcaaataggtaaccctttcctgaatgccaccagttgctcaaaattgtgtctattttagtttgcttcatatgtggattataactttgaaataactttttgtttttccttgagtttctggtacttaaaaaaaaaactagagagaagaatcttaagcctttcaaaaaaggtattagcatctcaatctttctttatattgcttacaacccatttcatttatcttcatgaaacccactgttttctgattctgattttgactagttgttctaatttggattagttgttccatatttgaatcactacttcattgtgtaggttttgtatttcccggagattttagttgcttttcttctcccctctttttcttgcattatatttttcatattatcgttctcccctccatccctaaatctcaaccccactatttattgtatggaattttccttttatcctagatccctctatctccttgctccattttcagctggagtctgttgggtttgctgcacagctttgtcagctttggacttaccactctttaggtgggatcactattttctaaatatatgttttcttttttaaatcttgttttgttggagtatattgtcacattaaggaagaaagaatgaatataaatgtacaacactttttttttttcttgaaataaaatgggggagtaatgggaaataatttttttgagcccttgcgtttctaaaaaatgtttgcattgtgccttcatgtttgacagttcagttccaggttgaaaattatttttctttggaatgttaacagctgccctctattttctgtttttatctaatgttgctgaagagaaatcttctgattcttattctttttttggtgacctgttttaattttgtgtctttcttttttttcccctggaagcttttaggctctcccttttatccttgtagtctgagatctgacaatgatggttgtgtctagttttccccaggatactttttcatttgtcctggtcagcactagtagatcctttcagtttgtgtacttctgtttctcttgctctggagaatttaaaaaatatatatatttttgagacagagtctcactctgtcacccaggttagagggcagtggtgtagtctcaactcactgcaacttctgcctcctgtgtttaagcgattctcctgtctcagccacctgagtagctgggattacaggtgcctgccaccacgcccagctaatttttttgtatttttagtagaggcagggtttcaccacgttgcccaggctggtgtcgaactcctgacctcagatggtccacctgccttggtctcccaaaaaaaaaaaatattctttcttagtcactattctccagatttttttgtctttccttctaggaatcctgttagctattgtcatggttctgcttgattgattcttttttatttttctagctttattgaagtataattgatggatagatactttatattgtttgtctctgctatcttttatcattctttttttgttttaatttgagacatgttcttgacttctaatctcatattgaattttttttttgcagttgcaagatttaatagagtgaaatagagtgaaaacaagagctcccatacaaagggaggggacccaaagagggtagctgttgctggctcgaatgcctgggtttatatcccgatcattgtccctcccactgtgctctcaggcaatagatgattggctatttcttcacctcctgttttgcctaattagcattttagtgagctctcttactggtcgggtgtgagctaagttgcaagccctgtgtttaaaggtggacacggtcaccttcccagctaggcttagggattcttagtcgacctaggaaatccagctagtcctgtctctcagtcccccctctcaacaggaaaa

SEQ ID NO: 109568 - DNA, 1366 bp, Homo sapiens
ggaagatatgtttgctaagatttttagctggtggtcttttttttttttgagtcacagtcttgctctgtcacccaggctggagtgcaatggcacgatctcggctcacgaccacctctgcctccccggttcaagcgattctcctgcctcagcctcctgagtagctgggattacaggcactcgccaccacacctggctaatttttgtatttttagtagagacggggtttcaccatgttgtcttgaacaggctggtctcgaactcctgacctcaggtgatctgcccaccttggcctcccaaaatgctgggattacaggcgtgagccaccacacctggacagctcgtggtgtttttgtctgtgcatgattatcattaagagtgtttaagtgtaagtgtgcctgagggaaggggtctggactaggtgacatttgatgtccatttcagccatgtgacttttagatttagccgtggatgcaatgctgttaatgttcacgggccaaagggatagcagttggaactgtgccaagcaaaataaagccaaatctataaagccattctcagtggaagagcaccgtgttaacatgaattaacaggcaggggaagtctgctaaatgaggccaaaggaaagaagtcccaaagatgggtttggagaagtagaagaaagggtcagattatgttgtcatttacatgttatcttgctgaagtctgattttcaagtgagtttttttttctgtttttttgctgttgattcagatttgaagaccttgcttctcatcacccactggattatgccccaggcttccctacccaatgatcctcttgcaacacgccgtgcttcctccacctaagcagccctcaccctcgcctcctatgtcagtggccaccaggtctacaggaaccttgcagcttccaccacagaagccttttgggcaggaggcttccttgcctcttgcaggggaagaagagttatcgaagggaggggagcaagactgtgccctggaggagctatgtaagcccctgtactgcaaactctgcaatgtcaccttgaactctgcacagcaagcccaggctcattatcaggtaaagggagaaaagaaaaccaggcattgagtagggtgaacatttcagggctctggctatttagcagttgtctctccagatatgactgtgcctggaataccaagatggcttagagaacaactaactatgaatttgtttgattaaaagccttatgtttttactttaaaaataagtatcactttttgtagactggatctcaacctgttacactaagctgtgtggcatgcgatagcttaccagtctttgtaggcaaatgtaaatgatctatgctggcatctgaacctgtagt

SEQ ID NO: 109569 - DNA, 1022 bp, Homo sapiens
tgtgattaatgagaagtattgttaaattctatgactaatacttatgcactttgtccttaactacattattttcccatcacgctgatttcctttgttgcctccccaccccaaatttcgtctgaaagttgttacttgattttcaggtgctgtgtagttatcaaatatggtaaaatagactttaacttttcaaaatttacttgattcattttagtaattctattattgccataatgtacacatttccattgcagatggaaaatttcagcagcttaaaatagccatattctattgaccaagagaagaggttttaataatactgtattgagagagtggagggaattgtggattttgaaataaggattctaatttgggttaattagaatcttgggaactcaaagggtgtactgtggttcattttgagacactcagggttagacggcgccatctgggggggaggcaggagacattatggataaagattgaagagggagaggaacattttgggtcttttctgagggaattataatagagactatcagttatttgttaagaaggaggagggaaatagcctcaagattgaggaactggaattatactgtggcttatggtggtgtgatccattactccattggacatttccttgataccttattttgtgtaggtaatttacctagagaaggaggaaaaatttgggttttacaggggctgatgaatataatctaaggctgtatgaggcagggctgtaaactcaagagctcacagagaacaggcaagtaacaagtacaggcagcagctgagtggggactgaggtgtcccagagaaggcaggcctcgctagagggcacagtgcctctgagcactaactagctaattgcgtcccatataggaatgtgggccaagtgatgccagatcatcctttttcaagagaagccatgaatctcttgatttttaaatgctaacaactaattcgacttaaaaaaatgaaaacaaaactgtatattccaaacagcacatctgtggctg

SEQ ID NO: 109570 - DNA, 2371 bp, Homo sapiens
gtggggagagcagcagtttaaaggttctgttgcagcagtttaaaggatccactcagccgccttaaccgccaaccagcaggctaagggaggaacagaatgaacaatgtttggatcccaatgactggagatgaaagttgcaaaagctctgcccaggcttctaccaaggattaactttccagggcatctgctgaactgctcttcggggctgtctgctgagattggcggcgggaccctcccgcctctcactcgtgcctttgttccccacgccggcctaaccccgcgcccctgcgctcgcggccagggcacctgacccacgcgccgcccgccggggatgcgggagccgccactgctaccgctgccaccgctgccgggcctgctccgccaagcacatgcgcagtggcgacgccgagccggcgccctcagtctcctcctccaccgcctcccggttccgcagtcacttcctgcagctgtttccctgtgggtcgggttggactgacttttgacagtcagccttcggctgcggagggggctcggcggcggccggcggagaaagttgctccgagaagaggctgggtcgagctgggccgagccgggcgcgcagggcgggcgtcgcgggcgtcccgggcggacgcggcgcggagactgccggcgcgtcccgggggttccggtaagtgcgggcgattgggagccgcggagctttcaggacgagcccctggagcgccggggactagcggttcctttccgatgctctttccatctgccctccacgtgacagggcttgcgctgcttctatttatcagtttgcttgtttcaggcatttcacgtggaccaggtggatcatctgtgcgtgcagctgccttggccctctcagttgcccccgccccgtgggagtcgggggattccatccttcgtgatggcatccataccgggttgaggtgcgtgtgtgggttcgtgtgtatgcatgcacatcttaggaatgtaaggtggatgtgggcgacgctgaactgtctgtagctttgattcaaatctgtaaacagttctctaggattaggaaccgtcacagcggagactgaaaaacattcgccaattcaccaaggcctcttccccagttttctgcgttcttttgagccttctttataggatacaccttgcctcaagtgattattattattattttttttaacttttctccctctcattccttcttgctgcgttctgatgacctctgagtaatgctcgctgcctttccctcatttccagaattcccaattacagacttacctagtttgctgaggtgctcctaacctgttcctttattctattctctttcctctgtagatttctccaaatgagacaagagattgtctttaacacagtatgtgaagagtaggccccagtccaatcattaaaactaagtatgctatgacaattaattttctttaaacagggtaccttgtgaagctttgattttctttaatgtcgtcttagctcctttccaaaccaggacattaaccagcataaatccttcatttatgccatcgcaagcatcaaagtgactggtttttaagatttgaagaatatttatgccagtcttcaaattagtcccttttaaaccaatgcaacagttgaacagatctgagttgcatgttttgggtctctgtattccatcattcatgcattcactgaagacttggttttattcattttaagatttatattttatactaatttttgtttgcaaatgtactaatatttgatgcaattgtcatacatagatttttttgaggagtcgacattgtgttgattgttaaatataacaagaaataaatttgggatatcaagctactctttaaaaattgtaaagatcaaatgtgataatgggtaaatctgtgtttggcaagaattttttctttaaatcaggtaactgtcacctctggtaggaggccttttgtgcctctgttctttgagaaggatctttattttgagggaaacctgtagataacactgggggagacacatgctagaatttcctcaagtgaaagtgagctttcataaaacaagtccagacatgcctaggcaattggtagcatttgattttctgtttatattgctgatttcctttatccagaggttttgacacccccccccaccttttcactaatgaactagcagaatgtttgtggcaatttgacatcagtagcttttcaacattatgaattattattattaggtagttaaactttttaaaagctgttctttgtctacttagttccgttttctaaaatgaccatatctgtctttgctttctggactatctttgcttgattcaattaagagaaataataccattacagagaacctgactttttaa

SEQ ID NO: 109571 - DNA, 1272 bp, Homo sapiens
tatgtgctggattgcgtgttttaagaaaacttctggaaaatactcaaaataccgtgttgctaagttagtttggataaatcaaaacactttgctttcaaagcaactacagtcttaacaatttaacgtgtctttgtattcaggttttaagtttttggtgttttttttttttccttttaactgaagcactgaggtccgattgacagcatagatctccatctaaacatcacatgttctggaaatttttaattatcagattaactgttctgcagtgtcatcagccaaaattatctgaagaggactgtgtgtgtttacgtgtgtgtgtgtgtgtgtgtgtgtgtgtgtgttggtattttgcttaagttttttcatctcacattttgggacaaaataaaacttcatagcttttttcaaaagtttcttgtgctttttcaaactagagtactttcctattaaaatcacaaaatagtttatttaaaaatgatagcatatcgtaataatagcatcatgggggaaataacaagaaagtaaaggaatattaatattgcatgattgtgcgtataaagttttaaagacattcctgtcagttttaaataattaaaaatgaaacacctgtaaatatagaagagtgtttttatttaaggttaaaaaaatttaactaaattggttatagcattaaagagatgttactaaatacaaatattgtacttaaactgaaaaatggcttcatggaagtgtaaattgtcatgggccttgatatatttaaaagggagactaaaagtgcagtggttttgcttgctctgtgcgtggaacagcctttctggtggcagagcttccttcctgtcaggataaggtcctctccatcccaaatcagtatccccttaaaaaaccaaagaaaaaacccaaacttataaataatgcacaacataaagtagactgtaataactttttctctaaaccagtttactttgtgtgccgcttcttataagtaccctttactgaataaagagttttaaacagttacgattaccatttaaagggcacttgctctgttgatctgtttatttgaagagaggtaacttaatcccatttgatctcttgagcagctacagtagcattaaaaggatcagttctctattttgttattttatatcttgaattccaagataggggtgattctttaaatgaagtgtttcttaagcattataaaatatttcatctccagtgaaagtatttacaatcttaaaaattattcagctttagaagtatatgtct

SEQ ID NO: 109572 - DNA, 1106 bp, Homo sapiens
taggttacagagaggctgtgtgctgtggtgaaaaaaaattcgatcacgaatcagaaaacacggtttttccattcatctattaactagctgtttggcctaagatcttggcctttcagagcttgtttcttcacctgcaaaatttctaatacaactcccaaatgctgagattcctagtatgttaaagcctgtttttttatttcagggaagagtaagtaaatcactccctagagagaagacagtctagctcagtttgttgtattttcagaagctaagatcattttgtctgcctgtttataaatttgcacatattttaaaggtccttgtgtgaaattctgtggcagagaaaagctgccattggaaaagaatggagtggaaggattttccccccttttttgaaaccgttagtgactttggagaataaattgctacaggtgtggtcaaaattttggttactggcactgggagcaattaaatgactgccagacattgagagtaggtcatctactgcacaccagttgccagggttataaaggccagcagacttgtcacagcacccttaatagccactggccatcatccttacttgttaaagacttctaggaaagtatattccatatttcccttggtaactcatccctctaggtggttttcagaaaatgtgttctaatcttagaaacataaatctgtaggcatggtaagcctcttttttctaggtctatcctcagttgtgcagataagtatgtggaaagataacagaaatcattgtatttgatcagaaagcagtgatgtttatgctattgatttattgtttttttctgttaatattcaaattaccttcaacttttgaatattttttaaccagcacactgctcaggtaatgagatattatttagagttattttgaggatgtactcatttttcaacaagctaagcatatttctgcagcttgtttttctttgagagttcttgcttttccaagttctttttcctgatggacttatggcaggtctagacctgaaagtactattgtatttcaaaacaactgactgcctttagccccacagtgactgaactgtatttttttcttaggaggttaatgtctttgg

SEQ ID NO: 109573 - DNA, 1105 bp, Homo sapiens
attatttgcagttgagaccatgataggcagcatcttatggtatttatgaaagtgatatttgtgttcttttttctaactatataccaattgtaaaagttgaacatgactttttcaaagcagtttctatacttgataataacagtggtagtaaaactcagaacagtttaaaatattagtaattttacagtgtagagacttttcttcactagaaatgaccagctttcagatttcttagtgatattatgagactctagatttcttcaaaatcattttgagtaaatctaccagtgtataactgctaaagcacagttaaatgtatcatgctgtggtcttttttgtttgtttgtttggtataaatatcagacatatatgtttgtttactctaaaactaattttttttaccaatcaaaattgaggcacgtaatctgacaatgggacaggatatttgcagtcaggatagtcttagaaaagccacaaaatatggtcgatgtacttagacttctttaattttccttgccttttcctaaatatatctcataatgattaagagcatgttctctagagtcagactatcgagattactagttttgtaactttgggaaagttatttaacctgctaaatattctccgggtaatacgtatttcttcatttgtaaatgaggggtaataactacctacatcacaatgttgtaatgaggattaaataaataatacttgaaagcatttagtaaagtgtgttgtacatagtaagcactcagtaagtatctgtgaactccttgagagtaagaaccatgttacattcatccatttatttgggtgctttaacattatgaagtgaattgaattctgtcccttccaagaatttaccagtggatccgatttctggatagtgggcaataaggttgccttcaaacaagtttagagtagttttcagttctttacaatactgcttgctttttattcgttaaaacttttaaaatttcattctagctctaggaatctgaatgctatttcatacctactcctaagggaagttagcatatggatatttagtttaataggaatgaggaattaatggacagaaggtattaagtaagtgaatgta

SEQ ID NO: 109574 - DNA, 1017 bp, Homo sapiens
atatggaggtttcttcagaaattatctgcgatttttgttgtaattgttttcattgttgtgtgcttttaaagaatgacttttattaagcatgcttccaagcttttttgtacatgaaaaactgcatataattttgtctcttttagggggtgatatgtacaatgaaaaaataacatgacattggattgccctggggctgaccaagagtttgtttccatagtaagggattatgactaatttaggcattgaagttaagaatttattacttatttttaaatgacatcacgaagagttacagctgaaacccatggaagaagttttcttgatttttctatatgtacacacaaatgtgtattttgaattcccataaacccaaactttaatataaacctgaggagggggagcattatggactttgtatatgctgcctcccttaatcctcacaataacacttctgatacatgtgtaatcacttcatttccatgattaggaaaatgaagtcccacatcaaattaatacagtagaatctcacctcatttattttacatgaaatcaactgtacctactcagtcaaacataaaaacgtgacaaaaataatacagtcatgtgtagctttacagtggcaatatgttgtgagaaatgcatcattagatgatttcatcattgtgcagacaccacagagtgtaccgacacaaacttagatggtatagcttactaaacacctatgctatctggtacagcctgttactcctgggctacaaacctgtacagtatattactatactgaataccataggaaaatgtaacacagtggtatttgtatatataaatatatctaaacatagaaaaggtacagtaaaatacggtgtaaaaaattttaaaaatggtatgcatgtataaagccttaccgtaagtgaagcttgcaagactagaagttactctgggtgagttggtgagtgagtggtgagtgaatgtgaaggcccacgacattactacacactaccgtagacttgatgaaca

SEQ ID NO: 109575 - DNA, 2099 bp, Homo sapiens
cttctttaaaaaaaaaaaagtgagaaattagcaaggtaatttttaattttgtctgagaaactataaacagataaaagtaaggtatcttttgagtggaaaatgaaggacagagcgctaaccctgtagcttattagctatcaaaatatacaatacaattagagtaaatgaaagagttgaatactggcatacacattgatagtaaaattggtaaaagggaatagagatcccagaaacactctaaatatgataaagaagtaatcagaaattaggagaaaaaggaaaactaagatttgtttttgagagtattaaatacttaggaaaatagacttttgaatctttatttcatcttacataccaaaataaagtctaggtaagttgaagagttaattggaaaagagtaaacttatgcctagtgtcattttaaaaagacatttatgtgaatggggaaatactttccaaagcttcaagaattgtaagtactcaaaaggaggaacaatcattcgttcgactctcaaataagattggggcatggcaatgtgccccctctagtccaagctactcaggagactgaggcaggaagactgcttgacccccggagtttaaatgcagcctgctagcaagactccctatctttaaaaaaacaaaaaaagaaaaaaatctctttctctcacctcctctccccccaacccccatacaagtgaacaaattaaaagatgtgcagaccaggattagagttctgcaaaaattcaatagatgtttgtctttaaatttttactacaaatactttcaaaagcaccatgacccatatggatgaatgagcaaagaatttgagaagttgggctcatttactaaagaggaaatgcaggtacaagcataagggacatgtttttccctgacaggtaattgaagaagtgaaattttaatatgtagtgatttttttttttttactttttgagttagcagaagtatttttctaatgatgtttttgctggtgagggtgccatgcaatgtgcttgtccatttatttccattgacagtctgaattggtttaaccctttcgaaaagcacgtgaacaatttgcatgcctttaaaatcaacatacagtttgacccaataattctctttgcagcattagatataataatttacaacagcttatgtatttaacaactaaactgtttaacatctcccgtggaaataggttgtcatagaaaatgtttatgaagagtttacaataatttgcggaaatgtttttgtagtgaaaaaagatacaaaattatgtatactatatgagtacaagtatacaaaactatagaaaacaaagaaataaaccaaaaatatccagacaaaactgtaagagaatacataaaagatgctaatatggtgtcttaggtacgttttcttttggtttcatcattcatctgtgcaccgctatatttccgatacttacagagcacaatcccaggcccataatagacctttcagtcagtgcttaagtgaataaatttctgtaataaacatgggattcatttacattgaaagaaatatgaatacactttccatccaagttaagaaaaggaaaaatgtgggaagcactctagaaaggaaactgattaataccttacaattagattttgttttcagaatgttttcacatctctattttatgcgatccttttctgttctaatttaataatatcattacttacctaagttagaaatttgtgctaaccggctgggcgtggtgcctcatgcctgtaatcccagcactttgggaggccaaggcgggtggataacctgaggtcaggagttcaagaccaagcctgaccaacatggcaaaaccccgtctctactaaaaaatataaaattagccaggcatggtggcgcatacctgtaattccagctactcagaaggctgaggcagaagaatcacttgaacccaggaggcggaggtagcagtgagccaagattgcgccattgtactccagcctgggcaacaagagtgaaactctgtcttaaaaaaaaaaagaaaaagaaaaaagaaatttctgctaaccttgattctatcccttttgacctgccaaatccaactgattacc

SEQ ID NO: 109576 - DNA, 1045 bp, Homo sapiens
acagattgctggatattaagccatttgtctctcactttcacatctaaccttctttactctgctttgtaatgcttatttatttctcttgcagaaagcatgttatagtgccttatgggatgtctacaaatatttgtttaatcaaattgagctaatatttatgtaggaaacattttattctgcaacaattaaggcaaacagatatatgtgtgtaagtattcacatgggtttccactgtagttttgaaagctcagtttccaaagtttagatgtgtttagccttactgtagacttcactcttaaggtgttgatggaaatcaacaaccagctgcaaaattcagatccagtatgccataggatacatgtagccacggtttaaaccaaatgttagcaatgaaatatttagtagcaactgttcttttaaaagaaacattttagataattagagtcgtcttgtaatatcttatacccagctgtcagctttttactttttctgccaatatttctggaactgaaaccaagaaaatggaaattagggcaccacactttgaaatgtattaaacacttgaaaaactgttatatcttataggatttccaaaaagagttcttcagtgcctcagaagatttttataaaaagcaattatctacaataaccctccccagtattaagctgaaatatacacataccttagtaaataataggagcatttgggaagtggaagaattgcctcttaatagctactggacttgaagattattaaatttgagcattctaattccatttttgaaagtttctgatattgtttcttaattttgttaccatgtttaatcagtatctcactagcctttcattcatttctttagcttctgttactatctttctacttttaagatactcatatcttcattttctgccacatcaactttcagtaatattcctgattcctcactatgttagacagtgataatagtgtctcattcttcctttcaagtctttcccacccttctacaaaatgttatatataattactttttaaattgtcaagtat

SEQ ID NO: 109577 - DNA, 1237 bp, Homo sapiens
ttgtttagaaatgattggtgacacaaaggtctgtactctgatattttaagatccgaagtgtattctaccccttttttataaactattttgcagctgttccttcacgactttgctacatcttggagatcttttcatgtcagtacctacaagtctatatcattgatattatcagctatatagtactccataaaatgctttattataatttatgtaatcatcttcctattgatgaagattttggtggtttctagtttttgctttcatgaatattgttgcaatgaatattgtttggcttacttttgggtgaatttttacaaagacatccatataataagttcccagtagtggggttgcctaatctaagaataagtgtatttaaaatttgaatcatattgtcagactgtctcccagaaagtttacattcctaccaacaatctgagagagctgtctttgcagttactaggtttcatcaaacttgtttttttcagtatggtaggtttaaaaatggggatacatttttgtttttatttgcatttttaaatattttcttaggttagttggctacttaaatttctttttctgaaaactttgtatttatagccttttaaaattcttattgacttgcctgaactatttgtaaattacagaaattagccctttgtcgtatgtgttgcaggtgcttttccagtttgccagtggtcattcattttggtttatggtacttttgatagaccagaatctttgacttttatttagtgagatttatccatctttttctgtgtggcatcttggtattatagcattaatattctcttttcttttttttttttttttttgagatggagtctcactctgtcgcccaggctggcgtgcagtggcctggtctccactcactgcaacctccgcctcctcgtttcaagtgattctcctgcctcagcctcctgagtagctgggattacaggcatctgccaccacacccagctaatttttgaatttttagtagagatggggtttcatcatgttggtcaggctggtctcaaactcctgatctcaggtgatccgcccgccttggcctcccaaagtgctggaattacaggcatgagccaccacgcccaggctatagtttttctttatctgaacaataactaattataaagtatagtggaagagaaaaacccattcagaaaattaacaaaaagatcacttatctagaaataaacttaaaccatagcagagc

SEQ ID NO: 109578 - DNA, 1133 bp, Homo sapiens
atttctttacctttgtaacttttaattaatgaagatgttttaagatgaaatataaaatgtgaacctgagaactgtttaacatttaacattatggatatacatatccatgtttagaatgttctctgtgtattaatgcatgattttgtcataaataccccactaggaagagaaaggtcggagagagtgtgtgtgtctctatgtgtgtgtatttgtgtgttttgtcctggcaaaaagacaaactgagagaacagaagaacaaaagagcagtactgaaaatagctagattaaaggttgtttttctgtcaccacacaccagatatggagagtagtaaaagcagacagatggacagttctgttagttttggagtgtgtgaatagagaaaagaaacattctgttccttttattcagaaaaggaatttctagactaaattactggtatcagcaataagtttcatattctgaccaaagaaacattattttttttttaccctagggataatgactcatgctgttctcagaattttgcttttgtggaaactaaagtgcagtcataaatacggcactgttatttagatcttagtgctaatgatactattgtgagtagactagtgatgggtaagaacactagtattataaacccagttgtaacaaagaaaccaagcacatcttaattagctgattctagatgggaaagtagattttttaaacaaattaactaattgttttaattctgtgaattatgcaatagaaataggacccataattttatttttttaatacttcattattttgaggggtttatgtcagaagttaaatttctaacttccaatattgacagtggagataattaaacatattttctctgccttttttccttatgttcctcaaaattagtataagtctactaaatcatagtcacatacaccataaagcacctatcaaaagagtatcagctaggtgaagttcaaagattatattctagttttattttaacctttaaagtcttgtaatttaagaaatagaggtttgaatgtcttctttatataccatagtactagatgctctcactctgaatttttaccatgtcaggatactccatcacatatttatctctgtaattataattattggg

SEQ ID NO: 109579 - DNA, 1068 bp, Homo sapiens
gtcagggacctaagtatttatatggcaaacaaggatactcagtacatctagagccagactttttccagtgtctaatccttgttgtatattaaatactttgggaactaaaatatgttttatgacactgtgttaactgatgcataattatgtaatggaagccattagggcctgtgtcttggcaggaattaaactaaaagcaaggtccttctagtatttttggtagaagattattggctagtgcctattttcacagcacatactactaaaattaggaggacgacagaagacgagcattgcccctccctgtgcaaaattgatagacacattcaagaagtattccatatttttaagctaatctttttatttgattcacttaccagcaggctgttttcctgctgcaaagcaaattggtggagtccatttacaccttctccttagcctataagtattggcagaatcaccaccacgatcacagcagcacagtccagacagtgtcatttgattttgaaaatattgtccttgcaacagccagctaggacaatgacatactaatatctgctttgcttattatttgtgcctgggagtatgtaatcatagtcaacagacaccatagctacagttttatgacacttggtctcaggaaatagagaactctacagaagacagtagaccatgatgaagctttatcattagtccctggttctctcccctccagatcactttggccttctgacagacagtacagataaatctgttaagtttggaatgttgaattggtcaaaaatgaaaataatagtccaaagcaaaaagaccttctgtgaaacatatgtggatgcaattaggtgaatatattgtatctgctggtgtccccaaagttgatagctttatttattggaccagcctagactgaaaatcttctgtttaggcattttggtggggattttttcccctctgtggataccgactgttatatttaaggaagatagaacaattggttctaccaagaaacctgtagctaacccaagtttcactttatgatggcagcactttaaaagtttggtatgaaag

SEQ ID NO: 109580 - DNA, 1044 bp, Homo sapiens
tctcggtgaaaaaaaaaaacaacaacaaaaaccgtttccttccccatctggtgccagcactgtataattcctaataagcttgaaaagataatgttggcaatactttacaagtttattgctaatgtttaacatttattaggtgcttgctgtgtgctgatctctgtgcttacatatttttcatatatcacttcatctatcttcacaacagtccagtgaagtagatgccattattatcccaatttcacaaatgggaaaaatgagattcattgagataaattaaactacccaaggccatacaactatagactaagggggccaaaatttgaatctagtgtagattcaaattagagctcattctcttattcactactggggaatattgcctggccataactgaagtccaaataacagcatggttataatatgggctttaaaataatctagacctggattcaaaatccatttattggaggcaagtgacttcacttctgatcttcagttttctcatatgtaaaatgataatatctacctcaaaagtgttactgcccacccatgtacatggtacatactaaaaaagcaaatgttagttccatttgccacttctacactttatgtgaaccctgggggtaatggtttgtacagaataaggcctggcatgagaagacaaaaaccatctgacaaataaaaaagctgtcattctgtctaccagaatgtcaaccagtgcctgccttccaggatcaacaagtgttttattaccataatcacatttattctcttaatgaaaagggtgtgtcttgagtatttaatagttaattacccataaatatactacagtagaataaggaataaaaccagtgatctgtctactatagtaactaggtttctttcttggtaatacttagggaacatatgagggttccctgtgggttgttatttattatataaaatagttgctctggtagttccataatagagacctgtcagtgccattcagcagagaaaaatcataaacacagctgctgtttttgtgtggcttgtggtttt

SEQ ID NO: 109581 - DNA, 1120 bp, Homo sapiens
ttgtgcttcaacgtaaatcctaaatgttagtattttaaatgttataggaactactagtaaatgtggtctataatgtttaattttttatcacctttgcagattaatatgtagtcataatactctgacatgttacttttaaaatgaaaaaccttacaggaaatggctcgcccccttaatctcttacagtatataagaagctgtataatgcttgggaggatgcccaatttgatgttgatggctaaagaaagcctttattctcaactgccaatggactgttttacaatgccatcttattccagacgcatttccacagctacaccatatatgaatggagaaacatctacaaaatccctttgggttataaatagtgcactcagaataaaaattctttgtgcaacctacgtgaatgtaaatattcgagacattgataaggtaaagtcaaatgctgatgcttattattttatagaaattattttagataacctttttcttgcactatacagtaatctgttgacctgtagtatgttttcagatggttaggagaacatccaaatctccgaatgtaaaaatatatcaagaattttacttgagcttccatctaccttagctattatacagctcacagtcctttgttaataattctaatattcacaattctagctcttaaaatcaaaagttttacagaattcgtttggcagaaagacctgggccaaccttaagtgagggtttttataatctttattaaccccacttagtataaaattccggtatcttattaaagaaatattaatgtctttatgaggtactgcttcaccagctaaggaagtagtatttagtaagtacgtgtaccaatttagctttctaaaatatggaaaaactctgaattacatacctcccttaaggggattgtgggcctatatttatgttttagtagtctgatgtctccattgttattagtggatgaaggcagcaactaattttggtgaagactctacatcagtattaacgtgttacatatgtgaaaaaaaggagaaccaagctatatctgaacaaaaattccgtggttttatatttgagtctatcgagtgtgtgcatatgtgtatgttgagtgtatacatta

SEQ ID NO: 109582 - DNA, 1094 bp, Homo sapiens
ttgaaaaatcaattttttttttttagatattcccattattatagagatgattgttgaattttccttttggggaagaaaagtgttttgaaatgtgttttataatttagactagtgaatatttttctttgttttttaaggaacactgtccattggcatggggaaatataaacttgtttgattacacagacactctagtatctggaaaaatggctttgaatctttggccagtacctcatggattagaagatttgctgaaccctattggtgttactggatcaaatccaaataaagtaaggtttttattgtcataaattagatattttttatggcagtcaaaccttctctcttatgtatatataatagcttttcttccatctcttaggaaactccatgcttagagttggagtttgactggttcagcagtgtggtaaagttcccagatatgtcagtgattgaagagcatgccaattggtctgtatcccgagaagcaggatttagctattcccacgcaggactggtaaggcaaatcactgagtttattaagtatcaattataatctgtggatttaggtagatactttctctatggaaaaggatccatatattttactggcatagatactatgaactctaggaccaatattgcaatagaattaagttctctatatgctaatatttttactgcacctctgcttttttaaagccctagcttgccttcattcatttaacaaatatttattgaatgccgactatgtgtaaagcactgggaaaggcactaggtaataaagtcatgaactaaacagaccttcattgagtatgcactctaactgtgaaaacagacattaagcagataaaagcagaaatataagattacagttgacccttgaacaacatggatatgaactacactggtctacttatatgtggatttttttcaataaatatattggaaaattttttggagatttgtgacaatttgaaaaaaacttggagataaactacattgtccagaagtatcaaaaaaattgaagttaggtatgtcatgaatccataaaatatgtatagatacaagtctattttatcatttacgaccat

SEQ ID NO: 109583 - DNA, 1066 bp, Homo sapiens
ttgagaattcagaatttttcacttttcacccagaatgatgacagatgaaaactgaccaaggaagatatttcacaagcattagacaaatcataatatgaatgtagatagatagtagcagcctagagcagagtttcccaacctcagcactattgacattttgcgccaaataattctttgttgtaggagccatcctgtgtgtgcaatccaggatgtttagcatccctgtcctctaccctactgcaggccagtagtgccatcctgctaagttatggctatcaaaaatgtctccagacattagccaaggttcctgggtggtcaaggggacacaaaatcaccctagttgagaaccactactctaaactctaatcatggtgaagtttattatataaatgaaatgtcagatgacaacacctaaactgtctctcagttatcttaagtcttctcaaactcaggataatgatgagtaaagaatatatttctaacaacaaaaaggaaatttgatagtatttctaaagacaaaaaggaaatttgtattcacattcagttagtcattccaccagaatgacttcatcacacaatattttgtgacaagaacctgaacagcctgttttacagtattcttttcatcttttattatatgcaccaaaatttttttttaaattttcttgaacctctaaatctacgttaaaaatttacctgatacactttctaaatggacaaatgccgaaggtagctgtgtatacaaatgtgactagaaggaaaaagatgatatagaaataaaataactccttgagttgatcattctgattggcatttatagagtagaaatgttttgtaattacagaggaaaaaagatggcctttccttcaacagttatgagccgtcagaattttcaaaaatactgcattttgacaatgtagtttctagtttgacaatgatatatttatcttcaaaaccaggaaaatgtagataagaatttggttttataatatttaaattcttattaaaatgtctaataaaattgttttccccatcactttattcttctgtaagttattttatattt

SEQ ID NO: 109584 - DNA, 1453 bp, Homo sapiens
aaacaaggtacatagtacatatttaataaatacttgttgaacaaatatgtgccggtaatatttcttcatgctgctgaataagttaacagcatataaacacatacaaaccaagtggcatggatgtctgctttcatttttagccttttaaaaatatatgtaacccatcctaaggggtttatatttgttttgcataatacattaatatgtactcattattcattacacagttaatatatctatatttgcagggaatatacattgcttggaattatacaaaaaaatattatttttcgttttctaatattcaggatacagtgttttaatgggggtgtttcttcattctttttttcttactggtttttactttttaaatttgaaagctttgcagggatcataaggatctgttcaggcaaagaacatgaaagggtttacatttttatcattttagtgtttcttattctctatatcaaaaacattcacagataagttaacaagatcctcatcaggaggaaaagtaaattgttcactaccatcctctagtatcctaatctggtcttgttgttggctaacttcagcagttactattctgtgactggtgtaatattaaccaaataaattactggatttgttctacaaatattatgtcttagattggttctttcctgtctctgaaaataaagtcttgcaatgaaaataaattattttacaacagttaattagcaatgtaaaatttattgaaaatgtatttgctttttctgtaaatcatctgtgaatccagaggggaaaaatatgacaaagaaagctatataagatattattttattttacagagtaacagactagctagagacaatgaattaagggaaaatgacaaagaacagctcaaagcaatttctacacgagatcctctctctgaaatcactgagcaggagaaagattttctatggagtcacaggtaagtgctaaaatggagattctctgtttctttttctttattacagaaaaaataactgaatttggctgatctcagcatgtttttaccatacctattggaataaataaagcagaatttacatgatttttaaactataaacattgcctttttaaaaacaatggttgtaaattgatatttgtggaaaatcatactacattggtagttggcacattaaatgctttttcttactctgaattcctgatatgactttctttaggattgtttaaaatattctagtagttttaggtcaatttagatgtgatttagttggtctagatattataatttttaggggttccctttcatttttcttttttcttacgtttcttcaaatagtataatgccttattttcatttatgaagaaattaccctgctgttggtgatacgggtatatttaaataaaccagttgcagtgcatttctgcagaaagtccattaagacataaattttgtccagta

SEQ ID NO: 109585 - DNA, 1034 bp, Homo sapiens
atggattacaatatccccaaacaaagaaaaaaatgttttaccttgaaattcagaacaatgtcaaactcccgtggttcttactgaaaaacaagctaattaagaataaaaaatgttttgtagaatgtgatatatgtagtactcaaaagttacaggtcataaaccatataacttttcataaatttagaagcagatttatatctaatatgatattttaagtgttaaaatttaataatggaacccagaagttaagttgaaaacaagaagcataggcgtgtgtcagaagagtcaaacagcattcactgagcgctttgttccctccctcttcatttgattatttttgtgctcaatttccttttttcatgtttttatatcttgtactgagattagtcaatgaaaactagttgaaataaacctaaaaactagatgtttatttaatcacatattcaggaactacctgaaactcatggtggttttgtttctaaattacaggttttgaataattttattattagtatgattgtaacatttattggatttcaaaaatgagtgtttaaattgtttagcaaagattatttgtatactgatttaagactatatatatatatttttaattttgcacgattcttttagatctgagatgcacaataaaacagttagccagaggtttggcctgcttttggagtcctattgtcgtgcatgtgggatgtatttgaagcacctgaataggcaagtcgaggcaatggaaaagctcattaacttaactgacattctcaaacaggagaagaaggatgaaacacaaaaggtgtgtgactctagtttgtgtttgagactcttttcactgcagtggggcagagttgtttagaagcccagtgtatatacagatcatggtccttggaatcaagcagattaggatttggaaccaagttccactgcctctcagctgtgtagtgttagacacgtcatgcaggctctcaggactcattttctttgtctgtaaaatggaaataatacctgcttcataaggccattgtgag

SEQ ID NO: 109586 - DNA, 1336 bp, Homo sapiens
gtagaaaccctcttaattagaaagcagcagtctaggatgtagattcagagactgtacagtactgaggttctcatgtgagaaagagattagcagttagttttatcttttattaagtcagtttcttactgtgactatcctttttttttaatcaggtacagatgaagtttttagttgagcaaatgaggcgaccagatttcatggatgctctacagggctttctgtctcctctaaaccctgctcatcaactaggaaacctcaggtactttcttgggggtttcattgatatatttaaataaataccttttctggataaaatcttgagaaaagtaaaaatgtctgttataattagaatgttcaataatttatgcttctctctctcattctcctaccctcaaaataagagtagtatatcttaagttcagtactgcctttattcagaatgagtttttactacttaaataatacagtttaaaaccttctatggccagaatttctgttaccataggataagaaatggaaatgtaatatctgtaaaactaatgatatatctctatatatttgttggaaattcatatgcaattatataacttttaaaacttttagttttttttatactctttaggaatggattcctaaataaaaattgaggtgaaagttgtaaatctttgtaacacttcaaaaagctatattgtatttatattttaaaataaatttcagggtaaaataataataaagcaaaggtacctagtaaagtttttaactattttaaaggcttgaagagtgtcgaattatgtcctctgcaaaaaggccactgtggttgaattgggagaacccagacatcatgtcagagttactgtttcagaacaatgagatcatctttaaaaatggggatggtaaggaagagtattaatgagcttatgatgcatgaatttagctatctttttatacacaggatatttatgaaccatgaaaactactgaaagccatttaaggaatatacacatgtgataaaatatgtaatatttatcagatgtcttgacctttgaaatatgcatgtataatcaatgaaaagaaaagaagtactaggtttagatcagaagtcctgaaatcagttttttgttttttctttttcctgttccctgcctccaacccccctcccgtggacctgtgtagagaagtattttttgttgttgttttggttttttttttaatcagtttctaattatcatttgcttagctgtgtgagtatccattcattccataaatattctatgtgctaggccctggggttttagcagtgaagaaaacagaatccctgccctcttggagcttacag

SEQ ID NO: 109587 - DNA, 1050 bp, Homo sapiens
ttagtaaatatttaaaatttttattttccctatttcaatttctaatatcattagatgtaattcacataactaaaagctctttggagtcctcagtaatttctacaagtgtaaaggagtcctgagaccaaaattgagaacttctgccctacagttttatttcgatgtcaattaaacatctttaaattaacacatatttttaaaatcataaatgtttgtaaaattttaattgccacaataattttcttaattcttttctgataaaaatacagtgctttctcagttgaaggttataataaatgatgacaggtaattttgaggattattccaggagtatgtttatcacaccataaaaaagaaaattaaaattggggaaaggcagtaaaggtcatgcatgacaaatttactaataaaatactcatgttttagcctgttaaaacatttgctattttaaaattccatcatttaattgtaaacgtgttactcctctttcagaatgttaccttatggttgtctgtcaatcggtgactgtgtgggacttattgaggtggtgcgaaattctcacactattatgcaaattcagtgcaaaggcggcttgaaaggtgcactgcagttcaacagccacacactacatcagtggctcaaagacaagaacaaaggagaaatgtgagttgtattattctttcttcctatgttaatctaagtttttgttagatgagtctgtcggtgtttgtgtattcctctgagttagaacagagaaaacaattgtactttctatggaaaaaaatatgctcaacctttgaaatatttgatgttaatggatttaaatgattataattacttttaatttggtaaaatcttaaacattcatcttatgtattatctaaaatgtattgttattgcttattctttttaaaacaaatgaatattgcacattcaaaattttatttctaattcattgttaaaatgattagaaaaaaataattttaatgacatgctaagtattttttcacatgaagaattatgctttggtcagggaacatctggaaattt

SEQ ID NO: 109588 - DNA, 3897 bp, Homo sapiens
tttttatagctttgtctacgaaagcctctctaattttgtgacatttgagcaaagacctgaaggtattaacatcatttgctccaaactgaccaaactgttcttattacttataggtttcaggagatgtgttacaaggcttatctagctattcgacagcatgccaatctcttcataaatcttttctcaatgatgcttggctctggaatgccagaactacaatcttttgatgacattgcatacattcgaaagaccctagccttagataaaactgagcaagaggctttggagtatttcatgaaacaaatgaatgatgcacatcatggtggctggacaacaaaaatggattggatcttccacacaattaaacagcatgcattgaactgaaaagataactgagaaaatgaaagctcactctggattccacactgcactgttaataactctcagcaggcaaagaccgattgcataggaattgcacaatccatgaacagcattagaatttacagcaagaacagaaataaaatactatataatttaaataatgtaaacgcaaacagggtttgatagcacttaaactagttcatttcaaaattaagctttagaataatgcgcaatttcatgttatgccttaagtccaaaaaggtaaactttgaagattgtttgtatctttttttaaaaaacaaaacaaaacaaaaatccccaaaatatatagaaatgatggagaaggaaaaagtgatggttttttttgtcttgcaaatgttctatgttttgaaatgtggacacaacaaaggctgttattgcattaggtgtaagtaaactggagtttatgttaaattacattgattggaaaagaatgaaaatttcttatttttccattgctgttcaatttatagtttgaagtgggtttttgactgcttgtttaatgaagaaaaatgcttggggtggaagggactcttgagatttcaccagagactttttctttttaataaatcaaaccttttgatgatttgaggttttatctgcagttttggaagcagtcacaaatgagacctgttataaggtggtatttttttttttcttctggacagtatttaaaggatcttattcttatttcccagggaaattctgggctcccacaaagtaaaaaaaaaaaaaaatcatagaaaaagaatgagcaggaatagttcttattccagaattgtacagtattcaccttaagttgattttttttctccttctgcaattgaactgaatacatttttcatgcatgttttccagaaaatagaagtattaatgttattaaaaagattattttttttattaaaggctatttatattatagaaactatcattaatatatattctttatttacatgatctgtcccatagtcatgcattgttttgcaccccaaattttttattgttcatagcagcatggtcagctttcttcttgatctatagatgaggctcaggcactatcccatttataccaataaccagtgtataactacttaaggaaaacataaaaacttcatcttctttccttttatttcttatgtgaatctcccgtcttccattctcttttataattgagaatgtctcaatcatatgaaattagttaccagaattaacacaatttagactatcttcctgattccttaaacccctttactgaagtatactcatgaataatactttaaaatatgggggaatagaaaccatgaactttttacctttttaaactatttatccatatctccaaagtagaacattaaaccattttaagatatgtctcattcccaagtagtcagagctcactctccaactttattaaatactatttgagcacaggacacattcttaaacattttgaaaaacattaacccaagatgtagaggctactgctagtcgtcattctagaatctgatattttactctgtatttgaaatgaatgattaatgtcctaggaaattagctttagcagatgtccaggtgccacatcaaaaaagtgcaataattattgacagttttttagattaggcatattattggaaaacaactttataaagagtgaacattgtatactctagtaaaacagcatcactttaaaaatattcatttatgaaatctgttacctatagttgaagtcttgagtagtgaacaagggactctaataccaatactcttaatatctggctattttagatcccttaaagggcataattattggaaatttaggtatttcactaaagcatgtatataatattgccaacaagaaaagtaaatttgaagattaagggaacttacttctgcaaactgtcttgcgatagttaagcagaatttaaactctgttttaagcaggaaaccagaaagattattttgcagttgtagaagatttcataacttattaaaacttattaacattttgtgttgtttagatataggcagttgatacatactaacatcccagccttttcaatatcagggttaaattataggaaaactcagtaaaatggtacaaatctgaaagtttgatggtagaaactgaagatttaacagagaactgtgttttacccgagtgccaaaaatgctgtgagcctccttgcacaaaatttataccacttttgcatttttatctatcagtccagatagttgtctcccctccttctcccaggacctctccaccattaaaatgcacaaaccacatggccgatttcaccatttacatttattttcaaaagttactacaaccaaattaattctattagaagaaatgtagacaaattctataaagactatagattgtgacctaagaaagaaatgaggcaaagaaccaaacattgaattaaatgctacatgggtgactaagatctgtttcaagtcagtgataatatagccacttctgggtacttcagtatcagagatcagttctcgtggtttagacagttcctatctatagctgactatccttgtccttgaatatggtgtaactgactattggctctacagttttattgggccacttaagaaatatttccttgaataattattttgagaaaaagtctaaaagtaataaaaataattttaaacacactgtagtaagaaatgactgttggaaaattatgctttcactttctaccatattctcagctatacaaaaccatttattttgaagatttttagactactgttaatttgaaatctgttactcttattgtggaatttgtttttttaaaaaagatgtttctaattggatttttaaaagaagaatggaatttggttgctattttacaatagaacctaagctttttgtggttcttagtgtcctatgtaaaacttagtgtcaaagtaatcaactttgagattttcccttctattctgctttatattaaaagcccattagaaaatgggaacctggtgaatatataatgaattgtaaaatattttaatgtgtaactttttcaactgtgaaactgacttgattttttgatgaaaacagctgctgataaagtattttgtgtaaagtgtagttcttattaatcaggaaaatgatgacttgattagactgtatatgccctcttggattttattttaaatggattggtgactttcacataggtaaaacacagtccatctgtattcttttttccatcaaaaatcgagtgatttggaattataaaaaaattgtgagcagcctatttgaaaggcatcatggaaatttcacagcacaataacacggatttgttttttcttaatgatgtaaatccgtttaattcatactttgatcaatagcccatgcttgccaactctgaagaaatttaatttccagcagtattttaaagctagcctgttaactttttctgaatatttaaagttcctcttttttctatgtctgca

SEQ ID NO: 109589 - DNA, 1054 bp, Homo sapiens
taacctagcagatttttaaataaatgatctaacatttttgagcactgctactagatgctagaagctaagctaaagtttcacctgccctactttgcttattccataaaataacaactgcgtgaaagaacgggttatccccattttatagatgagaaaagaaaggtttacacaggttagcttatttgcccaaagttgtaattatggcctacaaagtcaaataaatcctactctgagacacatgttctttccaccattgcacactagaaaggaaaacaccaagattattcattactcatcaagtcaatattgctgtattcagctaatttagtaatatgtgtcgaaattaattgctaaaagggattaaactgacttagaatcagttttttgtttgattacatctacatacaaaagtagcttcaaatgtctcattccactgtccataatttaagatttttgagtataataaaattttaaagatactttgaggcactttggaaaatcagaccaaaatctcttttccactcatagattcggcttaatcaacctggaaagcatttgttgagagccttatgacatcatttaataaccatggttgattcattaattaaagtacagacaattgttgactatccatgtgggacttcttttctattaggttgatgcaaaaataattgcggtttttcgccattaaaagttaacagcaaaaactggaattacttttgcaccagcctaatacgatgtggatcatctgagatgaatgttaaaatccagtatagcttcttcatatttctggcccatttttcccaccagaaagtgcacaaagtgaaatgagcttatgaaaagcttaattaactagaaaaatgttactgaaagaaaaattacatggtacatgacaaggctaaatactagtaactctaaacttagtgaattttctaggcagcagctttcctctgctgtctagactggtaaagaacaaactaaagccaagcgcagtggctcatgcctgtattcccagcactttgggaggccaaggcgggcaaatcacctgaggtca

SEQ ID NO: 109590 - DNA, 1049 bp, Homo sapiens
gaagctttgggctatatgaatcgtaatagctcttctctttttgatttttgaatgcagtgaattgagatggttactcaaggaatgattgtttacattgttaggtgaggcgtttgattttattcttttttctttctttctttcttttttagacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggtgaggtattttatatattggtatcatttctgtacatttcatggttgtctgtttctttaggctattctgttccccttctcccaactggtagctaagaactggaagcaagatgtgcatgcattttcatctctggttctcccacttattagttgacttaactttcactaaggctgtttccacatcagtaaaaatgtaaatgggtttgatagtaactcctccatgtaccgcacaggaccattttgaagatgaaatagaataagggttaggaaaatgcttaataaactgaaaaggccgggcgcggtggctcacgcctgtaatcccagcaccttgggaggccgaggcgggcagatcacgaggtcaggagatcgagaacatcctggctaacacggtgaaaccccgtctgtactaaaaatacaaaaaattagccgggcgcctgttgtcccagctacttgggaggctgaggcaggagaatggcatgaacccgggaggcggagcttgcagtgagccaagatagcgccactgcactccagcctgggcgaaagagcgagactctgtccgaaaaaaaagtaaaaataaaataaactgaaaaagcactatctcattccctgctgtattatat

SEQ ID NO: 109591 - DNA, 1041 bp, Homo sapiens
tttcattgaggttggctctgctgtgttggcagtataagaaaaggggtctttgtggccatctctaatacacctcgcatacatttacttgggaccatctcagtcttacctattagtctacccagcctacacattcttcatatctgaagaaattaaccctagtatactgcttactggcccttcctagacaacacttgaaatgactatattcagaagccctaagtggtccttaccatttcccctatgtaacaacctttctctgcatgacatggcacaccttcctggtgtttatttcactgttttgtgcagttaatacagtgtttatcatatatttttattttgtgtgattctgagtataaaacaaatgtatccttgtatatttcaaagttgttatgttttagagtatgtaatttgtggttctttcaaagtcctatgtcaatattggatctgaaatataaaagctttaaaagttgaaaatgtataatattttcattacagatactataattaacattaagaacatttgtataagttagataacgggaagtttctcattaaatatgtatgtttactgtacttgaaatatttttcattttatgttcagattcctctggaataagcagaattgcagatggattcaatggaattttctctgatcattgttacagtgtctgttctatgagacagccagatttaaaatattttgacaacaaaggtatatctaatattttcgaaaatatgtttctttaaactgcttttacattttttattccttacttgaaaatgtgggtaaaatgtggattgatgatttcaaaacagacaagtctttgaaatttgttacaatgtaagaaaacaaagttgtatttttttaagaaagcaagtaattttaactattctttttttttttttttttttttgagatggagtctcgctttgtcgcccaggctggagtgcagcagcgcgatcttggctcactgcaacctccgcctcccaggttcaagcaattctcctgccttagcttcctgagtagctggggttacaggt

SEQ ID NO: 109592 - DNA, 1922 bp, Homo sapiens
aagcatttgcttgtttgagcagattttctgtgtctgaggtatatagataacttatctttttatgactaaatccaagtccttagttcctgttggaattcaaaatcatatttaaaaattgatgctttgttctataattaatgctttgattgtataaataataagtattcttccaaatccctttttacagatgatgattctgataccgagacgtcaaatgacttgccaaaatttgcagatggaatcaaggccagaaacagaaatcagaactacctggttcccagtcctgtacttagaattctagaccacactgccttttctacaggttgggggaactaatttatagcattgatatattttgtattggtgaattttaaaaaaagtgcatgcaataaatttttttttgcccagttgtatttaacagatcttatttagttatagtcatataataggtttgttttattcttcagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagc

SEQ ID NO: 109593 - DNA, 1063 bp, Homo sapiens
tgtttataagtgcttaaatcatctctgagccatactggatatagctgcttgaaccctcattgtttagtatctattagcctagttttatatttcagccatctaaagcataaacattaaaaagattgaaatattgagcatgttatttgctttgtcaaagatcactaagttaaaatttcctagacttcttacagatgacagctggaaatcctggtttttaaacttcaaattatatataaaagctgaaaaaattctgtaacccaaattttctttttaagaaatataatacaatttttatttcactctcattagtccaggcacagatgtcactacagagctggatagctggattgataagttttgcctagatgctgatgtctttgttttggtcgcaaactctgaatcaacactaatgaatacggtaggatttaatcatattattgtgtttcgatggtaggaaatgaaatggtatctgttttaattctgaaaagcaagggaaatccatatcgtggattagaaaaaacttctaaaaacaggcatgaatgaaggggtttgtgttttcatagaaccagaagggctgtttctagtctttctatagtgtgtagttccctggatttctctagcagtatagggcttgatggttctagcttctggttatttgtcagtctcagggaaaatgagtgccagaaattttaggatgcttatttaagtctcttgaataaagtataaaccactccttccttctgccatctatcaggcaaggctttttatattttcagtattgtcagctatttccagcttcaccagaatatactccaggtttcagcttaactgtgtacactttaagctgctgtcagacttagaagattatttagccagatgtctggagccagactcatctgaaataaactttccagagtttaggtaatctaatattcaaaattataacatgattttttaaagttatcagtttttttcatctttgaaagtttaatgctcatagagtgctttgggatcctttgtcagtggtgttaattactgtttaaatggttcagactttctcatt

SEQ ID NO: 109594 - DNA, 1072 bp, Homo sapiens
gggtatgttttatctttaggtgtgtacagaacaggaatgctataacttcctacattaattttttcaaaatcagtgaaaataagtgatgcataaatgagcttcaccatgggaaaaaatgaagctaggcaatgcaagaaagtaatggcttcagagttaaatattgactaaattaattaccctcatgtgctctatagctaaataatctgttttgttttctctacctcaaacgaaatgctgaagaggggagctaaaatggcagtagagattatagtctttctgagtgctcaaataatttcagagacatgaaggctaagcataggtcgtaaataggacattgaatgcacgtgtagcatcctgatgatttcaggataagaaatgtagcactagagtattaagtaaatgccttttgaagcctaaaagccatttattaaaggaaggatagtaatgaacttcaggaagcaattaccacaatttgtattagctaaatatatagaggttcgagaagatgaattcattggagtatcagagaattaatatatccctaatttttaaaaaatttatcatagaaaataaacatgtctcttataaaacatctatagtacttactgtgctatatttcagtgcagaatttgactttctgtgaagtaaaaatgaaataagacaaattgtaatataaaaattttataaatttttatttatttattttttgagacagagtctcgctctgtcgcccaggctggagtgcagtggcgctatctcagctcactgcaagctccaccttccgggttctcgccattctcctgcctcagcctcccgagtagctgggactacaagcgcgtgccaccatacccagctaattttttgtatttttagtagagatggggtttcaccatgttagcctggatggtctcaatctcctgacctcgtgatctgcccgcctcggcctcacaaagtgctgggattacaggagtgagccaccacgcccggcccaattttataaattttaaatgataaatcatagtaaatatatatttataggatgggcgtggtggctcactcttgtaatcctagc

SEQ ID NO: 109595 - DNA, 1740 bp, Homo sapiens
atttgaaagtgtcgatatttattctgcaaccttgcacacatcatttatatcccctggacctcactattcctgtgtatgaattgtgatttttaaaatgttttgtggctttaaaatatctttgaagcagtggaagaaccatttcttcaagcagatttttatgaagaagtccaaaacaggtgatcctctttctgcattcaacccacgacccattttttaatatggtcatacattggtattttgaaatcactattttatactagttgtgtttgtttattgcctggtgaacaaacaaggcgatgctacctgccaaccagaaagttgatttggtaagcagtaccctttatgttatactgtacggcattattttatactatttgttaccttgtaaaggtggcaatgaatacatgaaaataccagcattatcgatacaaagtataattttcacaaacttggtatgcttgaaacacagatcgggatgttattagatgtgacaaaagtaatgatgttaagcctcgataggaccttcagtggacttaagccagttgaaggaaacataaacgcatcaaagcttaagtccaagatgacataacattggaattttaaatgtatttgctctttcagggaacaaagaccccttcatgtccctgtctgttgctttataatggtactttcttaggaatgaattaagttcaaatgcagagaattgccagcatataaaacgcaaggatcagaaccctgagtttgaactcagcccctgtgtacagcctccgtgtggcctctgtttaattagatcgtgctgctatagcagttccttctagctcagttgctttgatgtagtacccaaattttggcctaaaagtgatttaattagtaataatttttaaagatataggatgttgaacaaagtatagcacaaagaagatgtgatttgaggattgtataatcataatgtcctgggaacttcttaagtaaaagatcttcttaaatggatctcaggtctttattttcctgtatcagccagagttgaacaaacttttgtttaaaaaaagagccagatagtaaatattctaggctttatgggccataaagtctcttggagctactcatttctacagttttagagcaaaagcagccatagatagataataggtaaatgaatgggtgtggctgtgtttcaagaaaactttaacaaaagctggcagctggctagatttggcttgtaaggtgctatatgctgacccctgcttattaactaaagtcagtattgcattctgttttgcctgttcatatctatgaagacttagaattcttattcatcctttctgggattcaggtgccacatgggcagagaaacgtggtttctatcaaatcatctatataaaatactttataagtgaaatattacttgaatcctttgagatgttacaagttttttttttccttgagtcatgctaatagatggttcaatacatgaatgagtcccttgctgaaatgctttaggacttcagactaccctgaacgttgattactctttatactgaaataggcattattcagtggaagagagggaagaccaaattgatagactggactttattcgaaaccagatgaaccttttaacactggatgttaagaaaaaaatcaaggaggttaccgaggaggtggcaaacaaagtgggtaacagtagcttcatgattaaaataacctggatggaaattatttttgataatgctaaaaatg

SEQ ID NO: 109596 - DNA, 1044 bp, Homo sapiens
gttcgagaccagcctgaccaacatggtgaaaccctgtctactaaaaatacaaaaaaaaaattagccggtggcaggcgcctgtaataccagctactctggaggctgaggcgggagaatcgcttgaaaccggaaggcagaagtggcagtgagccaagatcacaccactgcactccaacctgggcaacaagagcaaaactctatctcaaaaaaaataaaaaatagccaagcatggcgacacgcttctatagtcccagttactcaggagtctgaggcaggaggatcgcgtgagcctaggaggtcaaggctacagtgagtcaagatcaaagcactccagcctaggcaacaaagcaagaccctgtctcaaaaaaaaaaaaaaagtcaaattaaaaagaccattttggcatttactgaatattttatgtctttataaaaactacatactttctggagaaaaaataatatggatatttaccattgttaacaggaattaaataagcacatagaggatggtatgggaagaaatttggctgatcgatgcaccgatgaagtaaacgccttagtgcttcagacccagcaagaaattattggtaatatttatgtctacaaggtcatgtctggtttgttttttcattcatgactggtgaagagcttattttcctttaggcattccattgaaggtaaaacatttaccattcttatcttaagtgttgtaattttgttctttctagaaaatttgaagccattacttccagctggtatacaggataaactacatacactgatcccttgcaagaaatttgatctcagttataatctaaattaccacaagttatgttcagattttcaagaggatattgtatttcctttttccctgggctggtcttcccttgtacatcgatttttgggccctagaaatgctcaaagggtgctcctaggattatcagagcctatctttcaggtatgtatctttgaatctaccaattaagactctcctttattattttgtttatgtggtttttctataataaaactagctttacaaaa

SEQ ID NO: 109597 - DNA, 1050 bp, Homo sapiens
tttaatacttcctaagcattttcacatcacagcacacaaagaaatatttgtacgttgaggtaataagaaaaccccaggtgccctatctagccttctctgaatatcaaggggatctgtcttaagtattaaatgttatttttagtagtagttcttatttgtttctttaaaaaatgtatatcattaacagcatggatatgcttgttttggtttttgaaaggtctgacctacaatatttaacattgttttatttttgagatacattgaatcaggataagtctggcagcttataaagctctccctcatttgtgtgctgatcccttttaagcctgattgatttctggtaacttcaggttttctcatggagaaggaatatacatttttagaaaatgtatctaactcaaagatccatagggaactaaaatgcttttaaatgtactctccaaagtggtgtttttccttctcagactaagctatgactttatcttacagatttggaaaactataggctggaaactcctatctgtttcattaactatgtatggagctttgtatctttatgaaagactgagctggaccacccatgccaaggagcgagcctttaaacagcagtttgtaaactatgcaactgaaaaactgaggatgattgttagctccacgagtgcaaactgcagtcaccaagtaaaacagtaagttggaaggtgcatctttcctttaaaaaaaagttactgaaatatgacatacatgcagaaaaagcacaaaataagtgtattgctcaaagaattatcacaaaatgaacatgtttcgtgatggccataaatgagaaaaaatagaacaatactaaacctcactgctgccctttctccctcctaatcactattcttctttccattctcctgatagattaggtttgaacattagaaaattggtagataggaactctcaagaactctggaggggtttaaaaagatagttcttaattttttttcttttttttcagagatagggtctctgtcgcccaggctggagggcagtggcacaatctggctcact

SEQ ID NO: 109598 - DNA, 1027 bp, Homo sapiens
aaaagattacatcaaatatggactctgtgggtcgaatacaaatgcgaacaagacgtacactgaggggccacctagctaaaatctatgctatgcattggggatacgattccaggtttgtacctgtcattacctgtcatttttaaactgttgcagaattattttcattaagaaccatcatttgcattttctttgtttaaaaacagaatatattcatgaagcgtttgcagaaaatgcatctcagatgaacatgctgctttcaataagaatattaattgactctttaaaagtataaacatttttaatatggaatccaggacaactgttcagaagaggattccttttctttgcagtggaacattgcagacattctttgttttttaaataggcacaaagcgtttttactgtatatgaagcttgaaatttcagttcataagcaaatacgtattgaacacctatgtgcaagtttttggatattgctatagtttgttattacataaattcgcaaataatggaaattacatgaaacaaaggtgtttgtactgaatacatcttttactccctcgactgcatcacagaaaggtgtgtgcttgaatgtgcaagctgaccatctgcaggtgcacaggcacacgcacagctgctacgtggcctacagttagatagattgctcatcactgtcattcactatgtgtataaggctacagcacagcctatgtttttccattgtctggcaatagcagatgtgtctgctatcacagtggtttacttgttcctttgatttggttaatcttaatgggaaatgcctaaaccaagaaacttctatgttttaatagaagttgcacatttattctcttctcccaggagacactaaaattataaagtagaagaagcctcaattgttgctctaattgggatacttgaccacaataatatagaacatgtgcctcttacgaagggatacataaaattatataattggcaactgacataatgtcttaatctttttctttttcttttcttttttcttttt

SEQ ID NO: 109599 - DNA, 1034 bp, Homo sapiens
tcttccttccttctttccttccttccctcgctccctccctccttccttcctttctctctctctctttcttttgttcatttgttcattcattttttttctttttttgatatggggtcttgtaatgttgcccagggtggtctcagcctcctggcctcaagcaatcctcccaccccatactcctgagcagctgggattacaggcatgtgccacaacacccagctagtgattttttctccctcccttcttccctccctctctttttctttccttttttcttttctttctctttctttctttccttccttccttcctctctctttctttctttctttctctttctttctttcttcctttcttctttctttcttcttcagctaagacagcagaagaagtgatttattgtatgcttgttacacttggccacaagggaacacagaaatagttcagaatgccacaggtccagggaaaaggatcaatatggactgttttggttatgagctaggtgggtctccaaggtagttttggtgatcacatggcaatggaagttctagatccattgagacaagctctagacagtagcatgaagtccaacaacttgtactagcatccccagcctctagcattccatgtttctgttcctgtggcctccatgggtgcacaagctagtggattacttggacctcttgtagggaaaagaaagagagatcaaaatagaatttcttatgtcttccttttctacatagacttctacatagatcagactgttactgtgtgtatgtagaaaaggaagacataagaaactccatttttatctctttcttttccctacacctctgcctcatctttcttcttttgcacttcagcctgtgcattcacttcttcctccacttggttttcatggcacagaggtttccaagatgatagtgttaaggctgggagctgccgattatttctttaaataagcttttcctcctttcctctctcttctcattctgggacccctataattcatatattattttgcttaatggagt

SEQ ID NO: 109600 - DNA, 1004 bp, Homo sapiens
gcctccgcccattccctcgcccacccgggaagctccgccccctccagctccgcaacccaactccttctgtcctgctgtcgctttcctctttcccgcccccatggctgccttcgattggctaaacctgctgggccgcggcggggatgcggcgcagccgcattctgattggctagacttaggcctggaccctagtgattggctgataggaggagccagcaagtgtggctgagctccggggtgtgtggacgccgctttgttgcctgaggtgggtggcggtggaagttaagggagtcaggggctatcgctcctcgagactcgcagtcgcggccactgcagtcacttcgccagttagcccttagggtaggagtcgcgccggcagcagccatgagcggcggcgtgtacgggggaggtgagtgagtgcggccggacgagagagcgcgccttttcggcgtgtggggtttgtaaccgccgctcccagccctcccctccccggcgttcccttccggtctccccctctcgggaccccggcctccccgccccgtccccgccccacgctctgcccgcccccggagcccacccggctcgccgtgctcctcgggctccctgaagtggcggctctctgtggcctcttcctgcctctgtccccggaggagcagggttttggggtgcgcgctcggttctctagggagcctcggggctgggcgggaggctcagtctagccggccgccgggccccggcttgggtgaccgccccagggtcgcatctccccgagtgcctcctggactcagctgtgtcgggacgcgtgtgcgcccgcctaaacttggaaggtcccggcggtttgcaagcgtggacggagggttcccagagtgtcccataggtggcaaagcgagcctcaagccgtagaactgactagggaagcggcggccacttagggtactgcctcctccccgtctgcgccccatgcgcgagctgcctcacctttcagtaactcttgcctgtttttt

SEQ ID NO: 109601 - DNA, 1816 bp, Homo sapiens
gcaagcagtgtgtcaattataatagcagcttacacttagcatgtgtattttctaagacttcatatacatgaaagcacttaacatgtttaatcattagagtatcctgtgagataagagctattatgtacattttacatattaggaaactgaagcagagaggttaataaattgctcagttcttgtagctgttgaacattcttttgcatgtctccttgcaacctgtatgagagagtgtctccagaataagtaagtgtaattctatgtatgcacaatttcaactttaatagatatgactaaattgcccatagtggttgtcccactttggacaataaattatagaatcaccctagttgatggtggagggaggttgctggtatatttattagcctggttcattcacctcagggtaatccatggctaactgcatcccctctactaaaagtcacagctcctgtcaggtagccctccccatacaactttctctccagattctgataacagttatttcttcttgtttcttcagtttgaagaatggcaatggatccattattattagttatcattatagtactggggtactgtactgtcccttctggttgtcctgtatttcacctatatctttgcaaataattccctttaataagtaaactgaaattacccagttttagtgtaccatttcttaactgattgaacctctacttaaatacggtgtatgccttgttatattttaattaaatgattctttaaggtgtatttgaaactaggttcaagtgagtaataatatgaatataattgggctgagtgcagtggctcatgcctgcagcactttgggatgctgaggcagaggattgcttgagccctggagtttgagtccagcctgggcaacatagtgagaccttatgtctacaaaaaatttaagaaattcattgtagtcccagctatttggaagactgaggcgggaggattgcttgagcctaggaggttgaggctgcagtgagctgtgattttcatatgatacttttgcaagctgttaatgctaattatctttaatcttttcagatgaagttggagcccttgtttttgacattggatcctatactgtgagagctggttatgctggtgaggactgccccaaggtaagtgtaatgttagagttaattggatatgtaaagccattcatgtaaattaaatttatgcagaaattctgattcaaaacaaaatataataaaatacattaattggggaaaaaatgccttcttgatgaaaggtgaaacttgtatgtcatgtttctgactcttacaggtggattttcctacagctattggtatggtggtagaaagagatgacggaagcacattaatggaaatagatggcgataaaggcaaacaaggcggtcccacctactacatagatactaatgctctgcgtgttccgagggagaatatggaggccatttcacctctaaaaaatgggatgggtatgatgttttccccatggaattgattatggagtgtacatgttatattttagatacaaagtagtagcttcctataagttgaacatcaaccatggttttttgttttgttttgttttttattccacaaactgatttccagacactgagaatacaaagatgcataagaaatgttccttttcattaaaagcttacagttagttgggggaaatagatgtatatatacaaataatggtacactgtgggataagtggtacaatataggtatgtgcaatgagcaatgggattagagaggagaggtatttgactctagtgttgggagtcagtgatggttttcacaaa

SEQ ID NO: 109602 - DNA, 1060 bp, Homo sapiens
tttgtttttgtttttaagaaggggcatgtggatagaaggcaatgttttaaccagttggcttaggtgaattgaaagattgccattttaaaatctccttcccttccaatatcatagaaaactggaaattggctgtaaattcattctccttcaaatttagtcagtcatcaaatcctgcctgttcttccctgctatttgcttctctctgtcctactgccacagcattaggtggaagctatttccaggattactgaagcacgtcctcttgtctgcccattctttacgctgttgctctaataatctttctatttttatttatttatttatttggtagagatggagtttcgccatgttgcccaggctgctctcgaactcctggactcaagcgatatgcttgcctcagtctcccaaagtgctgggattacaggcatgagccaccgtgcccagcctctaataatctttctaaagtgctagtctgctttaagccagaatcgtcttctacatttcttcctttattttactttcagaccgtgctgaggtacttgcagttctctgacctcgctgtgttctcttgcttcttggtcttcccacatgctcctactcttgcccatattcccttccccagattttactattgaatatctcaggaataggtttcccttttacatcaccatcttccctgggacatcctgagcttttctttttacagctttattcatcatctacttcactaaacaggataaccttcagggaaaaggcagttttggtgcaccattgtgtgtctactgtgttaaaggaattttagtgccaggtgagcagcctccctccttcctccctccctccttattaagcaccagacttagtagacacctaatagatgctcagtaaatatttgatgaatgagtgaatgtccctactcctaaacatcagtttagtatattcaggtagtataggccatctgcagcacagaactgtggaaaatgggatctgccaatatttaccaactgtggaattcacctggaatagttttcccgctcattgagttggaggagataggaactgc

SEQ ID NO: 109603 - DNA, 1568 bp, Homo sapiens
aatgttttaaactagatttgctaatggtcgttctactgggctgattttggacagtggagccactcataccactgcaattccagtccacgatggctatgtccttcaacaaggtaaatgtatttaaccaggatacactgagatgattttagatgccatgaggatgcacataatgaaataaaatgatgagtagcactattaaagcatatcagtttctgaataagattttttttaagtatgttaaaaatctttagtatataatgtatatttaaaactgatgcatggctttatttatgtgttgaaggatagttcagttcattctacctgaaaaagttattcacataaatacacccacagaggaaattcgttcaaggaagtttggacttactgccctcttagccttgtttcatctgtttcataggcattgtgaaatcccctcttgctggagactttattactatgcagtgcagagaactcttccaagaaatgaatattgaattggttcctccatatatgattgcatcaaaagtaagtaattattgaattttctttgtagaacttacttctagctcccccacccctatgaagtgaactccattaacctagcatctcttggtactctcaggaagctgttcgtgaaggatctccagcaaactggaaaagaaaagagaagttgcctcaggttacgaggtcttggcacaattatatgtgtaatgtaagtaaccctcattctctttacaaaaatgttacaggctttttgcatgagtattaaaaaaagttatatataggctgtaaatccttgagtaaaatatgggcactttatattttcaagctctttattttttttattactaaatacattttgaagattaaatagaacatgatctcagggtcacactctatatttttaatgatattttactaacaaaagagcttttctgtgagaggcatgcttttcatacttgccaaacaaatctctacaaattactacatactcacttggattactatggtgagacctggaaggaattttggttttatgctattctgaacatttttggctgagaaaatggttttaggttttgtagaggcctactagtatgtctcagttatgttctgtttcccagcatcagtcagcaatatcaaaaatgtgtttttgttcagaacaaggaacccatgagagattctctttactaaaaacccatctctgaacatatggcttactgatggggaagaggttagtaaaacaacctgatgccacagatacgccttaatttcttaaaaaaaaaacaaaaaaaaactgttactttaggttcaggggtacatgtgcaggtttgttaaatgggtaaactcatgtcacggaagtttgttgtacagattattgtcccccaggtactaagcctagtacccaatagttattttttctgctccattccctcgtccctcagggaggtccaactgtctgttgttcccttctttgtgtccatgtgttctcatcatctagctctcacttgtaagtgagaacgtgctgtatttggttttctgttcctgcattagtttgctgaggataa

SEQ ID NO: 109604 - DNA, 2201 bp, Homo sapiens
gtcacccaggctggagtgcagtggtgcagttgtagttcactgcagtctcaaacacctgggctccccctgcctcagcctcctcagtagggaggactacaggtgcatgccaccatgcctggctaattttttatttttatagagacagtgtctcgctatgttgcccaggctggtcttgaactcctggcctcaagcgatcctcctgtctcggcctcttaaagtgctgagattacaggtatgagccactgcatccagctctgacagtttttgcacctaaagataaagattttgtctgtgtgcacatgtaatatacgaggaaaaattaggatgattagtcatttttcctagatattagacaagatttttctagaggtcgtgttagttcacaacattttattaaactgttttatactatgtacagtcattaaaagttgcataaaatgtgatgtacatgcacatgtgtatatgtaggtaatgaaatcttgcttctaatctagcttatttttaaggagaaagtggtgttctgaaattggttttgttatgcagaactgtggtgcaggggttcctgcacctgcagttatttatctctcatttcataactgttgtaacttaaatgtgtgtaattaacttctaatgcaaatgattagaattaggtttcttgatactcagaatccttgttaggtacatttatactcttgaaatgatttacccatctagaaacatggtccaatttcattcagaaaagtatttaaaatatgttataaaagtatagattacaaagataaatctcaaccttgtttgttacttttttcttttactcacagtgtgttatccaggattttcaagcttcggtacttcaagtgtcagattcaacttatgatgaacagtatgttttcttattaaaatgtatactttataaatgaggaaaggatttgtttaaaaaatacttaattgaataatgtttaaaatattctcactcccttttttttttttacaagtttataattccctagtagtttataattttgaagagaattattttttgtcttttgtgtaatacggtttaatatgttttcagagtggctgcacagatgccaactgttcattatgaattccccaatggctacaattgtgattttggtgcagagcggctaaagattccagaaggattatttgacccttccaatgtaaaggtataaaagcttatttcataattagcctggcttttcctatataggtaaagagcttttgtggctaaaatgttttggatatgctttactgtatgaagagcttccatgtgactacttgttttcttttgttgtaggggttatcaggaaacacaatgttaggagtcagtcatgttgtcaccacaagtgttgggatgtgtgatattgacatcagaccagtaagtgccagtctcctgttacggtttaaaggtatcttttaggggactgaaatgtccccaaatcattgttaggttgacagtgatctaatggttgtcagtgtcattgactttgaggttcattttataacagtatatgtaaaaagatgaagtactagaaaaggaaaaatgtgaaactctagagctatggtgtccagttttgtagctacccgccacatgtggcaatttaaatttaaaatagataaaaacataaaactcaattcttcagttgtagtagcctcattataaatgtggctagtggctgcatcagacagcgcagatatagaacatttgcatcatcacagaaagttattgtagactgcgctagagatttcctgaaatgtggcaaaccaaaatatgtattgttggtgattttcttacagatagcacaacttctacttttatttttcaggaaggcgtggtttaaattatatgagtaacttttacatgaagtttattttaaatgctcttcatattttttgtgctttgtcaggttttaaatactaactccatattatatacttcactcattatcagtgataggttcttggagactgcaactttaactgaaacgatgtacagtaggtccttgaaggacattgtttcaggaaaaaaattggttttgttacatgacattttgctgaaagtcagtttccaaggtcatattgatgacattaaatgaggacttactttatcttatttaaacccaattcagcttatcacccacatactgcctagattttgagtaaattaatttgcttaa

SEQ ID NO: 109605 - DNA, 1065 bp, Homo sapiens
gttggtgttggatgaaatgaaataataaagacttagcacagcaccagatttatagtgttaggtgtggatttgctattttaggatagaaattgtgaatgctatacttcagtatgcagctttttaaagtttgtatgttttctcatcatataatcgcatgttaaaagccataatcaaagtacttttaaaagtctgtacattagtctaacctatgcttgttatcttggctatttcaaaattaccgtattttaatcagtgtttgaaccacagggagccattatgaagtctgtcaaaattgaatttcctggctgggtgcaagtggctcatgcatgtaatcccagcactttgggaggctgagatgggccgattgcttgagtgcaaatgtgaagaccagcctggacaatatggcgaggaagaccctgtctctatttgaaaaaaaaaaaaaaaaaaagaattttctaagttgagtcacaagatttgattgtactaatgcatattcttctatttcagagtatgcggttgaaattgattgcaaataatacaacagtggaacggaggtttagctcatggattggcggctccattctagcctctttggttagtagatgagctactttgcaaaaatattcttactgaattatactaaatttagtaaaaatacaaaaaataattccagtgcttcatttgtctgtgcattttataactgtcaaatgagtggaagacctaatggaataaccagttttatgtgttctgatgtaacaaaatgcctctgcctaattagtggacatttgtcagcctaatttcaatgtcccctctcaaacagaggtggaaatatgttaatgtatgcatgccttttctaataatacccccattggcactggtcagggcttgtctggagtgcatttaaaatgaaaacattgcttctcaagttctggtcattccccagtctgcagtgagatctacagtgaggtctaggaagtcaggaattggtcttggagcaaatggtgaagtcatggtgcggggtgtaagatgttgcttggactaccatctgccttgaataaggacaaa

SEQ ID NO: 109606 - DNA, 1249 bp, Homo sapiens
agggcagaaataatcgagtactattttgggggacgggactcttaaatgaattattcaaagtttaggagttacgaaaataagatattaaaaaaaacgctggtgcagtggctcacacctataattccagcactttgggaggctgaggcaggaggatcacaggtgcccaggagtatgagaccagcctgggcaacatagtgtgagaccccatctctacaacaattaaaattaggcaaggtggcatgcccctggagtcccaggctgaggtgggagcatcccttgaaccaagaagttcgaggttgtaagctacaatcacgccattgcactccagcctggctgacagagcaagaccttctctcaaaaaaaaaaaattttttaagccatttctagtaagaagtaaggcataattatataaatttctttccattttacagggtacctttcaacagatgtggatttccaagcaagaatatgaagaaggagggaagcagtgtgtagaaagaaaatgcccttgagaaagagttcccaagcttctaccttccttttgtcaccttacgtttcatagctttagtatactcaggaaaagaatgaccatcttttgtagaatgtttatacatttttgcatatttcaatttccacttaaattttttaaagctttaactggctctataaattaagtttgtgctttccttgaaatgcacttattcttattacaagcattttataattttgtataaatgtctattttctctaaatattttgctttcagtaaaatgctttccaactctgtttagtgtattaattaccagtggattggtagaactgctttttattgactagtaaaagttactgcctatgctttttaccttaggcttacagaattaaataaaaattagccattccagaaatatattttggactgttgtgcactgtgattactactttaaggactaaatgtatttctcattattttgaatcaaagtcctccgtttattaacagcaatacccacatcctcttcatagcctattaacaacagaggtaaaactattattcaaattcaaaaactacggtattgcctttgctgtggcagttaccatcaccttcacactctaaggtagcaggtgacatttaaagcctgcttaaatgtcagaatttataaagtgggaatctcatctgaactttatacctgatttttagaagcaaattagcttctaccaaattagctaattagcatgccatattcacacttag

SEQ ID NO: 109607 - DNA, 1041 bp, Homo sapiens
aagaaagcaaaaattcttttaaaaaagtttccacatcttgctgaagcccaaaagtcaagtcttgtctaagatgtctgaactattaaatttaccattttgtttttcttgaatagtctgtgtacaggagtaaatatgttaagtggtttataaagaaattctgtttttagtcaagtgactttactaatcagttgttctaagtgtgaatatggcatgctaattagctaatttggtagaagctaatttgcttctaaaaatcaggtataaagttcagatgagattcccactttataaattctgacatttaagcaggctttaaatgtcacctgctaccttagagtgtgaaggtgatggtaactgccacagcaaaggcaataccgtagtttttgaatttgaataatagttttacctctgttgttaataggctatgaagaggatgtgggtattgctgttaataaacggaggactttgattcaaaataatgagaaatacatttagtccttaaagtagtaatcacagtgcacaacagtccaaaatatatttctggaatggctaatttttatttaattctgtaagcctaaggtaaaaagcataggcagtaacttttactagtcaataaaaagcagttctaccaatccactggtaattaatacactaaacagagttggaaagcattttactgaaagcaaaatatttagagaaaatagacatttatacaaaattataaaatgcttgtaataagaataagtgcatttcaaggaaagcacaaacttaatttatagagccagttaaagctttaaaaaatttaagtggaaattgaaatatgcaaaaatgtataaacattctacaaaagatggtcattcttttcctgagtatactaaagctatgaaacgtaaggtgacaaaaggaaggtagaagcttgggaactctttctcaagggcattttctttctacacactgcttccctccttcttcatattcttgcttggaaatccacatctgttgaaaggtaccctgtaaaatggaaagaaatttatataatta

SEQ ID NO: 109608 - DNA, 1893 bp, Homo sapiens
ccttaaaatataattgtgtaactatgttacctctgaaattataaggtagcagcttctataatgcagtattaacaatactttctaaagcattttcaaaatttattgtggccaagcatggtggctcatccctgtaattccagcactttgggaggccaaggtgggaggatcacttgagcccaggagttcgagaccagcctggacaacatagtgagacccagtctctaaataagaaaaaaaaattaattcttgtgcagaaaccctgagtagctttttaaaatgttatcgatgacaaaatgattatgtttattatgataatgtttattgcttataaaatccagatattataaaacttttacttgtttatgtgtgttcaattgcaggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggtgagatacttggatttgtcaacattagatatatttatggaacccccccccccgccccgcccaaccatcgttctaggattatatatccagtttaggaattatttagatgtttcctttttcagttttctttgagactgtctactagagaaaattaaagggacaatataatagtagagttaattgttccttggcagattggcaagatggttagataaggaataggctgaaattattaactaaagtaaggtttagggcttattttagattttattttttaatgataatttaaagtttgtttatttatttagagatggagttttgctcttgttgcccagactggggtgcagtggcacaatctcagctcaccgcagcctctgcctctcggattccagtgattctcctgcctcagcctcctgagtagctgggattacaggcacgtgccaccacgcccggctaattttgtattttaagtagagacaggatttcgccatcttggttaggctggtcttgaactcccaaactcaggtgatgcccgccgtcttggcctcccaaagcgttgggaatacaggtgtgaaccaccgccccagttaatttataatgacaaagtattttgtcattagggtgtgaaaatacgttctgtactaatgctaacattttttgaatgctattgccagtcatgttaatagtattttcgtatgttacctaatttatctctaattacacattgttatatactataaaaaagctgttatatattttacagataaagaaacaggtttagacaggtttagagagcttaaataatttgccaaagggcacatggctagaaatgttatttcatgttatgtattattttaataggagcagcatggacctgtcagcaactaaggaacaaaagtaatgaagatttacacaaactttggtaagtatactaagtacattaacatctagacgtttgaagccgttatagtgtaacaatgaggtgaaaacaatctatctgatataagaaattgagtaaagcgatttcttttgtagtactatggatgataaatctgatgtttaagatcatgaaagattttatatgacagaggttagattatgacaaatgtcacaattctcaagtagttgggaattcagaaattttactgtaatttacattggtcctactaacatgtttatactagcaatttcagttaattaataaaatgaaacagagaatagttggtggcttttgtttttttctttgagacaaggtctcgctctgttgcccaggctggagtgcagtggtacagtaacggcttactgcagccttgacctcctgggctcaagtgatcccccacctcagcctcctgagtatctgggaccac

SEQ ID NO: 109609 - DNA, 1051 bp, Homo sapiens
cctcaccaaagtgggctccggctctgccatccaggcggccgttccattcttgagttgttctcggcatctcggcatctcggcaaccaaacaagatccaaagttggagaggtgggcaaacctactttatacatcacttaccctgtgcaggcagggacctgaggagttattaacgatcgggaagatttcagggcggatgaaactctcctacaaagaagggccaaaccggccgcagccatgttttcgcataactggcaaaacgcgtttccgccaacgatagcgtcacttccggcgtctcaagccggcggtgaggagaatagaaaacttgccctcacttaagatggccacatcctgcctttgtcctcattggtaaattggctctctcagcttccgtgacccgcctcccttcttcctcctgcccgtagtagccatggcggccatgagtttgttgcggcgggtttcggttactgcggtggcagctctgtctggccggccccttggcactcgcctcggatttgggggcttcctcactcgtggctttccgaaggctgctggtgggtgctggcctagggagaacgggcgtgaagcgggtgcggggcgagaaaagggaggacgcttccagggtgaccttggtgggatccggagggagccgggacaagttgtgggcttggggcttgacaggagagacggagcacgagctatatgaggggttttcctgaagtagccagatagatcgtgtttacattattagcatttctaaaacgttgttattcaccatcccaattaatgctaatttgcggatgaagctgagtctagaaaggtatagagctgagatctgtatctctagggcacaagcttattgttgcgttccacctgcccaaaggctaggttctagtcccacagatgcaaagtcatcttgccgagaagcccacctatgctaaggaatatgaagacaggtaatatgtagacaggtaaagaggctcagggccaacttattctttaggcacagtaagtaccgtgccgcccaataatgagatgcagatgaactggggag

SEQ ID NO: 109610 - DNA, 1011 bp, Homo sapiens
tgctgtatccacctcatctaagccattcataaaaaccttgatgctgcagggcttttgagagatctctttgccaggttactgcagtaattaatcagtaccttttgcttacagtcaatcaagtacccattacaaatttctctaacttcctctttctctcagcttataatgtcccctcttcccaacccccccatcttgtctaaataggaacttttcttctgggccactgtatcctatttctttcccttgttacccttacagatttgtaattacttgtgtagtgtgtatttctcccagcaagatctatatccctcttagaccgtatatagttctagcataggatctgcacatagtatgcaattaaatatgtattgaattaatgagtactttgtactgtcatccaacccgttttcttcatctagtccacaaaaaaaattatgtatgtttcagatgatttgctgaagtccatacttactttgtcaaattctcttaatcttgttatttaaaaagccttagtagtatgaattatatgtagtaaattcatgccagtttctaattctcttgtgaatcaacctcccaaactcactgcaagctgctgcagatgttaccaaaattaagaagatagttcctgctttcaagatatttatacttaaaagtggcagcagtaaacacaaatatacatgtcacaataacgtacagtaattcaacagtaggaaagatctcgtgtggttgggaaaaatgttggcatcttggaagataagatgttatctgggcctaacatagatttcaggagaggggacagcattccagacattaaacatgaacaaaagattcagatctttctgacatctattatgactgaaattcctttaatgggaaattaaagttttttattctacagtgactcacatgcaaaatatccttgagagtagttacacagtgaaaagataggaaccttcagtttctaagtaacagctagatcctttcctgttcccagtggaaagggcttggaat

SEQ ID NO: 109611 - DNA, 1046 bp, Homo sapiens
aatggcataatggaataatttaaattaaatgtatttcttttgcagcattagcaaatatttgttgcagaggagacacagatgagcagctcattaagtacctaacctccctgcctgctattgaaacaaattaaaatgattatttagatactttaactttgaattaaaatgaggaaagttatgctttagaacagtagatccatctttgtttaaagataccctatctgacctggccttattactcaaataagacattttaaaatcttaactcatattaaacatctaagaatgtatattttctttttgtttcatgtcagatgggtaatgtgcctacctcataacaaggtttgagggaggcacatctcacacctgagtgtgaaaacccagtcatcctgcttatgagctacaaaaggatccttgtatttttttataatctgattttaactcagaatataacagtatacccatatgaaccttgtataaaacagggtaattcaatattcccagctcctgttcgacacagtggagaccatgggaaaagactatttgtcatcagaccttctagattctatgacaggcgttttttgaagttattggtaagtttaaattttttgttgaattaaagtctttgcatgtaacagggaaaaaatttttgcctctttagaaaacatctttcattttatgaaatattttattttgtaaatttatatttctttctgtagaagatactgagactgtaaagtctgatttgttattgaatttctctttaaattagtgaagctttccttcttcacaaaaggatttacactaaatggaggtaaaacttgaaccattcctttcttctgaagattatggcgtttcgaaatagaatctgtgttcctataactaaaatattctttaaattaccaaagaacttgttgaaagacttgcttaaataaaggagctacattattttgggatatgattttatatttatatgttgttcaggaacatttatttcagagagtaacagggatctatagtgcaatcttaatttagcaataatataa

SEQ ID NO: 109612 - DNA, 1083 bp, Homo sapiens
aagtgttattgtgagccttgaatggagtatatcccatcatgttttattatctgaatgaattatattttaaatacaaatcttaaaccattaaatcttaaggcagaccttacacttagtttgtttatgctaactggtgcaaagagctccatttttgaattaccaaaacctgggtttgtcttctgaatctgccacctaagatactcagcatagtgtaatggaaaagagtacacagctttggagtcagacagacctggtttgagtccaggtgctgccatttattagctacgtaactttgtgcaattcacttatctttaaaatgcggacaaaaatagtatccacctcatctgttaaaattattttatatataggtatattagttacatagtagatgttactggtttatctaactgaaatgatcattttaaagaatagtcaactagaaaagcaaagtattattcagaaatggactaatattaaacgaattttctcttgtagcatcccatatcaagatggattgcccgtaatttctatgatagtcctgaaaagatatatgaaagaacaatggccgtccttcagattgaagctgaaaaggctgaattacggtaggaaaaacgagggggtaggtgggaaagaaaatcttcctaaggtagcaaaccaccagaaaaaattaataaaactatgaatatttcagcactataggatactttatgtaaaaggataaagatacgtccagatgcagtggctcacacctgtaatcccagcactttgggaggctacagaaattagccgggcgtggtggtacgtgcctgtaatcccagctactcaagaggctgaggcagaagaatcacttcaacctaggaggcagaggttgcagtgagccaagaccatgccactgcactgcagcctgggtggcagtgtgagactccgtctccaaaggaaaaaaaaaatggataaagatagaattagcttgtttggagtgaaaactataaactggtgacaaggagactattaggagatatgtgtcagattaaagagttcttttttaaatttttgaatttttttttagagtggaagtcttgctct

SEQ ID NO: 109613 - DNA, 1097 bp, Homo sapiens
tcaggagttagagaccagcctggccaacatgataaaaccctgtctccactaaaaatacaaaaattagctgggcatggtggtgggcccctgtagtcccagctacttgggaggctgaggcaggaggatcacttgagcctgggaggtagaagttgcagtgagctgagactgcgccatagcactctgacctgggcaaccgtgcaagactccgtctcaaaaaaacaaaaacaacaaaaaaactgtttgatagctatctatataagcaacataataaaagtcaaaaataagtcccaaattttggttatagatatataccagatgtatgcctacataagggtctgtggaggagcattatactttacataaaagcagactccagtgattgtcctttatggaaatggctcattaaatttataattggaagtgctggaatctcaatattgctgttccatttgttacagggtaaaggagctggaagtgcgaaaattgatgcatgtgagaggagatggaccctggtattactatgagacaattgacaaggaacttattgatcattctccgaaagcaactcctgacaattaagcatttttttctccaaatacaaagtatattctctttattggaaaataaattaataaatatattctgtatttttgctctccgtgaaaaacaaaagagcctctgacattactgtctctcagtgttggttcagattgaggcttttgtttgaggagtttggcttccagtccccaaagaaggtttaaaatgtactaataaaaactggagaaataggaatttgtgaactcctaaaattgtagcaactttgaaaggttagtgttttatttacctgacaaatggaagttatagaagtctaataatgttaagcaccagtaattatagtattttgtacaaatgcctgtactgtagatgtctgtattattgaggggcaactcaggattttaagttccataaagtattgaaccaactctaaaatgttaactccttaataaacagattctcagtaaacaaattttaaagtttataatgctttcatggtttttttttttgccatgtattgttcttttttaaactacacacag

SEQ ID NO: 109614 - DNA, 1053 bp, Homo sapiens
tctatgtttcaggggaggaagggaaggtttgataatatttatcttaaagcacagtgcgtgataatgggaaggttttttttgttttgttttgttttttttttgagttttgctcttgttgcccaggctggagtgcaatggcacaatctcagctcactgcaacctctgcctcctggattcaagtgattctcctgcctcagcctgccaagtagctgggattacaggcgtgtgccaccacacctggctagttttgtatttttagtagaggtgggtttcgccatgttggttaggctgctctcgaactcctgacctcaagtgatccactcaccttggcctcccaaagtgccaggattacaggcgtgagccactgcacccagccagtattttgttatggtatgtaacactatactatgaatccaataagggattcttcagcacctactatgtgccatctcatacatgcatgactgtaaggagcataaagagcaaaatccattggtgctaaacacgccagaaactttaatccacaagtgccacgggatgtcttagggaaaaggccaaaaccagctgagtggaaaaaagaaatcatccctgcattggttactgttgaaaaaggttatgtacaaagatggctagaaaataagggagatcaacattcaaggccagggaaattatatgtgcaaagaagatacaacgtgtgaatatttcccactaatttgcctgtaatgtatttggaataaaaagatacatttggcaagtagcaagaagtgaggtagaaccaagtagagagtagatgatgggggccttgaatctggaaaacatttgatcttgattttatatggtcagttatggaaagctattcttggtcatgtgatttaaagtggtgttggaggaagattgtgaatcaacaaattcacagtgtacctaccatgtctaaggcactgtctgtagacctttgccattcttcacctttgtgggatatgagtagtgtattagtatctctcttcccttcttcccacctcctagggcttaacacatagcagatgctcaataaca

SEQ ID NO: 109615 - DNA, 1591 bp, Homo sapiens
tacttctttttataattacaagcagctcatttggttaatttttttttcctgtccgctcttttttgagtcgatgttctagaaaatacggtgttctggtcttcttggccttccttttccaagggtgtgtgagtcaccgtcttcccgcggtgttagtatgtgatttgtcctggcgtggatttgttgtgactccatctacctacatcatgtttctctttgcagcaatgaccgcttgttttccacaggagacactgttctgtagttataaaaacaagtgttacgcagcgactgtttcctgagcgcgttgctcacataagctcatgctcccttcctgtcttccagtgggaaggctggttgccaagaaaacatcatcataaacaaagttctctgaacacctaccgattgacaaagtagtgtatttttatttaaaatgactattcacttgctactctgaaacatgttgcaatcttgacctttatatttgccaccgttttaacattcttttaaacggcaggcaatataaaatcagtgactttgtctttgatgttatttctgaatagtacatagagggatacaatacaaagtagcaaatgaatggctaagtatatactgtatgtatattgaaatgcattgaagacaggattttaacaatacatggggcttctaatgctgctcctttctttttctttttttttctttttttttttttgagacagtgtgtcgctctgttgccagtctggagtgcaatggcgcgatcttggctcactgcaatctctgcctgccgggttcaagcaattcccctgcctcagcctactgaatagctgggactacaggtgtgtaccaccatgcgcggctaatttttttgttagctgggactacaggtgtgtaccactattcccggctaatttcttggtattttagtagagatggggtttcaccatgttggccaggatgggcttgatctcctgacctgcctcccaaagtgatgggattacaggcgtgagcctctgaacccggccagtgctgctcctttcttaccgtttgattatggggctggagaagttgtcaagggaaatcattatagagccctgtgcagtatttcttgactttcttctgattttggatgtcaaagtcttgcatcttggtcaaatttctggttagtgcatcataaaaatgatcattagaatcctatttagcttaggattgtgcacagaactgcacattggtcattctgggctgggtgtcctctgagcaccggaggcaggtaggatccaaggtgggacggtggtgcagagaaggcagccactttcctgaagaaccatgtgagactggcttggttacagcaggtgggagagctggggcagtagggttcaagtgtccaggctgctaagagtgacttcagccaaacaaacctgaaaagctagaatttctgctggtgcctcaggctgtttttctatgcgtggccatgagttttattttgagaattcccattgtttagtcgtgccagagactttaagtggaagctgtattatgatgcattttaaattcagatcagaagggcactgaggaatagtttgagagagagagacccaat

SEQ ID NO: 109616 - DNA, 1111 bp, Homo sapiens
ctatactgtggtctaaataggcgaggggggattttagctgaagcaatttttacagaagcagaactggcaaaaagttaaaaaagtaattggttacaaatgtagttacaaaaaataaacagttccaggtgcaggggcttaaactatcacaaagagataaatgcaggggttttgggtgccatccaccgagcgcgtcctcaggagctggcggtgcagcttgcctcaatatcttatcagtaggtacattcctggacgtgctttgagtcagtttacactagttacgccttaagggaggggggtgaaagggggctgcaagtgaagaaactaaaatggagtctgtccggctctctgtctgctaggacagagtcacttgggttaaaacaaggtagggtatcacagcaggagcctcggtggccctttgccaggcctcgtcttcagcgtttgccttccttccctttccctctttctacatctgactactgggctaggtgtcgtcggctaatgtactttttctctttcttctagaattctgaaggtggactctatgtatgcatgaatacatttttggcctttggaagggaacatgttgaaagacattttcgaaaaactggacagagtgtatacatgcacctgaaaagacatgtgcgagaggtgagagcggcactttcagagaactggccttgatgtcttccctgtaacgttgtctcagtgtgctttctcacgtggaaatttgaccatgcccacataacttccgattccctttgacgatgagaaacaaaaacagcactgcttgcaaaatccagagagtctcccaaaccttatcgtaaccagttttatttttcttcctctaaacttctgattggtgtttttaagaatacatagattgactaattggaaaaaaaaaaccgaaactaggtttaaaaatacagaaaagtacagagacacccatggatccaaaaatcataaaaaaaaaccatttgaatgttcctgcttcagatgtgttttgttttgttttttagtataagaaatagagcttccttaaaaattcaagttccttttgtccctctccctcgccagaagtaaccactgctttgaactttttctgtgtcatgca

SEQ ID NO: 109617 - DNA, 1040 bp, Homo sapiens
actttttgtagagacggagtttcaccatgttgcccaggctggtctggaactcctgagctcaagcgatccaactgcctcggctgggatttcaggcgtgaaccactgcacccggccaattttttgctgactttcaatagctggctcttgcagtgactcacgcctgtattcccagcacgttgggaggctgaggcaggaggattgcttgaacctaggagtttgagatcagcctgggtaacataaaaaggccctgtcgttaccaaaaaattaaaaaattagccgggtatagtggtgtgtgtctgtagtctcagtgacttgggaggctgaggcaggaggatcacttgagcccaggaagttgaggctgtagtgagctatgattgccactgcactccagcctgggtgacagagcgggatcctgtctttaaaaaaaaaaaaaaaaagaagtcaatttttttctttttatttctaaaattagccaaactacagacttcattcagatttcataatttttctcccgctcatgtcctttctttgttacaagatatgatccagggttccgcattgtattcagttgtcatgtttctttaatcctttccagactctgatcattcttcagtttttctttgtctttaataattgtgacacttttgaagagtgctggtcagttattttgtagactagacctcagtttggctttatctgatgttttctcatgaaaaatgtgaagtatgtacgtatgcatttttggaaagaatcctacagagatagtgtgcccttcttagtgcatggtatcaggggtacatgatgttaacatgttgtcatactggtcatgctgaacttgatcattgttaaggtagtgtctgctgggtttcttcactgtaaagttatagtgtaattaagaaatattttgagagtgatactttgagactgtgctaaatattttgtttctcctcaaagttttgctcactaattttagcatcagtggaccttgcctgcaataatgatggctctagtgtttgactaatggtgatttgaaaatttcc

SEQ ID NO: 109618 - DNA, 1049 bp, Homo sapiens
atgtggctgttaccaaggataaaatatattagtggacaaaatggccttacctcatcccattacctgaaattatataccaatgcttatatttctgtaatactgagagttcttactgccttgtttaatataactcttatttctgctgtcagaagagaagaaacattgtgaataaatgttatgataaattattttcctttcagcccctcatgaataagtctttatgttaaaaaaattaataaaaaagccttttcttattgttgtacttggagtataatttgaaatgtgaatagtcttatttaaaataagagaagtgccatagaaatctgaatccagcaagatatatcatcatttttactatagagtcttttagtattaagaaatactttaagaatgaaaaaagaagagagaattatttggaagatgagggtggggagataaaaggaaaagcctggacttatctgatggtaatggataggatttatctacatagaagatgctagttactatattttcttttcatgcttttgctatatttttggtgttcgacaattctctttttaaactgttaaatagcaaaaattattgagctcaaaccatctaaccaggtgattcttccttcatcttctgagtgttttagcacagaagaatttcattttcagagagtgactctataggttctaccagaaagttaaagcacctctgggtgatgctgggttcacagagacatagcactgtgagctcggcaggggtcttagagcttgaaatccaatgccttcatttttgacatcaggaattggagcagtggtgtgcttgtaaatgtttaacaacaggctccctagggaaaaaaagctctgttttgtagtgtctgctgattccatggtgtaaatactcccaccatgactgatttcaggttatcaatatgacgtcactgaatgcggtgttggaaagagattggtagtagcagaccattgtacagaatttccagcattccgctgacatgcatgtaaataaaacctcaagaacacatagataataatgagatacagtaa

SEQ ID NO: 109619 - DNA, 1026 bp, Homo sapiens
tctctgttattccactgagcctttgttgtgacctgcctacttgaaaccctctgtcttcttagatgttaagttttaaaattatgccctggctgttctgactactctccaatggctttccagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcaggtgagtgcgcctttaccgactttgggaacatgcagtggcttcctcttagatttaaccaatccctgaatccaggtggttggaaggtgcaggctctggatgcagacagcccaggtttgaattctaattctgcctcttattagttttgaggtcttgggcaagttttctaatctccctaagctttagaatcctcatcttgaggataacgatgatgatacctctttcctgtgtttgttagtgtgcataaagcatttagctcagtgcacgctgtaaggtcctaatacaagttgctgctgttgttattatccttctgtgtatctcttggctaaggaggacagagcaggaaacaggatttgtgaagtgagtgtgcataatcaagtctactgttagaacagcaggaggaagccctggaatccattacagggattaagtatcattttaggaacaaatggattaattatggagaatatgagttttaaaggatactgtgcattaaaagagtccctgaaatcacctggcagtgatggtgttcacattctccgggggattagaattgtttccttcttgcactgtcagcttcagagttggttctgtttctttttgtcctcacatggtgtgctttgaaacattagcttttggccatgtttgtacagttaataccttctaccattttgcgagggaaaaaggcaataatatcaggatcagtaatgagaaacttaaatat

SEQ ID NO: 109620 - DNA, 1066 bp, Homo sapiens
aaatgtgatcatactgtataaagttttattccttatttttctctatttaacattatgtttttctatgctattaaatattcttcagtattttatgatggtttcataaatcatttcactattctgtaagtggttacaattttttttctattctgatgaacatccttgtatatatgcaaatctttgggtgtttgtctagttatttctttagaataaattgctgtgacaaaaagagttaaatctttaaaattttcagttaccaagattctcttttaaacagttgtaataatttacattcccatcaacagtgtatgacagtacccatttcaacaaatccttgacaactttttttattaagacttaaaaaaaaaacctttgctaatctggtatcttgttttaatttgcatttctgatgaggctgaatatttttcttagtattcttggccatttgtagttcttttttgtgaatttcttaggccaatgtttttgtaggtttaggtttttaaaaattgttttttaagaactctttgattattaagaatattaacccattgtcttccatagttgttactgtttttgtgaagaagaaataacttttaaggtttttcttgtcatataattgacagtatttgaatgcatctgtttcaatcatagaaagtataaaacatttggcaacagcaatgcagatcgtatacactgtgataagggttgtgaattcatttagctaaaataatgttaactttttgaaaaagatcaggctttgattcctgcgaatattgtgcagagtcagttttaataaaagtattttctgtctaattgtaatttcatattagtttatgggatgcatacattctattttggtttcctttaaatctgtttaatagatcgcaagctgtaacatattgtttatttaaaagccacataaattaataaaaacatgcataaagtttccttaaatgtctaatgatgagccttgtggacattgaggcccaggggtagggtgccctctgtctgggggtagccatctctcggtgaagtttccactgctgagggtctgctcttccacact

SEQ ID NO: 109621 - DNA, 1033 bp, Homo sapiens
tctggtgtttgtgacttatagatgagcctgaaatgccccaagagagggaaagaagattcactgaaacagagaaggggatagatgatgagaggaatgtatggtgtgggggagagagcatgaaggatgggtcagagccatgtggcagaaacgcctttttacggggccaccaccacgcatggtcttaataactagcatcacatagtgcttgcaaagggccaggctcttcctctatattcactgatgcggaaacggatgcacagaagccttgcccaaagttgcaaagccagtgagtggcagagctgggaattatatcaggcagtttggctctggagtctgtgtttttgatcaccgcattatcctacttccctaacagttgttccaagacttatttcaggctcccagtgcctcagtgtgtggatggtggcaggtggatgacaaaagggggcgtttgaagtttgcagaattaccaggtagcccagttatgagggtttctcactggcgtcttccaagttgagtcatttctagaatatatacttcccagtattaaattaatctgctataaaccaaggttaaatctagctttttatatatgcatgcttaataaacattgtcatgcataaaaaggcagcagtatttatttgtggtaccgccatttttacttaaatatgttgaattgaattttaagattaacttgcacttgcagtagataatagttactataaaagggcatttttttcttcaaaaaatattttctctatctttatgcattctaaggcagtgctttcaaatgttttaaagctgaacactctacctcatttcttcctccaaagataacatatcttaaataactctgtattctgaataagctgcatttcttaagcgacaatttatttgatttctcatctaaataatcctcaacacatacttgctggtctcaacttttcatcaacgtgagataaccagtgttctgcttcaaggtggtataattttagctgtgaacataagagctttgtttcccttaacctctattttc

SEQ ID NO: 109622 - DNA, 1062 bp, Homo sapiens
tgtttccttgttagaactaggctgcagtggtttctcttgtctgcctcagggttactgattcacatgtctgctcaggtccatgatcttttctaactctgtttatcatttattagtgataactttttttttttagaataaagcctcccgagtagctgggattataggcacccactaccatgcctggctaatttttttgtatttttagtagagacggggtttcaccatgttggccaggctggtctcgaactcctgacctcagatgatccacccgcctccgcctcccaaagtgctgggattacaggcatgagccactgtgcccggccaacagccagtgttcacaggttggcatctgcccctcccatcactttccaggtcttatgttaattctctacatgctcttctgtaagcagtgttttcacttaaatgtttgccacatcatcacatctgttaacagagcataatttctgttttatttgtacctaatttacatgagtgtatttatataatcatattgtacatgtttttatgtttccagggcagccctttatttttttccctttctcttttgattggcttctcctcctcctttcttctcattccatgaatttctctcccatggtttttaatttaataatattgaaatagtaatccatgatgaactatattttattttaccaatccccatttttggactttagataaattccagtgtttttctattaaagtgctttggtgaatgggcatggccagaggaaatgtttaataaagccaagtgtttacaccgggtttagagttcattttctactaagtcttagtggctcaatattcatacatttactaacctgatacaatccatccttcagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaagggtaacaattccaaagcgggaaattggtactgtgtgtcttcatatg

SEQ ID NO: 109623 - DNA, 1115 bp, Homo sapiens
tggtcaaacgaaaaagaatttattgctgtctgtttaacatgtatttgtttggttgaaaggatctttttagaaactgtaggaaaataaacagaaccaaccaggtgaaacaaagcacagacattgggttaggatgtagtgagttgtgaacaatcaggattctgggtgtgatgggggtccctgtctcataggtgatcctttggtgccatgtgaccgagagacatggtgtctaaggcccatggcctggagacctgggtgctgctcctagctgactgtggaccttgggcaagtccttcatccgtcctgtgcctcactgtcctcatctgaacaatggtatgatgacacctgccctctctttcaatcatgctttgaggatacagtgagattggttacagtgaaccttcaatgagtagaatgtggtatgccatggtgggttgtagtagatggtgctccctgccttttctcctctgttttcctcaatttgggaacaaatgagattggcagaaggagggagctcacggtgcagtacttttctaccaaagtgtgcccactggtgtcacctcctaatgttaacttggatttcctaaagcagtcccactctgttatgagagtcactgactcccgtggacatccccacagtaagcagccttacaaaatccagtccccttagggcagagtgagtgtcatagaataatgactccaaacccacgtcaaaaatggcttgttttcagcgatgttataaaacaaaggcctgttttttggaattgggggtgactgggtggtttggattgaaatgtggacaaagatagcatgtgtattttgaataaaataaaaattttgtaataaaacttttaaaaatcagtgatgtaaaatcaatatttaagactataggctataaattgtttgatttcattaactagcccttttgatgcctagacatgttgtaaaaaaattgtgctatggctgccttttcttctgccccacaacacaaagggctatttctacaaggcaaagttttgtatatgtgctattctttacttcagattgagagttgggaaaaactggagtaaataatgggtttcttacttgcttaaaagcatatttatatgtgtatctca

SEQ ID NO: 109624 - DNA, 1092 bp, Homo sapiens
tgactgagaagattattttcatatttttcttctggttttgaagacatgggggaaattttcgatgagatgttaatccaagttgtagcaattcctacctgtgtgaccttagacaagtttcttaatctctctgaccatctcaaatttgaaaattgaagtgtacattaattcgttaagaagcctaattgtttgatttctgactcttgtcgataagaacattcacagatttgttgccaagttttaatactggattctctgctttagaaatatccttatattattgaggggggacattatccagttgataaagattatctcatcaaaacagagaccactacttcccatcatttaaaattctacaataaggtgatcatatggaaattataccctcaaactaattaatgggataagttagttgcagtgggaagtatttctgtttccttttatctctctgatttcctcagtcccaaggaaatacaaatattttcattgacagttatattagatgcagaattgtgaattgcctttggtatacccacttagagagaattgaaggaggaaatatgatgataaataaaaatgggaaactagaacctcaaggtatgcttctaccttaaatcactgaaattgcctgtttgcacatttaaaatgaggtatcctcataagtcagaagtagaaaccagaggctaaaattccaaccagagccaggagcacacttttatagaatgttagcaaatttaataccttgggacagtgaaagttcttggcaaacattgatttactggagatcagaaaaagttggttgactgggaggaatatttatgcatttatatatgcattctttaagtaagcacgattatatgagtaaattacagtctacagagaaacataaaatcccagagacctggagttcaaattattgactttatttccaactgtgaccctatatggccttaaacctttatgatctattccatggccctaaacacagcctacaagacattaccctactgagcaatggagaagattgtttggcacacttccttcacacgttccactcctttatgcacacaattaaaatagacaccaatacac

SEQ ID NO: 109625 - DNA, 1832 bp, Homo sapiens
acccaggctggagtgcagtggcgctatctcagctcactgcaagctctgcccctgggttcacgccattctcctgcctcagcctcccaagtagctgggactacaggtgcccgccaccacgcctggctaatttttttttctttgatttttagtagagttggggtttcaccgtgttagccaggatggtctcaatctcctgacctcgtgatccacccgcctcgacctcccaaagtgttgggattacaggcgtgagccaccgcacctggccaagaaaaatactgtttaacaataataatcatttcgaaagttcaaagattttggtatgtaaatagaatgcagatttcttgcttgggattcatactttcactgtcgagtgcctgtcaagcagagttaagtatagttacttaaaaaatatttgtggtttaactttttaatttttattttctttaatagcaaaaatttctctgaagatgattttgcttctgcattgagaaaaaaacaatccgcatcttgggctttaaaatggtatgaagactgtctttcaacaattgcattatatctagtctaaaagcttagggcaaggcaagcatgcttatatcatcaataagacaaatttgagatgcattaaagtgatgcctttttgacatgagcttttcttttatagatgtaagtagtcttacattttacacttaacagataagttttactcagcatttcagttttctcaaaaggaattagtatattgatatctaggtttcaccaatatttgttgtgaaaatgtccaaaggcagaagaacgttccttaggtatattgtgagtactctgaaaactaaatattttgccaagtttgatgacatttgcttttaaaacttattcacactaacattttatttagatattgtttgaagtgtttgtgatgctttacaaatgtcttttttagtgtgaagatcggagttgactattttaaagttggacgccatgtggatgctatgaatgaatacaataaagctttggaaatagacaaacaaaacgtggaagctttggtagctcgtggagcattgtaagtgaatcatacatggattttaaggaatgtttaccaggtaaatgcgaacaagatttatgaagagcttgtgagatacagccctctatctttgtttcatgtctctagatatgcgacaaaaggaagtttgaacaaagcaatagaagattttgagcttgcattagaaaactgtccaactcacagaaatgcaagaaaatacctctgccagacacttgtagagagaggaggacagtaagtatcagattttgtttaatagtggaggtctaatgttcaaccaaccactaaaaaattttgaacttaaggaaatagtttcttaagcacttaatttataacactcttggtttcaataaataaatgggaaagtacaagagattaggcaaatactcttttcctagataatatactcaaaagtttttggtttaatgactatactatttgtgtagtcattcctgtttgtgatcacaaattccaagttgattaaattttgcaatattcgtttataatttataggaacttctatttaatgattggagcagctttttacatacttactaggtggataactagtaactacttatatgtggttgtcttatagccttgtattgatgtctttgagctgagtgaatagcaataccctgtagttacctaagccagagatactgttcatctttgacttgtcctttgtttcccatatccagtctactgacacaaaagtgatcccattgtatttgttttatagtaatttctttttccttctaagaacccaaagcacttt

SEQ ID NO: 109626 - DNA, 4597 bp, Homo sapiens
ataatttacttggcttttccctaataagctctctcatataagcctttgacctgtatgcatatttggatagttttgttgtttttacaaaaaagctaaatctttctttcaaatttaggttagaagaagaagaaaagtttttaaatgctgaaagttactataagaaagctttggctttggatgagacttttaaagatgcagaggatgctttgcagaaacttcataaatatatgcaggtgattccttatttcctcttagaaatttagtgatatttgaaataatgcccaaacttaattttctcctgaggaaaactattctacattacttaagtaaggcattatgaaaagtttctttttaggtatagtttttcctaattgggtttgacattgcttcatagtgcctctgtttttgtccataatcgaaagtaaagatagctgtgagaaaactattacctaaatttggtatgttgttttgagaaatgtccttatagggagctcacctggtggtttttaaattattgttgctactataattgagctaattataaaaacctttttgagacatattttaaattgtcttttcctgtaatactgatgatgatgttttctcatgcattttcttctgaattggaccattgctgctgtgtctgtgacatctggtgctgctcatccccatccacaaactggaaaatgatttcctatgtaatcatgcatccaactgggctgtgctatttttttaaatggtttgtatttgaacatggtgattcctccttcacttcaccttaacggaatgtctttatttgaattttatttgtaaaatgtgtcctgtttaaatttttcaatctttaaaaataatttttatgtactttttttttttttttaacctttcttgcactctgggtcatgggtaccactgcaatggcttcccctttttttatgggataccaactgcaatatggtcctcaatgctgttctggccatttcaatgactaatgccaaacatctgtatgactaatttttttatgttaaaaaaatactgtttaatgctggctctatggtgatttggttttactaaattgggtttctcgttgggggtggtcttttgaatactgggttttatatattctgctatttttaacgtgtggtttttttcgatatctgggttctaaaagaaatctttggaattaagagaaaaacaagctgaaaaggaagaaaagcagaaaacaaagaaaatagaaacaagtgcagaaaagttgcgtaagctcttaaaagaagagaagaggtaaactataatattcagtatttttaaacttaaggcaactactgaattgaacccaaagtgccatactggaggtaaagtaaataaaaatatgaaagtatttcaagtgccaatcagtgactgttaagaatctttagcaaatatgtgttccatgtattttcttattaaagagatgaagtggaatttaaggctagaattctacaaaaaaagagtatcttagaattaaaatatagaataagttactttaattatgttttaggaagaaatattttagaactagagcagtggttctcaactaggggtggatttattcacccggggacatttgacaagatgtggagacatttttgattgccataactgatagggtgctactgcatctagtgtataatggtcagggatgctcttaaacattctgtaatgcacaggtcagctcccacccgcacccccaccccctaccaagaattatttggctgaaaataccaataatcaggtgaagaaaccatgaactagaggtagccaaataaaaaagttgagttctcctttatgtgttcagtagtcttaagtttttaaggtagtgttgaaaaaagtctgtctttcagagatgatggatttgcttacaatgatacctgtctgcaagcattttttcccccaaaagtgcttaatagtaaaattagatcttgtagtagccgagattattgtatcatttatctgaaccacagcttttataaaatctttaaaggaaacaaatagggcccacatctttatgaataatttagaaacatttttgtatatatatgacaaatgaactgttttttttaggctaaagaagaaaagaagaaaatcaacttcttcttcaagtgtttcttctgctgatgaatcagtgtcttcatcatcatcctcttcctcttctggtcacaaaaggcataagaaacataagaggaaccgttcagagtcttctcgcagttccagaaggcattcatctagggcatcctcaaatcagatagatcagaataggaaagatgagtgctacccagttccagctaatacttcagcatcttttcttaaccataaacaagaagtggagaaactactggggaagcaggataggttacagtatgaaaagacacagataaaagagaaagatagatgccctctctcttcatcttcacttgaaataccggatgattttggaggtaggtctgaagatccaagagatttttataacagctataaaacccaagcaggtagtagcaaaacagaaaagccatataaatcagaaagacatttttccagtagaagaaattcctcagattccttctgtaggaattcagaggacaagatttatggttataggagatttgaaaaggatatagagggaagaaaagagcactatagaaggtgggaaccaggttctgtgaggcattctacctcaccagcaagctcagaatactcttggaagtcagttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttgaaaaagaaaaaggaaataagtcaaaaaattaatacaccaaggatatcggcaccattacacaaaatgccattaagtgaagtttttggttgtattagtcataacagttgagtgcagaaatctctgcttctaaaattatttgtagagattacaggaaacaaatgcttttaagtaagtttttctcaaattttgtttcagttctaggtcccttgtcacagcttggtttttagactttttatgtatatgtttatgtacagtatattactcttgacagtttgaatttcttcacctaaagataattctctgaaagtactgtttcttcattctattgcggtatatgagaattcctgggtgcatcttattctgctgtttgagagaaaaatttgtgcattgaacacttggatcatttttataaaaattaatttcattttcttttctgttaaattaaaaatcgtcagcttttgaaagattatatgttcgaatgtttcttgaacacttttatatttatcagtttaaatattacattttttgcccaattttttttaaaatttttaaatggtagattatatgtcttaattttcctctaaagcccaatttgattaaaagtggtttgtgaacagtcattggcttccacccagcataagtgccttaggaataagatcataaaagttgaataggagcccattttgcttatttctccattattttttacctcattgctagcatagccataaaaagctttttaactttaaatatttacaaggcccttagggcctgtattccacgcaagggtaaatcagaaaagaaaaaaatccttttagcaaaaacatagcagtagcagagaagcacattgtaaatctggcttttctttagggaaagaaaattgggagactctcctagtgtagcagatgttcagtccagaaggcactaggcatgtcgttaaatctgacctgcatttcttcttaccacctcctgtgccttgatgcttctctgatgacccctttctcagagtctgaataaataactagaccaactagagcctggttttactaagaataataaattccagcagctagagctgaagaacaaagagacttggattataaagatcctccccaaattgctgaaaatagtgtggtatattctttgggagacagatagagataggagtcataggtactgggtttatgatgtcattagagtttgcagtttaagattctcaaagctgtaaattacaatggactttagatactgtcacacacaatgacactagataagtgggtgggtagctgaggatctacagaggtctaagtgagggagaataatagaggaagaagagacttattccttgttctgtcttgcagttcttgccaacagtaaaatgtccaggccttaagtactgggtgtgtattatctgtgtctatcaaactccagtaatgagagcctagtgaaaaatctgaaatttcttttgcaaatggaacagtgaaaagaaaccctggtcaagagcaatagataatggtgatagaaatcggctagtcactcaaagcattagtctttgcaccaagaagaagcttctttaagaaattcatcttaaaaagagtccttaataattctatgtatta

SEQ ID NO: 109627 - DNA, 1170 bp, Homo sapiens
gaagcgtatgaaataatactcaacatcactaattagagaaatgcaaattaaaaccaaatgagatatctctcatcagtcagaatggctattacaccccattcaatgtaagagaatagtaccttatcctgtaggctgcctgaatttattaggtaggcgcaaaagtaattgcagtttatgccatattaagcagagtatacaaaccaatttctaaggaagttcatcacagcaaaaattattggggatttacattgtcaagaatagcgacatcttcagtaatttttctcaagatcatatattgccatatcttggtctccataagcagatgaagcatgacttttggatatgaggataagtgtccagatttggagataggttgatcccctgtcgcaccatttgtcattactacactgaagttgttagaactgttatttaaggattaaatgtagattcgtatgctggcccaagaaccaaaccattccacaaattctgtgctaagctccaggtggcaactcagtaagtagaagttatatagtgcaatttctgtgtgtcaagccctgtgcatcttttttatattatcaaattcggtaaacttgtaggtaactttctgtgtctatagtacaaatgaggaaaacagggaagtaactatccaaggttacagagctagtaagatacaacctctaccttcatagaagagtgtttaatattacttcaagttttaagtaattcccaaactagcacagggctgagaataagaactttgatgagcaaagtgactttaattagtttttaggtcttataaatctcatgcattagagcagtactttagccaaaaattttattacctaccttttttttcgcccaccttattcttgactttgctatgcctttttcctatttctaaaacaaaacaaaaaataatcaggagaactattcactaccactactgcttttcagaaagaagtacaaacaacagttctaaaataatgacagttgtaatgagcattttttcccaaggtttgaaggagacacatgtacattcgtgaattctaatacatttatttaaaatccagttttataatattccacactctattccaagagtacaaagtgttgggcacatgttataatgaagtgttaactggaaaaactactacatttggcagtctacct

SEQ ID NO: 109628 - DNA, 1017 bp, Homo sapiens
gtctgagaaatagttactttgaataaagaaaacctaattttggtgtcttgtagggtaaatgagattttcacattgcaatacgctcataatagtacagtaaatctttagaaatttcttcttgaaagattgttacattagaagtgagtgtagtttcgtgaaataatgaagcaaactattttctaacactacgaacatcagaattacagtgaaatacagcatttttcctatgcttgtataacatgtagccttgtcaagaatctgctattaatttcttcagtatgaagaaaacagtagagaaaatgagaacgttcctttttttttaaaactatcagtttttacacttaccactaagtttttacactttccactagataaaatgtgttgggtcgttttgtattttaaagtatatttttgtttttgtgtttacaactttttcagaagagattaaaatgtttatttgctgctctttttgctcttaacattactagagctactactagcactagatggcctagaagggctgcctactagtgaagaggaggccgggaatttaagctccagtactttaattgaagactgagaagtagatgtacttgtactcctagatgacctagaagaaaaaccagaattataaattcaatgcaaagtttatattttagtatagaccctctcattattggcaaaaggtaccataattccataagtaaagacatcaaaaaagtacatattaatagtgttaagtttttaaatgaccatcaatagatatcaaacaatttaaacaggaaaggaaagatgaacatagatgagtttcaaaccagtagaaaagtagtttaataagtatgttcctacatggtaaaaatgctttgaactataatcagttttttagagttggaatcattaagcattgaaagtttccaaaacagaggaaatagggccaagaggatttggtgctggcaaaaataattaaaatgataccttttgtaatttaagctgaagagaagagagaagcatattgat

SEQ ID NO: 109629 - DNA, 1033 bp, Homo sapiens
tccttttttatggctgcatagtattccatggtgtatatgtgccacattttcttaatccagtctatcattgttggacatttgggttggttccaagtctttgctattgtgaatagacaatgcacattcttttatctttcagtgatttgccttagtaagtactttctactagattattattttttctttcaaactattttgttttaaggagcaatcttaatgtgatctttaagaaattaaagttcattaaaggattaatgggtagatcataataactatgacctaccaactaataacaagtaatcatcagggcttaccactaggattttaactaatttacctaagactctgagcacttgtttttgtctcctttaaatgagactgttatctcttactatctacttccctaaaagagattctaaataactgtcttcttggtggaagagcaagagaatagaagtagcagtaatgatagttgacttttattgaaggcatattactaaaaatgcctgtagaatttacctggatgtcttcttgaagttctctgatttgtctttgtttgtatctgtatttttcatcaacagctcttttttgttcttctagttgaatttttagctcatactcatcacctgaaatgtagaacatttttagtttaaaatttcaacatactaagtagaaatcaattttaaagtattatgtaaattgcaccaatatttttgttatgaaagtttaaattttttatatccacttgtagaaaaacactatgggcatgtagtagccatttcttgttttgtcaacatagagcagcaatatgctgccattttttttcagtctttgaattaattaccctagagaggtgatatgccatacagatcctgaactaataatggaagtaacaccctagaaaaccacttagaaaaaaaaatgtcgtggggggaggaaagaaaagggattagtttttctgacccaatctaacatagtttgcttttgttcttcctcatgtctcacagtgttccttttaactatacactcgtca

SEQ ID NO: 109630 - DNA, 1035 bp, Homo sapiens
catgggtaggaagctgtggggagtacagtctgcttatgtgtcactttcacagcagcctgcagcagggcagggggaattgtaaagataagttttattagtaatatttccattcttaacattttcactggcatttattttatcgtgcttcagaacattagttacacatattttgtgataagtattacataattttaaaaagtttagcaaaaaaattatagaaattatatctaattcctttgagtctcaaattggtaaccccatttcatctgaaatataaaagaatagtgggaaaatgagctggaatgagccaaacaaattttagttgtggactactgggtcagtttcttcatttttcaaatgaaggagttgaatttgttcattttatgcaaattcctgatataattccatgtatagcttgaagttctaaaattctgattccattcgcttctaaatcagagatgatatatctctcaaaagtctgtccaatattttcaagtaacttaattggacagtgtcattaaattgcagtcagaactatactgtttccttataaagactaagaggaacttggaaatgagatttgaaaaatactagtccttcactggttactaattatatttttcagtttggcctttaagggttagatattataagatactagagttgatgaaaaagccatgtatgccccatagaacaaagaccaaagacaggagcttactacaagaccaaagacaggagctatgaattgagctgtgtcccttataagaagatatgttgatatcccaacctgtggtaccccagaaggtgaccttatttggaaatagggtctttgcagatatagtcaagttaaatggaggtcattaggttggtcctaatctgatataactggtatccttattaaaatgggaaatttggacagagggaaaactgtgtgaagagacacaggaaggaacaccatgtaaagatgaaggcagatttcagggtgatgcatttacaaactaaggaacaccaaagattgtcagcagaccaccagaa

SEQ ID NO: 109631 - DNA, 1039 bp, Homo sapiens
atggcaatattaatttcttgtgggatgcagctaatataatacttagagggttttttttacttcaaaactgaaaattaatgagctaagcatctgaagaatttaggaaaataacatttaaaaaccctgtataaaagaaggaaaaaatagtaaaggcaagatcagaaactaatgaaataatgaatggacaatagaagatagcaataagagcagatcctttccaaataatgttaatactgattaacttgtggtgagaattatcctaccccaaaagaatgcacaaataaccaatgtcaggaatataaaaggaatcatctctaaaaatactacaactattaactaataaaattataaacaactgtatggcaataaatttgaaatttggataaatatagaaaatttttcctagagaaaaatagaatttaccaaaacagaatcaataataaatacaaaatctgcattgtcctataaacagtatataaaccaatagttgaaaatgttcccccatagaaaacttcaggctcccaatggcttttttttccagtggggtctttgaaaaacaaaaaagatataattccactcttttagaaacatattcaatgtatagaaaaataagaaatacacacaagtcattttatgaagtcagacataaccttaatagcctgataccctgacaaggacagtagagcaaggagaattatgggtcatttatacacatgaacatagatgcaaaaattgtattaaaatattccctaacaaaatctagatgtatgcaaaagataatatgtaacagacaagttgggtttattctagaatgtaaggttggtttgactttgaaaaattgatcaatatgattaaacacaacagattgaagaagatacatcttgtcaataagtgctgagaaagcatataataaaagtcaacatccattcttgattaaacaaaataacttcttagtaaaggataaaaatagataggagctcaatgtggtaaaaggtatctaaaaaatagaaataaactacagtaaaccttatatttaatg

SEQ ID NO: 109632 - DNA, 1044 bp, Homo sapiens
agatgtgattatatgctaatatattctagagaatattcacaaccattggtgtttaaataattatttaaaaataatgtctgttaattagaatatgtgatcaattcatataaaacatgtcatttctcaactgttttttaatggatatttcttatttgtagataataagttttaagtctaactgaaactttggttttctttagttttcctagaccagcgtagtatctgaaaactattgacagtattttctcctagcacagttcattgactttcttacaactagtgagcaacaccaactatattgtaatcacagtctaatgtaatgtagattttagagtagtggaattagtagtacttaatgtaagcaatttatgggaactttgttttaatctaatggattattataaatatttgtattcaaaatttctaaaattttaaaagcctttttatcttgtgtgttattctgtagtctctttgcaaagcaagggagcgtgagactgaaagtgaagaacattttaaggccattgctcaaagagaattgggacgagtgaaagatgaaattcaacggctggaaaatgagatggcttcaatactggaaaagaaaagtgataaagaagtatatgttgaaatattacttaaaattctgtgctactgctcattcttccatcaccaaatgagcattgacttttttttttcttgtatgggaaaggcatacattagtttcctagtgtttacttacgtattttttggacagtgaaaggcacatggagctgtgatttgaatgaaacaataatagaatagtacattttcccattattcattcatcagctacttactgaggcttactatatgcaaagtaccatgcttgctgcctgttataaaatactaggcgtggtttatatgtaagtgttagatttttaacagccacattttaaaaaatacttttagttttgaatttcatttaaaatattgacctttcatattgatttatcagttttgtgactctaacattaaactactttaacctatttctgtcttttctttagt

SEQ ID NO: 109633 - DNA, 2769 bp, Homo sapiens
agctgttgtctgtcagtcaatctcactaagccagcatctcaaatgtttgagagtcttggctatttttatgaagggccttcttctaatacatgagtattgtgcgtatgcaaagtgaattctcacaggttttcatttcagcgtaccttttatcctatgggtttttattttatttggccacgattttctattttcagcattttgattttcttttcttagtttactgattagctctgtggatttggtttaactgtcacgtggtaccagcataatggggaatcacagcgtataaaggatccccctaagctttttgcaagtttaaatctccttaggtggtaaacttaaagtaggaacagtgcctgttggaaatgagactttatgttaatgcgtgagtagttaacattgacgttctcggtttaagacttgatgtcagaccaatgacctaggtgaaatttgagtacatagttaattgacttttgttgttattgaaacctggtggttgctttccctggactactgcagatacagttcgctgggtaagacggcgaaaagaatagacttatctatgtttttcctatcaattgtagataagtcgttttgcatcaccccccacccctttcccgaaaagttttaaattctcactatttggccctgtagttcttgtataagggaggtatgcattttttcttgcatattggaaaaaataaagtgattattttgctttatttcatggttctgcatcatgcatgtggtagacaactatttttagcaaagtatatttgtcaatagcctgctatgcaagatattttttcctttttttaataaggtgaaggtaattttagtaaagattgtttgcagtcttactttggtttctcacggtattttttttttccagtcaattcacaatgaatcaaatgtccccattttggaactctgaagtatttataattgatctctatacatatctacaatctactgcttgtttctacttagactttgactccattactcattttgcctcacaaagtgagttggtactttgacaaaggttggaaaggacactagccacctgtgtgtgcactgaaatcatgtacgcttgaacatttggaattttatgtccagccataatccacttgcatatgcactttgtggaaactgtggtcttcagaactctggaagaatgagaatggcggagtggaaaagagtcctggatttgaagtaaacagatgagaattctaggtctgtacttcaccttaccattatctaacaatggacccctgaacaaatctctctgtctaacatgaggggcttgaagtagttctgtgatccccagtatatttttatcctattaaactgctgacttgaaaaccattggcttattgcacagaagtttattgctttttattcattagaatgtaaaagttaatgttaatttacatacagtaaaataagccttttttggtgtacggttatgaatcttgataaatgctgacaattatcaagattaactgtcactttaactgtggtggtgtcagcatttatcaagattcatagcccccaaatttccgtcatgcccttttcagtcaaccattcctcaaccccagcttctagagtgttttctgtccccatagtttttcttattcagaacgttacgtatatagaatcgtacactatattgtgtagtgttttgagtccggcttccatttagcgtagaagcaatttaattttaattagtttttttccaatttagaagataatacatggtcactgaggtaattttggaactcagcaaaaactagaagttgccttgagatgagagctgttaacattttagtgtatttctttggttttttttggtggtttttcaatgtacaggtgatctgaatttcccttttttcccctcctcttaccccgtataggcagaagacacacatttggccgtaagtgtgaattgccattgatgagtttcaaagtcagttatcatgccttgaggcagtactctgtagactttgattaaagtttttgtagtagaactgaaacttcatttcacaaattaattggaaccagtgaaacgctgaagatctgaatattttacctaaaattagggtagcctttaaaaaatagtatgtacacaaatggtggcatgctaaatacattgttctgcatttaacagtggctctatagttagagatattagaaacttgatttgtgcatgttcgtagccctataaatctgcggggatgagagagaatgggaagatgttaattaagcatttgttggtgggctatgctgttatataaaataacattataggctttgtacttttgtacttctcatacctaaagtagcatcttaggttttatactactggacatttaaggtgtcttgaaaaagaaagttttaatgaggtagaatgtatattctataaaacaaccttttttaagtgtacagttgaatgacagtgtatttacagagttgtgtaaccaccgccacagtcttccttcagaacgttccattaccccacagaaacctccggctcatttgcatcattaaagtgctttttaactgatgtataaatatatattagtctttgtaatagcattgcaatttgtatggccttgggctgagtataatttcattttatttttattttttgagacagaatcttgctcttttgcccgggtgggagcacagtggtgggagcgcagtggtgcgatctcggctcactgcaacctccacctcccaggttcaagtgattctcctgcctcagcc

SEQ ID NO: 109634 - DNA, 1909 bp, Homo sapiens
acatttttttgttttcttgagacggagtcttgctctgtcaccaggctggagtgcagtggtgcaatcttggctggctgcaacctctgactcagtggttcaagcgattctcctgcctcagcctcctgagtagctggtatttcagggacgcaccaccacgcccagctaattttttgtatttttagtagagacggagtttcaccatgttggccaggatgttctcgatctccaggatggcctccatctgtccgcctcggcgtcccaaggtgctgggaatacaggcgtgagccaccgcgcctggccagagttaattacttttagagctgtctgcttccaccgtgtaactgtctacaaaacaaatctcaaagtactatatttctataattccctgtttagcttgatttaatattaagtggaatttgagcgtaatctaaattatgcatagatatattaataatgatgaccaatagaattatagtaaaaagttgcgttcagagggtatgctgacttttcaaggttagtacagaatcttgttagttggtttcattgtggagatttgtaattgaaaaaacgataattgtcttaatattaggccaccctgttaatttaaaaatacatagttccagataatttaaaatggttgttttgcatatttaaaaagataattttcattaaaatgctaagtaatgaagatttaactggatgtcaaaataaatgatcacaacagcttttattttcattcacagatagttgcaaaacgtggaggggaaggaaggctgggattttctactctatcttgctgatggtgatcacagttattaaaaagtcaacttaggccgggcgccgtggctcatgcctgtaatcccagcactttgtggggctgaggtgcgtggatcacgaggtcaggagttcgagaccagcctggccaacatagagaaaccccgtctctactaaaaatacaaaaattagccaggtgtggtggcacgcgcctgtagtcccagctacttgggaagctgaggtgggagaatcgcttgaaccggggaggcagaggttgcagtgagccgagatcatgccattgcactccagcctgggtgacagagtgagactctgtctccaaaaaaaaaaaaaaaaaaaaaagtcaatttaaatgcatatatttcttgtaaagttttgtgttttgtattagaagagcaacacataattacgaaaaatatgaaagcagaaaagcacatcttacctatctagagagatactgtcaaggccctggctttaaatacttccagaaaacattatttttccgtatttttacttttatgtacctgttattttctatgtcagatatttgtgtgccttctgtaagataatagtttaagatgagagcctgttctttactagattatgtattaagcttctatatgtatttcctgattttcttttcccaagaactctgtgaggttggttttatttttttaatttttattttttagtagagatggggtcttgctatttagatcaggctggtctcaaactcctggtctcaagcaatactcccatctgggcctcccagagtgctgggattacaggcatgaaccactgagtctggccagcattagggatttttcaaagtaacttttaggatagtgagcttacattttcattaggaggaaaagggcagatactttgctggattatcactctggataagttctctatcacagtgtttaaggttgtcaaattagcttttttgtagtgggaagagcaatatgcattcattccatgattgacccctaattcttgtaatagtttttaactggcaggatcatccaggtaaacaccttggttttttcatatgcagtatgaagcagttgtatttcctttaacctatttataagttgtgaaatctttgctagtt

SEQ ID NO: 109635 - DNA, 1310 bp, Homo sapiens
ctgcctcagcctctggagtatctgagactacagacatgtgccaccatgcccagctaatttaaaaaaattttctgtagagataggtcttgttatgttgcccaggctggcctccaactcctggactcaagtgatcttcctgcctcggcctcccaaagtgctgggattacaggtgtgagccacactgtgccctgcctccccatccttttaacttcttttcttatattgctggtcatagtgagattttagtttttaacataattttttttttccattaaggcttctgggtttccagtcctggttaagacagtctgtgcccagattatacatacaatttcttaggttactttggagttttatttttacatttaaatagtacgttaatatttttgcatatttgtatgtataggcagttatgctagtgccatgtattaatcatctctgtttgaaagttgtttttcttgcatgtgtgtctctccttagctgtatctccctcacttctaggattgggatgagaggttgatgctcagcatcctggagggctggatcccattccagattgatagaccctcctgagaattactccaaagagtctggggtgtcctgggaataccatacagagatctcgagaagggaacattgtgatttgctttttggcaaataaggccagttagggatcttattttccttacattactgtcttggatcctctcttgttatacacagtaagtagtgggatctgagaccttacagtgaaaccactgtattgtagtgccttcatttagtgaggcttttttttttccttgccctgataaggagccctttatataatctgttaactatgtagacagtccagaaactttattatgaatcttttaaattactttacttatcataaaagctccaggaagatttaccatggtagttgtggggagggagtagctttaagtactcctagcacatctttgagtgtcagggagtaccccagtttaagaatcttcacctcctttattttgcaaatagagaaattgttgtttcaggagaccggtctgttgatctgtctccctatgttgcccaggctggctggcctcgaactactaggctcaagtgatcttccccgctcagtctcctgagtgggttgggattacagaccctcaggcatccttcttgagaactttaaagttgcctagataacgatgatcacccagatctgggagacaagtcagacttttgcagcttgagtttctgtttttttttgagacagagtcttgctctgtcgcccaggctggagtgcagtggcgtggtcttggccc

SEQ ID NO: 109636 - DNA, 3696 bp, Homo sapiens
tttttttttggagatggggccactctgtcacccaggctggagtgcagcagcatggttatggctcactgcaacctctgcctcccaggctcaagtgatcctcccgcctcagccttccaagtagctgggaccacagacacgccaccaggcctggctaatttttttatatttttggtagagatgggattccactgtcttgcctaggatggtctcgaactcttgagctcaaggtgtccgcctttcttgttcttccaaagtgctgggtgcctgggcttgctttgttttttattacttaagttacccttcttccatttactttgtaagtttcaaaaaaaaaaaaaaacaacttttttgttgttgtaagttgccttttccctttattctcttctttcttttgggtttattccttcaaatctctttactgttagttaatggacttttgggaaggagtgagataaacagatgtgttcatttttgtcttactttgaccaggtactatacatgtgtttatatagctagtgtgccttggacattatggagtctagtgtgataaagatgttttagaaaagtatttcctatgtacaccatggttgaaagtgtgtgtaagcatttgactaacattcagtaatttgcagttctgattcatagtaatataaagtcatttaatgttaattgtaattatataagtgccaaggactgcttgcctatggttacacagtggtggaatcaggatttcagcaacagtaattctacacccaagtcctttgctctttcttgagtatgtcagatcttatggtttctttcagctgtattaatcaaaggaagatagaataagaaggctaattttaatagtaattttaaggctgaaaaatgaccgccaattgttattgagaatctgtattcattccaacataatcgtgaacagtgtactcactatagcccaattttcttttaagggaagggaaagagaagtatgtaggaaaaataagattaagttaatggcaaagatagtattcaaaatggagtcatgcattttactgaaggtgaactataatgttgataacatttataacaaaattgggttcttactttgtgccaggtactgtgctaaacattacttcatttacttctgataaatttttcattaggtggatgatactgtaattaatttcattagatcaaaactgtattcaagaatatacaagtgatagagcttgggtatgaatcctggcagccagtactccagagcttgaactctttgtcacagtagtaaatactgaactcttagtcacaatactaaataactgccttgctgaactaatacctgaggtgttccagggatgtacatttacttttgctaattcccaggtagatgacaccgggtgaaaaatgaggttcagagaggttaagtaacttaaaagatcatgtgtctcataaatagaatagatggaaatcaaactcacatctgcctaattccaaaccttgtgttcttttagtactccctattatctttgaactaatacaaccttttagagttacgaagtgctttaatatctatgcttttataatgtttttgtgtcttgcagggatttatcaaagatgttcatgaagactcccttacagttgtttttgaaaataagtaagttatttttgttgacaaaggccttaattttagagatggcagtgccaaactttttgcttttgggtgttcctactgccagtggaaaaatgattttgcttttagggagtggggaggtttggttgtttgatcataagtctagttttgataattctttatctgtttttctgtccataattgtcacttttttcataaccctcttcgccagaacatgtatggatatgaatcagttttgcagaaatagatggcacaaattagatgataatatgcttaatatttaaaagcccagaattttcaaatgaggttgtagaaggtcttccagttgactactggtcatcagaataagtattaagccatttttaattgcctgaggggtatgcagtctaaaaatgggaaagacagcatgctgggtttggttaggaagggctataaaagagcgctgggctgcgtgcggtggctcatgcctgtaatcccagcactttgggaggccgaggcgggcagatcacttgaggtcaggagtgtgagacagcctggccaacatggtgaaaccctgtctctactaaaaaatacaaaaaaattagctagtcatggtgggggggcgcctgtaattccagctacttaggagactgaggcaggagaattgtttgaacccaggaggtggaggttgcagtgagctgagacggcgccattgcactccagcctggacgacaagagcaaaactccatctccaagagcactgtttaattgatggtcagaaaaaaactgttcagcttccacttttaagctgtttctggaattgcctgaaaagatctttgcctaacagctgcttcatgtagaaacaagtgttgagatgatttctatctttgagcagctgccatttggacagtaatggtgaaaagaaagcatccccaaatcttttacttgtcagctgctactttgcccagccttggcagatagaaacttgagggacattttatgtcatagtatacttcccagacatataaatgacctatgagaaattagagtagggaataattttttactttataatttcagcttttaaaatacaacatgaaaaatgtcagttaactgctaaattggtttaatacattcgtatttgctacagagttaaaagtaagctttttctaggttctaattataatgtatatatccactgtaggaaagataaatggaacgtgagaaaatgaaatcttttgtaattcagctattcaaaataattgctgataattttctgtatttctgtgaacatgtatactaaaaagaattacacagtttatattgttttgtaatatatgaaattgtgtttcctttattgataggtcatgtagttgtgaaactatttgaaataagttgataccactactatttattgggcagctgtccgaatcaaagttagtcatcactgtgaacttagcttatttcatttgcagaataatgtatgtattgctcttatgatgagtaatttgggagaatgtgtactgctgttaggatgagtaatttgggaggtaatgtacaattgttaacaattatgttaattatgaacttattaagagtcatacaaaatctgttctacttcagtaactaatttcttgggaaattattaatagtatgaatgttgttttccttctctttagggaaagctaaatgataaactaacttgaaaaaatatgcaacaccaggcgtagactatatatttttaagttgttaatacaccttttctaatccttcagttggcaaccagaacgccaggttccatttaatgaagttagattaccaccaccacctgatataaaaaaagaaattagtgaaggagatgaagtagaggtatgtatttttaagtttattttcttgtgtctatttttttgatttaaataaatactcttttaggagaattagcttagttgatggaggataaatctaattcattttctctattctttctattggtggtaatagctgtgtaatacagcagtgcttgagttttggagttagaatcggtctcacctgtcccatttttagctttgtagactttaaattta

SEQ ID NO: 109637 - DNA, 1037 bp, Homo sapiens
attggtgttagagattgaatgatttagaaattgaatctagagttttttttaaatttcacgttatgttttatgattcagctctggtcaaatttgctctctagaattttgtaagtcattatctgaaattaaaatgtgattttttttcacttttgaaaaatttaaaaattaatataaggaaaaagtttaagcataatcttgccacccataggattttgtttttttgtcaccgtttattaaggatttatccatattacgtagagtgtttagaaattcggagttagtgctttcccaggtaacgtttcgaaagcctcttccccttctttaaatttaaagtaataaagcttaatgtaaaaaatgaaatggtaaaaaattatataaagtacaaagtaaaccttccatcttaatgtaggtgtacttgtccacccaccctatcttaaatctcatttaccagagttgattctcttgtaagttttttatttgcatgtataaaggacatatttaagttgaaaaaaaattgggattaagttatatatttgtgacttttgtattcacttaattaggacagcaaacattttcgtgtcttctcatttaaatttacctcattttttgtaaccacctcaaaattatttggtgtggatatatcaaattaaaagacattgaaattaccagattttttgctgttagcaaaagaaaacaatgccagagttaaagttaatattcttatgcaagtctggtagtataattcctaagaggttaatgtttttaaaagtattaaaatgtaccatttcatcctccaaaaatgtcttcagaattactttatacttttattaacactggaggtatctttttcatacattaagtgactgtattatattgttcatatgtacagttttgtaaacttggtggatggaaactgatgtctcatgaattctcatttccttaatgaatagtagtatgggaacatcacttaaattagttggttggctcttaaccccttgttctgtgaattgtctattttttgtttgtgcagtttttgg

SEQ ID NO: 109638 - DNA, 2403 bp, Homo sapiens
atgtattctgctagatggactgaatgtgtgtaatttttttgttcagttaaacaattttagtacatttgatttaggttctttagcacgggatctaaatgtcatatcctcgatggaatttaaaaattacgttaatcactttctgagaacaatttttaatattaacaatgttgacagaaacaggaagacctgtgttttacattatttaaaactcctttgtaagagcatttctttaaaataatacttatgtttagtaaacctcatgaatatggaattaatttctaagaagctaaattgcccaaaaaagtagttttatttttaagtagtaaatttaagttacatatcactttctttaaattgcatttaatatgccaatttaaataaaatagcatttttcattcttaagtttattgggattgggtattaataaaaagtcatttacagcattgaaatcttttgggatgaatggatataggcatttttttttcttctcaggtatattcaagagcaaatgaccaagagccatgtgggtggtggttggctaaagttcggatgatgaaaggagaagtaagtactcttcacacttgctttgtgactagtttctaaggaagtacctcagtgcttggtttttgtaaatcttatttcaactgttagttttatttctaaaagcctacctgagaaatagttgatcagacatttccattagcattaatttctgtttgtgttctgtattggcaaacaccaaagctgctctccagaggtacacctcaagcatgtaaggaccgccaaggttcatgcttgtaagaacctataatctagtttaggcaaatcagattgatgtagctaagctgtgcttagtattttatgccacatgggggagggtccgttggttaagctgagcaaggtaattagaacttcatttaaacttcattatttttgttcagatgggatttttaaagtattttgatgtcttttagttttatgtcattgaatatgctgcttgtgacgctacttacaatgaaatagtcacatttgaacgacttcggcctgtcaatcaaaataaaactgtcaaaaaaaataccttctttaaatgcacagtggatgttcctgaggatttgagagaggcgtgagtaattttatatactattgaattgttctgtgaattaagaagatttttcagtcctacaaaacattttccctaatgcccaatcaaaccttctgatggaaaatcatcttaatgaacaaaggttttagtggggcttgtcaaaatgaaacactgactttgtattgtgactctcctctgactttaatctgttattgagttcttacacataaattgatttctctctaggtgtgctaatgaaaatgcacataaagattttaagaaagcagtaggagcatgcagaattttttaccatccagaaacaacacagctaatgatactggtaagatagtaccatattataaggtagcttattaatggatattgcacagattttataattacatatttcagaagagaaaagctaagatcaacttagtgtatagtgaatttattaatatagtgtgggagaaaaatttgtttgcagctataaaatgttaattacattcttaacatcataaaattcttaatgtgtgagattccggatttttccccaatcaaacatattctgaatagcagatctaaataatacaggaattcagaaaggaaagtgtgattactcagagtagtgagtgttaggtgaaagaagtgtagtagatgagaagcaaggaaggctttgcatagaagatgggatggtgtttgtgctatttggaagaatgattaaagttttgagtaattagcttgtttgtttatagtctgccagtgaagcaactgtgaagagagtaaacatcttaagtgacatgcatttgcgaagtattcgtacgaagttgatgcttatgtccagaaatgaagaggccactaagcatttagaagtaagtgggtttacttacaaaagagttttctgtgtcccatttagtttttgtttgttttttggagacagattctggctctgttgcccaggctagagtgcagtggcacaatcttggcttactgcaacctccacctcccggattcaagcggttctcctgcctcagcctccgtgtagctgggattgcaggtgtgccccaccaagcccagctaatttttgtattttagtagaggtggggttttgccatgttggccaggctggtctcgagctcctgggctcaagtgattgcccgcctcagcctctcaaagtgctgggattacaggcatgagccaccgaacctggcccccatttagttttatatttttcaagttccttgcttcaaacgaaggcagcccaggacctctgtttcgtgactgtttggagttgtgtccgtaga

SEQ ID NO: 109639 - DNA, 1055 bp, Homo sapiens
aataaaacattttgtggccgcgtgtggtagctcatgcctataatcccagcactttgggaggctgaagtgggaggattgctttagcccaaaagttcgagaccagcctgggtaacatagtgagagctcgtctctacaaaaaataaattaaaaaaaaaaaattagctgggctcagtggtgcgtgcctgtatttccaactattcaggaggctgaagtgggacgattgcttgagcccaggagattgagttggcagtgagccatgatcacgccactgcaccctagccttggtgacagagtgagaccctgtctggaaaaaaaccaaaccatacaaaaaagccattttgtattttgatcttttatattactaattttccttttttattagtgcacaaaacaacttgcagcagcttttcatgaggaatttgttgtgagagaagatttaatgggcctggcaataggaacacatggtagtaacatccagcaagctaggaaggttcctggagttaccgccattgagctagatgaagatactggaacattcagaatctacggagaggtaagttctctttctcctgccttggcctttagtgtattaaccatctattgtttgattatatttttatctgaaattccagtttcccatgaaacatttttgaggtagaatttattcaattagcatcagtcagcctagtagtcttacttatgaagctgaattgaagttaactttgtattgaggggagtgaaagatttactaagtaattaaatatgtagtttttttattgaggtttcttaaccgcttctgagtttacttcagttttatacccgttaacaaataatctatcgaagtatttttttgaatgtttactgtgtgccaggcactggcaggagtaaatggcatatattagaatagcttttctagaacttgagtttgtataatacttcgtcactggttaatcatgacgtttgcaggggtagaaaattagtaagttatttttaaaatgttattcagccaggtgcagtggcacacacctgcagtcccagctacttgggaatctgag

SEQ ID NO: 109640 - DNA, 1934 bp, Homo sapiens
aattatgaattttgataatcttaccagtaggtacttttaaaaaatgcatctctgcaaaaatagctttttaagtcatatacctgattttgagaataaataaatcagacaattttaacaatttgtattgttaacatttaacatgagaatttcaagcaggaggtatagactagtatatttaggattgggttaaagttttggctgttcagcagctgtgtaatttaaactctgacactaaatttctcagcagcttaaagattttagagatgttattttatttttggttttaatagtactgactgatttggggtttttaaaaatgatttttttttaagtactttgtgaatcacttcacctgaaatctctccccagtggaatgagcataatcttttagtagaacataatcattcagaattttctcttttctcatcttcttgttttggattatgggttgctccgagattgaaacaggatttcatttttacttttcccctcatctacagagtgctgatgctgtaaaaaaggctagaggtttcttggaatttgtggaggattttattcaggttcctaggaatctcgttggtaggtacttttactaaatgttaaataagttaataaacattatttagttacatatagcgacttaattgaaaactagtcttgtagtctgataaccttattccagttatgtgtagatttatttagatagcaatacttcttttctttttttggtgataacattttgtgtaacttgttattgtcatatgttaaaaagtaaagatgtttcttctgtacaggatgactcactaataaggcccagggtttttataagtttgtcattacagtttttcatcagtcttttcatcccttgggatcttccctattattctcactcctttactctctttttatcactgatatatattcatcaaaattatgatagtactttttgagaaggtattggtgatatttgttttgtttagtgcagaagaaaaataacagtgaactaacaatagggtaataaacttctacacagtaggtcctgaatagtaggttgttgcaaggcatagaataataagaagttgtgggcaggagagaaggatgataatatgaggggaggtttcactgtttattatttgacaccattattgaaactgttgtacccatggattatagttaagtgacaagaatttgcatttgaagctatggttaaatgagcattatagcttggaatgagttaatttatagctctgttattaatatgcactacatctgtgctgtctttttgctatttgaggcaattgggaaggctttggttatgtgttaagtatgcagtgactatactaaaaattgacttacctaaacatttaatataaaaagaagcatcaagataatgtagtgtagttttactaggagggggacgagtttttgttccctgttatctctcattatttttttttgacgctagggaaatactttcagcttcttgggttccatttatataatgcggcctgttctgcctttaggaaatgatgtttagctacggacattctatttgttaaattgtataaaacaaacgttaatagaaaaataaatacttccattctaaaaagattttttttttttttttttttttggtcattagtaagtagtatattcaggaaaagtagtttaaaacacaggaatttgtttcttggaatttaactgttagtatttatgtaaaaataaattttttttttttttttttggagatggagtcttgctttgtcactcaggctggagtgcagttgcagcgatgcaatctcggctcactgcaacctctgcctcctgggttcaagcgattctactgcctcagcctcccaagtagctgggactacaggcgcctgccaccacgcctggctaatttttgtatttttagtagagatgtggtttcacca

SEQ ID NO: 109641 - DNA, 2567 bp, Homo sapiens
agtacctgttgtctcttttcctgtatcctgtctacgttggctttggtgatgtgggttgtgtgctctataggaaatacacattagcagtgactattacacactggtgaaatactcaggagtagtacaagaatttctattggttgtcatgtgtaaaaatacagtgtttccctccataatgttttatggatgaagcaggcttttgaataatagtacattcttagtccaaatgaaagaaaaagagaactgaggattaaaagggaatgagaacacttgggtaagttccagagaggatttccttacacattcgggttctgagagttctaagatgaccattcccacccctcccaaatcaaagggaaaaatatctgaacgttgatttgaaaatggttcaaaacctttcacctccagaagccttccttaatcacttctctctgtcccttcagcatttatattcagtgctcaatttatactacaggtctacttcagtttgtcaatatggtctggaatttaaactatggaaatgatcatttaaaatattgacggtctgtggtgggactaaataaaacttgcaggtaggttcctgccaaggaccccagaagggtgatggatgatcactcaaaactggtatagttcacaagaaggaagtggcaaaggttctgggggaggaatatggtatgtcaacctaatctttgtttttcgaaagacatttgcttacttttagcagggtcaaggatggagttgctgcttgagcttcactgtgttaacaatgaaggttgcttttatgtgctgctgctagggctgctcagagaagatacacgtcatgtgaattccctgccctactttttttttttttaacatgttcaattgctgctgcttttaaatttaggcttattaatggggaaggaggcttgagagtaggaatacaagagagaaaaacccattatagtccttttattgtactgaccagtctactgttgtcgttcttattcattctttaatagaaactgttcaggcatgcaacaggaaaatcttccattttaactctttcaaccaaggtttaagtttttgtgaaaagtgatatacttaaattaactgaggatgtggacttgataacaaatatgctgtcgctgttcactgtctaagggatacatcggttccatatggtgaaggttacttaatagtacttgttaataggtacacaactcagtgttgctttgttatttatgtgagtatgtgctaatctttagatagtcctttagggaaagagagccttttgacccctttatttattaatatactcaataactgctgtttgacagacttacaagttaagtgtagaaagttaaatacttgaattttatgtaattttacaatattttatacctagcaagacagcatatcatgtacatgctttatgtcattttttatatagctgtggagtacttgaaaaacttcttggtgtaaaatataatacatgtaaatattcattctaaagttatcttcaagtcatagaaatctcttggacccatagaaacttgaaaataaaagcaagattgatgaatttgctacttatgtgaattaataaagtgctaatgattaatgtcaaaatagtttttctctttgcctttatgtatacatccaaggttttgaaatgggttggatattttaaaaatatgaaaatgatataagcatattttaaaagtctagattttgagaattccttacatgtgagcactgttgtcagtcccagttagtaaccttaggcgtgctgaaagagaagtaagtttcagaccaagggtgaaatttcttggtagtctgtagggcgagttaattgatagtaaaaagatgggagcttcacttgatggttgtaatttagtagcaagttacaaataattggggctgacactgaaagaatagcagaattgagttttagcttaccattgtatttgttttctcttactaaaggaaaagtaattggaaaaaatggcaaagttattcaagaaatagtggacaaatctggtgtggttcgagtgagaattgaaggggacaatgaaaataaattacccagagaagacgtaagtatttaaaatgtaatctgcctctttaaaatgtcctttttttggccaacttaatagttgtaaacattttgtctgttttatctgatacagagggtttttcttctttttaaaattatgtttttataatattatttcatacacttagaaaacaagtcattttctactatgtgggccttgttcttagttgttttgatagtacttcagtaaaaaaagccagttcttgacataaagatttctatttgataatcttaacagttatttttcatacgtagagtgtaaagctgtagaacttgatactccaaaaggaattttttttttcaatagtttttggggtataggtggtttttggttacatggttaagctgcttcagtggtgatttctgagattttagtgcacctgtcacctgagcactgtacactgtatccaatatgtagtcttttatctctcacccccctcccaaccttcctccacactgagtctccaaagtc

SEQ ID NO: 109642 - DNA, 3310 bp, Homo sapiens
ttaaatattttttgttaattcagcttcagatttgccattgttctacatgagaatttaaaaagtcctttgtcatcataaaatgattggccttgtgtgcataatttctcttctttctgagcttttatatttctttctttcttaagaaatgattcctttgtcttcatgcaatttgactctcagatcacttatgtatctgcatgttcatactggagccattttgtttttacttttgtactttacatacaaatagggtacagaaccaggagtgacattgggcttccttggtaactttggcattatgcaaatcatctgcatcatctccactgacattactcgataatttgtaaccattgttaacaaaatagtctatttgagttgatacataaagagcaagggtttttagaaaaatatgacccataaattattaaacattttaattttattttctactctttcccttttattcctgctgtgtttctttttaaagtataataatatcctcacctgttctctgcctctagtatgttttcctcccagtctgtcgtatcattgttgctgttactattttgagatcactctgataatgtcatttcttttcttttgaaattcatctttatatgaaaagtcgcaattaaagctggcattttgaagccagtgctttatctttcagtactcatcttttaaccaagagctttctctagacatctaacctttgcatcctgtaatgacctcaatttctgaatgacaaagtctagcactccttctaggtcacaactcgtgtcactgctttgataggaaagtagcttgttaatagtacctttcatagatgctacctgtatctcattcagcaattctaactccttgagggcaaaatctggtaatattgtataattgttagctatttaataaataacttattttaaagctgtctgttaaacatccccttgattggggagagtccatgtcttcttttatattgtatgcctatagtagcatgtttggcacactctagaccattcagtaaatgttgaacagaaacagcaaatgacctcatcaattctgttgactaggaacacaatgctctttaccatctaattgcctaaggtcacagctttgatagggagtacagctttagctttaggctttaggaaaacaaaaagttatatataagaagacttactcttttttgttttgattgtaggaagtagaacagctaagaatggaacgcctacagattgatgaacagctgcgacagattggtatgggtttcagaccttcttccaccagagggcctgaaaaagagaaaggatatgccactgatgaaagtaccgtctcttctgtacaaggttctaggtcttatagcggaagaggcagaggtcgtcggggacctaattacacctccggttatggtaaaaaaaaattttttttttttttttttggtaatagtaataatagtagttatagtttaggtgctctaacacattttcttataattagttcattactctgtcttggctttgagggtagaaggtagttctgaaggtttagtacacgtcttaatagtagtgatagtatacattaaaatgacagtaaaatatataaaatttccaagcagttatgtaatgaagcaaagcatgtttttaagttggtagttcattgtcatgtttattatatttacaaagaatacatatgtaacttgtttttcaaatactttactagtacagttttatacatttcccagtaaatacctagtaatggtggtggtgatacttctaggaatcatcttttgtctaccctctttaagtaaaaaatgaaaagtgtgcgaatcactgccaagattgcatatagcaagtctttttactagcttttaaaaaatattttacttactcatttggcgtatttgaatatattaacatctcacatctggaattattttatttaacaacatttcactaaaatgaagactctgaaagccagaatctaatttaacactttataaatgaacattttctaaaatgtatttcactgtgaggattgggtctaacccagataggaagggggacagtggagtggtgatagtcaacaattctctaatcctaaattctcccttattcttcttcagctttggagttgttccatttttctacatttggacttggatcttagcagtgacctgatttgtttttttccttcgccccttctctttattttctcttttccttttcttttcttcactcctatacttactcccttttgaggaaatataaaaccttttccaaaatgtaaggcatttaaggaaaatagaaataaatgcaaatttcatgctttaattgaaggatcatctaatgctgacaaagttatattaaacctgaactatcttcaatttgttgtagagttgtaagtttgtgtccctgccctttaatatcatatctttatgttctcattttcttatatatgtttttatttaatgcagtattgaaacctaaacagcaaaattctaataaagaagtgttcagcatataaagggatgaaaattgcagactattattatatttctgaaaatgtttaatgcaaaagacagttaaccagtaatcacatagaaatcaaatatattctcattgatttttgaaccatacattattagcatagataatcagacttggcttattggatgatgcgtatgatgaattcattgaataattttattagcttttgtgggaagtcggcttattgatgagagcttactctggcaaaatgcttttgttgagagtagataattatgtgagaggtagagaaacatctggattcaagaaagctgtgcaaattgttcagtagatggcactcttagctctgaatcttagtggaattgataacattttatttcttgaaatagttactgaacctgagtgggcttggaaaagcaagaaaaaccatttgaatttggttgtagacgttcatgtatacattatatcagagggacttgtagttgatttatatatatatatatatatatatatataatgagtactgtagttttatcagtttaataggaactataagaaacatttcccagtataacatctctgaagttggtatgtgtgttaaattggacatcttacaactttagcagcattttcttttttaatggcacataaaataatgtcttaaaattgatggcctcttggagtcgataaaacgtgattatttttagctgttaagcttagcacaaccaaccattgaaaaatgatataaaccatcttcataaggtgattttagaagtttgaggggaaaatatgattttaaaattggt

SEQ ID NO: 109643 - DNA, 1016 bp, Homo sapiens
ggtgccaaaacctaggaattaatgttctgtatattttctgtaatttttctgttgactgcatttctgcacatcagttttttttttaacttccatgactttgtatttcctggatattatccccttttgctgatgagatggtcacacctttgactatattacatgacatagcacatcttagcagactgcagtgagggattcttctgctggttttgaagaagtgagcggccttctgcacatcagtttattttttaatctgtattaactagtagatactatactagtatattaatagtataataattgattattccttagtacgtttcagattgattttaactttcatggatctttctttgaagcagccaaacagtattgcttatttaaacaataatttgtaggacataattttgaacattttaaaaggctttttatagaaatctaagtggtttatgttcttttcttttccaaggtacaaattctgagctgtctaacccctctgaaacggaatctgagcgtaaagacgagctgagtgattggtcattggcaggagaagatgatcgagacagccgacatcagcgtgacagcaggagacgcccaggaggaagaggcagaagtgtttcagggggtcgaggtcgtggtggaccacgtggtggcaaatcctccatcagttctggtagtcttttctatactctgtcagcatccattatttgtaaacagtttaattttacaaaagttaattcatctcccagggccacccatttttggaagtttctcttgctactcattgtcttagagaaagtagtggaccatatagcagtatcaggaaaagccctcgtagagtgtttctcagtgaaggtttacttagaatatactggtcagaactttagttggcagcttttctttatatgatgagggtcagatgtttctctcttcaggttttggaggcttatttaattagaattttttttgttttccctagaattttggggttatgtttttttgtttgccagacagac

SEQ ID NO: 109644 - DNA, 3626 bp, Homo sapiens
acgggctagggagttaattgccagggatagatacatagactatattaaggatataactttaacatatcattatggtataccacgttaagaaacccgcaccttccttaatgttatacccatgaaaacttatgtagtattttaatattatagaaagtgtgtgtagatacattaaatatagatgccaactgtgcttacaaattacaaaaactggaacaaatcagggcaaaaattaggaacttgttctttgtttgtttagattttctccctttccacagtaatactctttgagccttaagtttagtttacaggctttcagggtaatagtttttatattttagtacactttgtacagttaccaaggtgtttaaaattacagtatactgaattgcaaaataaatgtacttgacctagtgttttatgattaatggatacgcttagtgtcttttgcaaagatgcttagcttgctagctgttaccaaaggaatcttaggaaaaatcggaattaggtgaatttcttctataaatttgattgttggaggtaataaatgcacataggtaagatgggtatttttcttatgaattgtaccttacagtttttccttttccaccttcacatcaccttccataatgtttctaaagatggagtactagtcagcattcgtttcaacattttcctttcataaccagttagaagttcaaccttatttaattggctgctttgtttcaacttgtcttgattgcttcagttcagttacggatttctattatgtcatggaatgcaggtattgaatattatttgggaaacagtccatcaacatcaacacaacaaagctgcagtcattttgaactcagttaaggggatgaaagctcgctcttataattatttcttaacagctgaatatttgtttcttttcatttttgtttttctagtctctgggcaggattaccttgaaatgtgaatgcaagaattagcatttaatacactattttctaatgtatattttaaaaacaaggcacaggaaatgttaggaagccaagatgtctgcttactttctgctttaatttttcatcaccacttaaagttttatcatatttaattatctttgttattttccaggtaaataatattgaaaacattttatttgaagacagtgcatttttattgggggagactgaagtttatttgtcattgatatagttcaatatagatcaaacattcataattgcagtactcttaaacgaatatttcttgcctctgacatgaatatagtgctcaaagatccagacagcaatccatacagcttacttgataatacagaatcagatcagactgcagacactgatgccagcgaatctcatcacagtactaaccgtcgtaggcggtctcgtagacgaaggactgatgaagatgctgttctgatggatggaatgactgaatctgatacagcttcagttaatgaaaatgggctaggtatgtaagcacttagggaagagaaatatatatatatatatatatatatatatatatatatataattgtaaactattgttagtatatgaagcttttttcaaagaaatatgcaattcacaaattgactttttcttagtgtttactttgaacaaggtagatagctttttgtctatcttaaatgtttagttctcagatttgttatagccaaattatttgaaacttggagggttaaagtgccctttgatgccattaaatcagtacaaatattcagctggcaaggtacttagtgcttttattgtccccaagctaaaatcaggctttcatcttgcctcttttaaaataattataaatgacactggtaaaggtacatatatcaagagtaggcattaattttcaagggctaaaatgtcattaacttcggtataaaccaaactgtactagagaggaagactgtgtccctgaatgatggcagtttaagtctgagttttactgtgagttaaaaccctctgaatttccagatgataattccatttttaatccatttggaatgctgaaagctacaaaaatgtatttcctgtcagtaaacatttgttgttttatttttgtgtttaattaaaagtttatttttcccctttaaatctttgaaggaaagaaggtttttttgtttttttgtttgtttttgtcagaatagttcatggtaaactttgcaattacagatgatagtgaaaaaaaaccccagcgacgcaatcgtagccgcaggcgtcgcttcaggggtcaggcagaagatagacagccaggtaacttgagtggacctgtggacaccatcaggtcacaagcatgaaaaaaatgtctatgtctgctttctaaatatattatacttacatgtacacatgtgtgcatatacattcaaaatttgcattgcataaattgtttattcaactaataagactactactattaagaaaatgcattcttccttcacagtgtgttagtaacttgtctaattgaactaatgttgtgtcctaattgtttacatggaaatactgttgagaagaccattttgttcacttggcagtttcttcacacttgagatggggcctgccatccgagggactgtgttgtagattgtgatcaaggttgattggcaaaactgggcagcttttgcatggtgcctgcttactatatctgaattcagcacctcatttttgtgggagttgtaatacccacaattaaaaaaaaagtataaaagagaaaaatatttgaaggtgtctttaacctaatgcgaggaatgcatgttgtttttgtttgtttattgtagtgtgatgccttttcccttacacctactaactattcaaattaataatacttacttagttttagaatgtttattttatgtagtcattaatttttagtaacttcaaagaaacttgtttgctgtgtctattattttgaacataattccatttcctgtgtacagagaatcacatgtatattcacaatgaagcaattgtgtgcaccagaaataaacccctttcaaactaatcaatttttgcattctttccaaaaccagttctttcatgtgttttccccaaataaagaatgtaaattctggcatctttactattttaaatttagtggttgtagagacatttgggaaaactggttaagagaattagttcccatccctaaaagttcatgttttaaagatagttggaaatttttagagcaattaaatattgtcaaaaaatagaaagtgtccagaaaatatttgttttccttccccttctttcctcccctcctttaatgttggaaatatattttagggctgggtgcagtggctcatacctgtaatcccagcactttgggaggccaggtagcaggattgcttgagcccaggagtttgagaccagcttgggcagtgggatcctgtctagagaaaatacagaaattagctgggtgtggtagtgcgcacctgtagtcccagctactcttgagactgaggcaggagaatcactttagcctgggaggtcgaggccgcagtgaagggtgatcgtgccactgcacgctagcctgggtgacagtgagaccctgtctcaaaaaaaaatgttttagatgaagagattatttcattttttgaaggtggtacagcagtgaat

SEQ ID NO: 109645 - DNA, 1004 bp, Homo sapiens
tctattcctgttttacttctttgggattactacttccctcttttaaaactcctcacattccctagcttgccccttctcccaaaagatagggtgggtaaaacaagcacaaaactgttaacccttgatcctagtagcagttctaggaggcagcctccctctaaagctaatatcaatattctgtttaaaacactcatttaatttgatctcatctgctcaaaatttcttgttgctcttagtgtaaattaagcagtgaatattctttaccacacttagaatgtgacaatacacactggtgtccagttgattaacttggatccattcgaggaaattctagagtccatgtcattacagaaattgcctgtatttttttctagatattgttaattattaatctgtattggacttttaaggggcttgtattataaggactggctataaacaggtttttatttgaattaacagaggtttcttttggcttccttttatttaggtagcggataccccagctaagtgcttgttaatttagttgataactatatcaaaatattattctgtctctgtacacagtggatgaaaggttctagaattgtttcaacaatgtgttaggttggtgcagtttttgcacccacctcaaaatggcaaaaaccacaattacttttgcaccaacttaatttagcagcaggctttccaattagatgttttcctaggtgtcactgagggccgaacttggaaacagtgcattcactatgctgttccccacactggctagaattgttcttgtaataggtttgctaccatgtatgtagacataataaagtggattatgacaatagccctttttccaatattgtaaactctttttaatgtagttataaatatattagcaatgaatttaaataatttaaaaagcttcaagatgagcgtactgtttcttacagtttggaaggaaggaggcagtttcagatttgaaacatctttagtggttttctagtaaatgatgtatg

SEQ ID NO: 109646 - DNA, 1025 bp, Homo sapiens
gagtgcagtggcacagtcttggctcattgcaccctccacctcccgggttcaagcaatgctcttgcctcagcctcccaggtagctggaattacaggctgtgtcaccacgcctggctaattctgacggggtttcaccatgttggtcaggctggtctcgaactcctgacctcaggtgatctgcccaccttggcctcccaaagtgctgggtttacaggtgtgagccaccatgcccggccctaagtttcagttcttgaagagagagtgttgatgtataaagtgagtcagtccacatactgtagaacataggtcatttgttgaagttgggttgacgtgacagtagggtgttaggttgggtttagtctttttcctaatccactactgccacttctttgcaaatacacatttcagatcgtccctaccaagattggcaaagggggtgtgggaggggtgtcattgaatacactctggaccttttcccactctgatcaatgtccacatttttagggtggtggtctgtcatctttagtttgcttgtagtttcttattttaatcactcagaatcgtttctagtgtgaaacgttaaaacaaaaccatagaataaaccacacttggatatcttaattgtgctttaaaaaaaaacacacacacacatttgagtaaatatttttgtatctgaaattttcaaatttaagtatatcatactgtgatttggaccaaatttgccccattcccccctccccccgactccccgataattgcaaacactgggcttagaacactgcgtttgtatttccttttactggttgtgggtttctctaacaactttgttccacaacattagggtcaaccagaagcaaatagctggattcttgggaaagaggaatttaatctagatttcctcaatctcaagcttgaaattttcttcagcaccaaaagcccaggtagatttttaaagctttgtttttggttggaggtgatacccagcttaagaaaattttgacactgggtgacccaccactagtttaa

SEQ ID NO: 109647 - DNA, 2830 bp, Homo sapiens
taattcaggagcaataggctatatacctcttctcattgatggatatagaccttttaaattttagttcttttaaatgctttacagtatttgatatgtaaatgtgatttctcaaaataaggtgagtaaagtaggtgattatttgtttaatattaactgtttatgtcattttcatggtgagctttccagtgttttaaaattaggtacagttttcattagtttagatgttttctgtggtttgggcactgctaggtactagagatacaaagttgaaagacccatagagtggaatactttgttatttgttttgaattttaaagatgttttaatactttgatccattgtggtatataaaactgaaatttttaattagctaattagtgtttatgtagctgttttcctcctcagctatagatttcatttataaagaagttgaaaaagttgtctccctttggcaggcaaaagatgtgattgaagagcatggtccttcagaaaaggcaataaacggcccaactagtgcttctggcgatgacatttctaagctacagcgtactccaggagaagaaaagattaataccttaaaagaagaaaacactcaagaagcagcagtcctgaatggtgtttcataaactgaagaagttcctagtttacagttcttttacattacatttacaatagtgcttgtacaagcttgccaaagatagaatatggatcgccagtctttacatcgcactttcagttcctccatttggaattcaaaaaggggagggatcctgaagaaatcatatgttaaacatactttgacacctactgtgttataaaatatatcatcagatgtgccttgagaatagtatatgtaacattaaaaaaaagttgctggctataggaaatgttattttgttttcaaaatatggcagagatggggggtggtgggtggggtgggatccctaacgtaatattctttatgaaagcattagctgcttttgttacatttttaatatgcaaccacttcttcacctgaggaaaactagaatgaaatgcagtctaaaatattttgcactgaattgtaatttcttcattagtttagtctggaaactggtctgttttaatgtgttttttaaatgctgtatgtagaggaaaatctgcagaccactggaatacatttgttaaactctcatctgcagggacactgggcgatacttggcagtgactgttctaccttgaggctttgtttggtttatttattaaagtgtacagtatttaaaaatcaaacatagctttagttaaaacactaagctgaattagtcatgtccattcagacataacctgaactactgaaaagatcaatttccagaaggtttattctgtataaactacatgttagtcttcagtagagtatcttttttttttccttttttttttttttatttcggttgtttgatgtgcaatatgtttttgtatgcaggtagtaaataaactttgatcttccatttgctgaatttttttaactttctactttttacaccaattgttgcaaaatagttggagctattaataggcttaggatagtatactttgctttttaaaaagcatttatacttgctcataaatagcattaaaatgtcagttggccatttaatcattttgtaatgaatcatctgaaatctttacacaagtttaggctgttagatgcataggtaattaataatacatgtgataattagcaaaaaaacctaacaaaattctaatcaaaggcaactttggaagacaatgggggatagaagggatgacaagcaatttttaaataataggccaatgatttgctttattcattctcaacttattttgaaggctctcatatcagtgaccaaaaatcagttattaaactttatgtatatattttagccagagcttaatttttatgaagataaagacatgaagtttaacaatggacaacagttagtacagctaattgtgaggtcaagtaattgttagacataggggaaggctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagttaaaaatgtacaatgtgccagttcagtatatataaccctagccctcaaattattctgattaaggttaaaatgtgctggtattacgtgctttttcctgaggccttctgattggttcttggtaacagaattttaaagtaaggtgtgagtagtgcaactcctgtcctttatatataaagatatcaagtaatttcatgtcctgatatttaaaaaaattacccacaaatgtgtttttttaaatcgatcaaagctagcaacaggttaaattgtctcagttctcttacataattgggttaaaaattataaggtattagaagaattttaattaatgccaaattggtaaatatggtgtaaaaaaaaaaaaaaagacttttcattttctcccacatagaatagtcagatatattaaacatcccttttccataaagatggtttcaatgggaatggaagaaacaaaatcttaaaagagtgagtatagctgaaccaattcttcattctagcaataaccacactaagttcattactttacaaatgactaaacccaatgtcttgtcctttaaaaaatataggtagtgcagaattgtgataaatacgcatttgtttttttagagagccccactccccaaagggtagccattaattcaggtagccttttaaatgtatttga

SEQ ID NO: 109648 - DNA, 1134 bp, Homo sapiens
tttcaactatgctgaatgcaatctataagatattccaaacaaggacaaagtaatttttcacaagtcttacagccccactattaagtatgctactaattagcttcttgaatttctttgtatttcagtgattgggatgttctttttttttgggaaagtttttttacccctttgtaccctcttaattggattaactgtaaaatgtacatattaattttctagttttagagaccattttcattaaaaatattttccaatagtttttctagataaacaatttatacttaattgttgcttggttgcttacatttcaacctctaggcttcctttttcagctaacttggctgtcttcaggttgtaaagaaaaatgtaaacatatatttgaaatttcattaactgaaactgctgtaaggtgttagcaaatgttaaccataacagattatcccatatcattggactgttctattattgggtcaggaataataggtgacacaggatagaagctcttcctatatatatcttgttgctaaggcagtagttggctctaagctgataaacagcacactgtacagcagtccaaaaactaaaaccagagcttaggtcattcaagttaactggtactcaaggttactcattccaggatactttacataaccaaaaacctaggagagcattctacattgtaattttttttttactttgtttacataaaatttacagggttttgtttttttaagcttagtctgttctttgacattgttgattcatgttctaaattttcatcagatttaacatgtttggaggttcttgtgcactcaatgtgaacctactacaagcttctgaactgcaaaaccttttttttaggtcactgtcaacagaaagatgccttatagaatttctcatgattgaaacagaactctgcattctaacctaaaacccctctaaccctttaaatgaagcattatgcctgcgtgaaattttatttttagacatttctgatactaggttttctttacgggggggcatacatattcagtatactgaatttatacagctttcagtgtggcaatatattaagaagctagttccctaatttttctcagttctcattggttttccatttaaatgtttccgtaa

SEQ ID NO: 109649 - DNA, 3514 bp, Homo sapiens
tctttaaaatatatctggaagcaccaatgagtaaagacaaaggccccaagctagatctgtagagataagtactagactcacatctcagtactatcaaggaaaacatgcttaggttatcagaattgtgaaggccatagtacaaaaagttaagagaacggaactcaggatctgagaaagatcagccattctcagcatgttgccttggctgcttaaccttactaaacttccatttcctcacatgtaaaatgtacatcataataactagtctactgagataagggaagaatacttagcacagtgctagtacactgtaagtactcaaatgttacagatccaagtattttgtaagaaaataccagcaaaagataaaagtttttttatggatcgtatttgtatcaatcacctacatgatctagagccctcacatggataacatttaaatgttcagtttgcctaatagccttcaatgaaacacggattcttctacttaaaaaaggtaagcctggagaaaataaaactgattactatgcaagaaaaaaatgtgctctgctgtgctccttggtatttttaagtggtttccattgtcttaacacctgtcttaaaacgggtatgttgtttgcactgaaccctcaaaagtatttatacctattaagttaaatttccctttttagagttaatgcttcattgcctgtcggcatattatcactatctgtctttgaaaaattttcttttaagtctcaactatttcttcataaagctcttgttcagagaaacattttttgatttgtccaatggactgaaataaaaggttagtaaaccaaaatacagttgatcctcattattagtagaattccttatctgtgaatttgcctactcactaaaatttgtaactccaaaatcaacatccttttctggtcatttgtgagtatttgcagagtgacaaaaaatttaaaccactttatgtgcacaaggcaatgctctaccttgtttaagctctcacaccataaacagatatcctttttgtggtctatttagtgccaagtttcatgtttgtgctttttgttggtgattttgctgttttaagatggttcctaagagtagtagtgaagcatgctacctagtgttcccaaatgcaaagaaggccgtgatgtcccaagcatgagttagttatagtgctgttggctgttaattgaaagttaatgaaatactaaagaatgttttcaagcagaaacaggtcgatcaaggttatatactgactggcagacaatattgtgaccaaagggtcacagaatctgtatttctcttaggaacttgttccttatttgctaattcagtgttcatagccaccttaaagaacagaattaccacaaacaagaaccagctgtactttcatgtctccttgtccctggaaataatttatcctgcataaaagccttagaagctagtgtttcatcatacactaaatcataacagactccatcagattttaaacgagggtattggatagaaaacacaaagagcagatatacctttactttataaggcagataaatattacctccactatttttttaacctcaaaagtccttgtatcctccaataattaagaaacttatgatgacttaaggaagtttagacggtaggtagtataatttatcatcttagagctacacataagaaatactcctgttgagaaatacatactagtttataccagatgttttatacaggtcctcttaagatccttatatattttatgttagacaaacagtaagtaatttgcctttaaacatcatttaaatttattagtgtataaattctaaagagtccaaattaaatatgttgatattgagaacatttcagttttcagttttgctaacagggtttaagcttaatcataacaattgcagaagtttgattatgtcaagaaatagccaactgaaggaataatttataaatggtcattacctttaaggggctagctgaatacaatgtaaatactcatgcctgtaatcccagtactttgggaggctgaggcgggaggactgcttaaacccaggaggttgaggctgcaatgaactgtgattgtaccagacctgtactctgaaatctttatcatactatttttaatgcatgaaataaaaatggtttatatgtacatagaatacacacacacacacacccctaggtcaatttcttaggtctcagttgtggttaaattcacttttaaatacaaggttccaagtatccaagttgccaggccagttgcctgtacctggaacagcctttccaccgaataagaagagtccctacttaaacagcttaagctaatttccatcatactatttatcacagtctaattaccagtttatcagtctcccattaaagtgggggctccctgagagcaaggactgtcatcttcactttgccttgaaaagtagacataggtcccaaattatctgctaaatgagtaatgaacaatatttctattcagaaggtgtgtgcttgcccataattaatacgcaaatattctaaactataatctgatttaaaatccccaaatttaaacaagaaaattataccaaggctttgagatttagcttgtgctaaatcattttttaaaattgtagctctgaggcattttattataaaaacttagtactcatatacataaactaatacgaacttaaaattcatcatacatttacttcattttttagcttgaccttctagtaaatctttagcttcattgattttggctgctatataaggagatcctcctataggaagaaagaaaaaagaacagttacaatatggattctcaatttctgcttggtaaaaagctactcttgtttcaaggactccaatgcttatctgagggagatttagcagaaacagtgttttaatttttaaaaaataaccctgacactgcaactggatgaccaaatatatggtaatatatgtgaccaatgagaaatgaagtaatttacgtgggagatatttctacaaaaataacacctttttagaaagcttaaactgatagaaataggatttctatcatatatattagatatatatgtatatgcctttgaactggtgttagcctattcatgattacaggtcataaatgaacatcaattataccatgttattttaataccatgatattctcagaggcttctgagctgtttactggaaagatcccagtttgctttacatcctttttctgtccagtttttcttttcctgttatctactgtcccttcacaatgtcatctacagctgctttcctacgaatctgctggaggagtgattctcaaagtatggtcctaagaccagcaagaaataacaggaaatttagtataaatgcatatttatggggctccactgccgacctactgagtcagaagccctccatataaaacaagctaaatttcataaaagatactgtgaagtagatatcaaacaattataaccctgtttaaaatgtcaaaaccctttttattaatgaaagc

SEQ ID NO: 109650 - DNA, 1082 bp, Homo sapiens
catattggtaaagcctacaatcactctattctgttacacttaatcacaacatattcaacaggtgatcacagccaaatctattcttaactgtgaccacagagagtatgaccataacatcaagccaaaccctatagcctaattaactagagtgctacctatgtatgatgtttgggagtgccagggccacatggtcagatcggatcactttagaatcatatacctctgtgtgtgcgatgcagagcagatgaaggaaaacaagaatatgtacagatgatgctgaaggtgatggtatgtgaaaaagtgaaacttgggtctagtggggtactagaattgtcaaaaccccatccaactctgtcacatataacatctgatgtttcagggtagcaccatcacaaagttcagaacttctatactctccttgcaggaagcaggagaatgggtccaaagcaatcacttagaacttcatggatatttggaaatttacccttccctaagtgtggctctaggtttcaaatagaagcagcaaagaattaacaaagtcttacagattttggtaggctttgaaaaacttgttttacttgaggctccatatgcttcatggcttgcaaaacgtaacggcctaaaaccaaaagcaacagaataagtaaactaaatctccaatctccccgacttcacttccatccccaaaccataaacaaacctgcaaatcctgcagcagcaatggtcagtccaactgctaccactgtactggcctggtaagggggagaagagtaaatatttacttctctaattcccaccctttctcattttgcccattcttccatccccaactcattacaaactgcattttaataggagaaacaacttttttttttctttttttttttttttttttaagagacggagtcttgctatgttgcttaggctggtcttgaactcctggcctcaagcaatcctcccaccttggcctcccaaagtgctaagattataggcataagccaccatgcctggcagagaaacaacttttaaggcggaaatattctgtccagtaatctttaaaactactgcatctgttatgctga

SEQ ID NO: 109651 - DNA, 1030 bp, Homo sapiens
tgaacttgggcctcggttttttgccttttaagaaaaacttattattatggtaaaatacatataaaagttaccatcttaactattttaagtgttcgttggtattaaatacattcataatgttgtgcaaccatcaccatcttccatctccagaactcttttcatcttaacaaactgaaactctctatccattagataataactcccttccctccagccccttgcaagcaccattctactactaatgctgctatgaacatgggtatacaaatatctatttgagaacctgctttcaatattttgaacatatacccagaactgaaattgctgcatcatatggtaattctatttttaattattttaaggaatcaccatactatttcccacagctgcaataccatttttggtttttaacaacattgcataagggttccagtttttctacatccttgccaacacctattattttcttttttttttttataatagccatcttaatgagtataaggtgatatctcattgtagcttttatttgcatttctctaatcattaatgaggttgaatcttcttatgtgcttattgcctctttgtatatctctgtggaaaaatgtctgtcaaatcgtttgcccatttttgagttgggttgtttgtttgtttttgttaagttttagttttctatatattctggatatcaacctcttatcagacatatcatttgcaaatattttctctcattctctaggatgcctttttactctgttcataatgccttttcatacacaaaatttaaaaatttttcatgaatctactttagttttttgtttgcctgagcctttgctttcatattcaaaaaatcactgccgaatccagtgtcatgaaggttttgacctatgttttcttccaagagttttatagtttgaagtctttaatccaacttgagttaacttttgtatatgatgttaggtaagggttcaactttattgcatgtggacctaacagtttttcaagcaccatttgttgaagcagttttttg

SEQ ID NO: 109652 - DNA, 1032 bp, Homo sapiens
tctattagtttgctctgaaaggcagccatcagaattctttttcaatatgcattttaaaattaaataatatgtactagcatttcctctctccttcacaaggagagagaaaaataagccaagattagcaacaggtcattgtgttgctgctctgagcaaaaccatcacttgcttttgtggaaagtaaaagcttccaataatttcccatgtatctattttcttacattaagcttcaaaaatagtgggtcctctttctcaactctgtctttgtggtagcaacagtggggagcatggttcatgcagctctttgtccgcgcccaggagctacacacccttgaggtgactggccaggaggcagctgcccaaatcaaggcacatgtagcctcactgaagggcactgcctgggaagatcaacctgtgctcctggcaagcacacccctagaggatgagactaccctgggcaagtacagtgtggaggccctgattaccctggaagtagccatccacatgcttagagggaaagtccatgtttctctggcccattctgggaaagtgagaggtcagactctcacggtggccaaatggaggaagaggaggagggggagaaggaagaagaagaggaagaggaagaagaggaagaaaaagaagaagaggaagaaaaagaagaagaggaggaggaggaggaagaggaagaagaagaagaggaagaaggtggaggaggagaaggaggaggaaaagaaaaagaagaagaagatgatgacaggcagggttaagtggtggattcagtacaaccagcgcattgtcaatgttgtgcccacctttggcaagaagaaggtccccaatccaactcttaagtcctttgcaattctggatttctctaataaaaaagccacttagctcaaaaaaataaaataaattaaaaaataaaaatagagggtcactagtcaccataaacaatgcttataatcctgaattgaaataatatgtctaagaggaaaggaaagaaaggagagtttagtagattattcaactacc

SEQ ID NO: 109653 - DNA, 3438 bp, Homo sapiens
accaactcctgcactggctgtttccagaaatacgagttggacagccgccctgagccacccactgtgccctgccccacccccgcaccttagctgcttcccgcgtcccatcctcatttaagtaccctgcaccaaaaagtaaatcaatattaagtttaaagaaaaaaaaacccacgtagtcttagtgctgtttacccacttccttcgaaaaggcgtgtggtgtgacctgttgctgcgagaggggatacaaaggtttctcagtggctggcaggctggctctgggagcctcctccccctcctcgcctgccccctcctcccccggcctcccccgcgcggccggcggcgcgggaggccccgccccctttcatgcaaaacccggcagcgaggctgggctcgagtggaggagccgccgcgcgctgattggtcgctagaaacccatttattccctgacagcccccgtcacatggatggttgtctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaattattcttgagtctttcatttatttggataacactgtgattatacataacttttcggggaattataatactgtgctcagccaagaaagcaaaataccaaaaaccttggtattactagtccagcatcatgtgctaatgttaactgcaaaaaagaaacggctggatgattaataagtactggaaaaattgaaatttctgtcatttctaaaatagaaactagagacatatattgtaaatccgccccctccttttctaagcagcatgaataagcatgatggggacctatacttaaaactgatttatgccacttgttgccagaaaggattcaattctgaaatttttcatgtagtttagcagatgggatattgagccaaatcagaaccaggttggctggttttgttttcattttcttcacagcacaatggccctttgaaacctggctatagagaaaaatgatgcttctt

SEQ ID NO: 109654 - DNA, 1185 bp, Homo sapiens
tgagacatcgccatggtctttgaattagcgatgcttctgcatcaccacccacccttgctttggggcagccggataatctgttacctagtcagggacttttctactttatttactacttgattcgctcgtcttcccccacccacggggaccaggaaccaacaatcgggcacttttaagagcacgggtttgcttcccacaatttcaagagcttgtgtcaacttgctacaactttggagaagttggaatccggcagcgtcttccacccttgagtaaagtacccgctgcagccactaagttagctcatcccgttggtttgcatcttctcatttccaagaaagtatttctttctcatggtgttgctaatgttagttctgggctgaactgaggatatctcatattttctgtactttctatttttttctagattgctttgttttagatatgtactggtttttatttattacttttttaatcctcatttttaggataacattgtactgggaagggacaattattattccagttcccaattctaagcaaggcattttcccccctaattaatgcagagactctaaaagaatttcccctagcctggccagccattgtaatgcatatacggattattcacgtggtaatgagcacattcgccagttcttgctcacacatacgaataaaagaaactttgaataaagatccaaatgatcatcctgggggagtggggaggatattcccggaatttgaggcagtcaaatatatagattatatatattttgaaaatagaaatatattagaaatatgtatagaggtttacagtaattgcactgcactcacctctcattttttaaaaaaaagcccacagggtcagcaactttctggcaaaatggtcaggttcaaatatttagcaaaaggaaagggagcacaatattttgggaagtagaactagctttgaataattgtcactatctgcataaaacaagagaactcccgttcccccttctaccccttcatatcgccgagccaaatagttgaaaaatgaaagtcaaaatattttgtttgcaaatataaatgcttttgataactacatctgagggaaatgatatatatcttgtacgatcattcatttgattaaattaaatggttacctgagatatgtaatttcatggctagattaatatcgaacatata

SEQ ID NO: 109655 - DNA, 1021 bp, Homo sapiens
tccttctctccccacctattggtctgaacactgcaaggtgcagtaggggggccagtgttccatttctgccatgtcataggttcctctgtggccctaggtaaaatggtaagggaatgattttgagggtaagattcctcgacaataatataaattgaatgaataagagataagctgcaatggtggggggggtggcggtgggaacagtaattacaaacccaattcattcagcttttcagaacttttgttgtgggagctccattgacgggttttgagctgccagttttctcacattaaaaagaactgatcagcgcctcagggggacaagaaataccgcttaactgcatagtgatggggtcttcatttagaaccattacaagatgaaaattaaacagtgcctttgtgtgcatgaggtttacttttcaactgctaacagtttatagctaactgctctgagattgaagtttgactatggtttgatcgcctgctgattgacgctgctcatttatttatttatttatttatctgttataattaagagaacttttcatcacctcaccccagtttcatttattgatcttggagaattttgaaaaacagatcctcatatttttctttgtggaaggagtttcctttgccatgagctttagcagagacttcagttcacattccccaacggacaacccccaccccacacacccacattattcccttaaaataatttgcatctcattctctgttttttttttctgctgcattttcttgctctccaagctagagttgcttttcgggcagcaagtagggttggagataggggttaatttatttttttgctttgctttctttttgtgacctaaattggaagagggctggatggatttcctaaggacttcacctatgaggtgaatccctcaaagaaggaagaagggggagaaactctgacctttactgtgaaaatatggatacagtccaaaaggacatagtttccggagttctagagtaagaaaagctgtggaaggagctt

SEQ ID NO: 109656 - DNA, 3846 bp, Homo sapiens
ttctctttggaagggtggagtattaagataagtctaagattcttgtctgtggcagaaagctctctttctctattcggagttcagatggattttattttatactttggtataatggtgatatttctgattccttgagcactttgctcagtttctctcctaaagcaaatagaatgtcttctcatttcgggatgcaaagatatttgcttcacctaggcgtttgaacttgagatgcttgttctactctgcaaagaagtgtcaggtgatttgaaagctggaggtgtccttcgttttattaccctagtctgcctgcgtgtacagaatgaagggtgcactgttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgacgagctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagccctctccatgttgacctcgtgacacgggagacggtgtctaggccccagattcccacccacatcagagattgtctacccaaggggatgtttgtccctgtttgtggccaaatctcagtattagtgatctcgctcggttcttcccgattagaggccgaggattggcagggctgggggaagcccccggagcaatctgggatccctggaatattgggcccctctggattagagcaggtagggatgggaagatacagacccttcactttcccacttgtgagatagggataatatatagttacctcgaagaagatgaatacagagtgcctgacaaaacaggcttaattgataagcatgactttacttactgcccagcagaattagggaagggaagcagttctcacgttagactacagagaacaatacagaaaccccggtcctttctggccttcctggctctggacagtgaaattagtcttgttcataccacccttcttacttttccagtgctctctctgacttaagatttgcctaggaagttatcttgcaaacttgccatccctgggcatcgtcctgaagggagggatcccggcattccgggcaggacccgcccccacccgcagaaggcagaaaaataattactgtattaaataaggagcggtgaattcttcccaagggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagaccccgtctccagaacataaccacatatacaagtaaccataatcctaagtacgtatatagtcacgcgcacaactctcgtcacaggaccgcccttcttccaaatatatatatgttatttagtttgttagccacaatttgttgtgggatctgaatgagttgtttctgttgtgtttgtatgtttttgtttttagacggtcgacaaattacgacaaatgcctttacaaagcacaccatagctttatttaacccggtgcaagtttcagcggcgatttaagaaatggacttagaagagttttctggctctcatatccagccatggttaggacaattgctccaggcttaccattgctgcactagttctattttctctttcccctctattcctaagaatttgtatagcttttaaaaatctttttagagtcatgtattgctgagagaatttcttagaactgtgatttaaattgtagataagaggaaagattatctggtcagtggaatgtgtgtaagtggcatagaagtatttgttagggaaaagcacctgggcatttctggatttctgggagatgcacttctcaagttttctttccaactctcaaatcaatttgatttattgaatgcccttccaatggaaaggatcctggaaagcaggccttatgttctgatattggtccaggatctcacagagtaacgattagccaatattttgcatgcagtcagtttagtatcagctcacatccaggtcgattttatcacacttaacagctcaaatcggggttattgcataatattagagtttaatcagtctggaatactaaatggcaaacctgtcttctccttctcaaggccctcctccctttctctatttctccttcctcccacctccaaggaaactatcttaaaatcaagtttccctttgagagtttgtttaccccaacttctgttaaactagactaacacgctctcatcagctttctaaacactgtctcatcagctttgtgaaatggtgcaaaaacatcttggaatccaagatggcaaaataaacttgagcatatggggggaagactgccttgttaagaaattgatttaaatgtttagcttacacttcagcatcaatgcttcccttactacccactcttacttccctcactgcccactcctggttcttgggtaccccacctctattagcaagctggttcccccagcataaattatgaatgcatatcaacaggctcatctgctgtgataaatcagaggcttttctcttttgcacatttctgcttttattctcatcgaaatgtctttctgccccatgctagcagtgtctttctacaaacttactatccccgtataaactatggagatatattctcaattggaaaaatcaggtaatttcaaccgttccccccacccccaggaagccttacaagttaaggatacaaaatatttcatggttagttgtatgagcttccaaattagctgcatataaagtatttaagatttttttttttttttttggctgtcactggctggcaatactcattttgtgtgtgtgtgtgtgttggtttgaaaagcaggaagaaatgtaatgaattgagtgctgtcagagatgtcttctgtttgaacaatctgcgatgggctgaatggcagggactccctcatccagtgcaggtgcagtagagctggggaaggggggaggggggctccctctgttcagtcaaaaagcaccattctccacaatagaccacacactgacagccagcgtgacatcaactcacactttcatacttttccccccatccatagttctgagttcacaaagtggccatacagtagccttggttaggttcctttaatgaacattttgcggctcctatgaccaacattgaaatccgcagagccctgggaggaacaaatagatttttaatcgtgagttccaaaccagaatgtatagctatagatattaaaagtaagctggtctccacatcctctcccaatgccaatgcccacagcaaccccagatgatgtgaaaactctgagttaaaagttcttctaagacttattaggttccaagacactgttttccatgtcctgagagagatcaaacaggaaaggagagaaggcacaaattttatgtatttatttaaaggtaagagcacctctagtattttattatgcttcatgagatggttaatcctacaaattaacaaacattaatcttgtggag

SEQ ID NO: 109657 - DNA, 1133 bp, Homo sapiens
gcaaggactggaccttccaagagttcgttttacatttgttgaagcccaggccttggtgcctcaagttttaaatggaattactcaaggggggcacactactagacaaactattctagccaattccttcatccccgacccagtccctactcctctctgcccccgcccacttcgccacttcttagtcccggatctgaacattttagctgaaagagggaggggtgaggaaagggccaggacagttccctcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaa

SEQ ID NO: 109658 - DNA, 1010 bp, Homo sapiens
ataatatcgcaactcgggacttcaacgctcagaccccctccaggccccagcctccgtattctcggagccctccactactgatacctctcgcggagtgcggcgccccgggaaaagcctcttggccagggactctgggacattactttctagtttgttttgttttttgtttttctcccagagaccaccaccaccctcatcctcttcaggcagcatttaggagaggacctctgagatcagcagaaggcctcagacggtcaccatattggtggaagcgtttgtctgatgttttaaaacgtataccaaacggggcgtcagggccacgtgctgtgccttcgaaacgccgccgcgggccctgcctttcagagctgcggcagccggggctggcgtggagggggcgctgaaacaccggcgggcgtcaggggccagcgctgagctgcagatctggccgcagcgctgagtgaagcgaattatctggagcgtgtttgatctgggactgcgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgcatctagcgccctctttttttttttttttttttttttttttttgcctgacgccactgtgctgttgcgtcttgcgcagcgcagacacctccactctggattgaaacgaaaaagctcgcggtaagagcagaaaattggtctattgatacattcgctccgagtgttgatcttggcatcaccgatagccggttaattcccccaccccgcccccgccagtgggtcgcacgcggattgccgagggcttgcaggcactcaggcagacgcagacagaaacccacatcgaccccccccctttccccgcctccagctgtccgaccctcaagtctctttctttttcttttttacccaactccggattatttt

SEQ ID NO: 109659 - DNA, 1229 bp, Homo sapiens
gcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatccggacttgaatgtagattactctggcgatcgtttgatcggccctttgaaaccctttacaattgcctgtgacgaacggccagtctcagtttttctctgaataatccctgagggtaagtcctccgggcttttaaagagctctagtattttttttttaaagaataaaaagaaaaacgttcgattttagtttagacctcgtcaacttttagtcgctaacaggcatcactcaagccagtcaatacttaatgaccgttagttacccttgctgtcttcctagaaaccatatacatatgtgtgtatatatgtatgtgtgtgtgtatgtacctacatacatactttgtgtttataaaaaggagaacaatgttattaatttcattttctttagtttcatacctccttgcctgtttatagaggtgtgtgggggtgtttattgtaaacatgcattattattattaatgccattgttaatcttgtcttaatgccttctctgttctctctgaattatacctactcagtgggagttaacgtaaaggttaaagctttacaaagtaaaactagagtttaacccccctcagcaccttcacaccaaccgctgtcaccaaaatgaaaatgtagtgctgttcaacctttaatatttacttagagtatttacataagggg

SEQ ID NO: 109660 - DNA, 1015 bp, Homo sapiens
ttctattctcccagctgctcacgtattccttaacgatagtctgtggtagaaacttgattatgctgaatccatacatttcgatggatttcatcagcctaattaatgcctcagtgtggtcctggggtctgaatgaaccctttactatcgtttgaggttaaaggcagtggtggaatgtagaaggatttttttttccttagttactcccggggtacttagggattccattaagcaaggtggatagcagttgttaaacagactatgtggaacaagaaaacccatccaaatggcagaaaagtgaggctaattcttcattcttatttcacaccaacactttcggattccatagacaatctccaaatatttagtaaagtggaaattaccatcttccgttgtatcttaaaacttcactgagaaggaagagttgaaaatagatttacaactgatggctaaattcattttgttttattcatcaaggctgtccctgctccttctcttcctgttcccataactttcagactacttgccccctcaatttcaactttcatctttcacaaggaagcactcatggctgttattcagcagaaactcaagtcacccccaatggggtgactacattttgtcttttcaggtgtaaattaacatctgaatacatctcaatcttactgacccctaccaccaccaccaatcctgcctcagcagagttgcggctaatctgtacctccacaaatggcagggtagatagaagtcaaatttcccaaactccatcccccagcaggaagaccaaaagtgcttgtattgcctatgagataaatcctgatatttgcacatgtctaatgaaacacctgtggaagaatacctttcaagacatgtttccttggtggtcaagaagaaataaaaagaggaagaaaaaaaaagagatgaaggtatcttgattctttaagaaatgttccaactctgactttgagtccctaaggacaaactgttcacccagcagaacttccttcatgcaagagat

SEQ ID NO: 109661 - DNA, 1015 bp, Homo sapiens
tgagtctgtttccttatgtagtctagagtattggtattttatgggcaagtgtagttaaatcaaatgtccaaatccagttatttaaatgggcagtagcgttttgaggagcttaatttgccttaaaaaaaaaaaagatttccctttctcttcctcccaccaaccccatggatagtttttctaacactgaggctttgagaacctagtgccaaagcaaccagttggaaagagaaacatccacgtaatgactggttgttttgtctatgcagtgtgaaacaagaagttggcatgattttatttttcacctagttgacagttttgttttgttagatttctttggactgaaatgatttgttgatttggtattgtgtaaaccaagcccaattccacagtacttttgtgactattaggaaaaaagaaagaaagaaaaaaaaaaagcaggtgaagagtgaaaagaataattaaactgctagccaggagacttggtgattttgttccagctttgtcacccatcagttatgtgacctcgggcaggtcatttcacctcctcggaccttcgtgtccttaaatgtcctaaaatgaggagtctgggcaagacaagtccttaggttcctggcagttcaccttttaataatttttttgacctggaggctgcagaatagagctctagtgtaatcctgagatcagttggtgactaacatttgagtagctcagggagagaatcacaggtttgcagttgtttttttagaaccagatcagtttttggctgaattctgactttatttatttttatttatatttttattttttgaggcagagtctcactctctcacccaggctggagtgctgtggtgcaatctcggtttactgcaacctctgcctcctgggttcaagcaattcttgtgcctcagcctcccgagtggctgggattaaaggtgcttgccaccacacccggctaatttttgtatttttagtagaggcggggtttcaccatattggccaggctggtctcaaactc

SEQ ID NO: 109662 - DNA, 1082 bp, Homo sapiens
atttctccatccacaatgatcctgaccaagagaatttaaatatggcataaattagaagactggttattatttgcagaaaggtagaaaggaggtaagagggaagtgtgtgtaaaatttagggatgagaaggtgagtctataatctgagacagcctaagtctcagacaaaagttaacaggagctatgacaattgtagtctcatttcaacaaattccccaggaaggaagaggatgataatatggatgaagacagaagaaaaaatgtaggaagggagatggcagagttaaaggtctagggctgagaaaagaacaaaattggatccaataactgaatagaatatacaatttaacactggccttgtcaagccaagcagttggctttaaaataataagagatttcttgttttaactgtaacagtttttatcaggttaagcatgtaagcagactagcaatgcacatagatggggcaatttaccatcttggtttagtaaacgagtttatgtgctgtgttgaaacagtgcaacgtccttaatccaatatctgatgaaggagcactggtagaagaattaatttaccacacagtaattaaagaggggtatgcactatatatactgtgaaagtctctgaaatgaatatttgataaacaatttctggtaaattaaaaacctgaaatgttaaattaaatgcaaattaaaaatctggaatgttaaattaattaaatacagaaacctgcatcaaatatcattataggtctcagttaaatcagagatgaaaaaaaaaaaaagccaagtaattcagcatcacatcatgccagcgtgcactcttgactcacctgttgggaataaatgacggtgccaggaacttcagctttactggtgaatttacatatcatatgcacaatcatttctgggcaccttttacttgtgaaactaagtaaggaatgaaatgaactttttgctttatcatggaaaaaaaggctaggagacttattcacatcactggatcctcttctagtttgagctaaggacggccaaattgctacataaagggtaccctcaaggcagagtaattcatactgcgtgc

SEQ ID NO: 109663 - DNA, 1126 bp, Homo sapiens
ttgtgtttttagtagagacggggtttcaccatgttggtcaggctggtctcgaactcctgacctcgtgatccacccgccttggcctcccaaagtgctgggattacaggcatgagccaccgtgcctggcctccccatcttaatcattgtccttgtgtactgtgccctctttatctctctgtccataagtctctctcaatctttttctccctcataaaacattagctattctttcaggcctccctgtttcatatatgtgtgtgtgtgtgtatatatatatatatatatatatatatatataaatatatatatatatacacacatatatatacacaaactatatatacacacaaacagacatacgcacacatttttttttccttccttgaatccttgctgccagcttgtgtgatttgcattgtttggacagaaaaatcaacactgctagaagccagcattctgggaactacttctgctccaaccaagtctgtgacttactttcacagttgcttcctgatttgttgcttttgtttaagagacatttcctcttggacgaaaccaactaaaatataacattaaatgtccaggattgcgtgagagtcaaggcagctctaacgactatgactgatgggagttggtgctgagaaaaccagaagccaaaagagatgtagcatttgccacccaactggaaatgaaaagatgcctgaagtttggtggtttctcttcccctccaccacgttccttttatttttgtggcaaaccttgaaacaaagctggaagaaaagtgctttttatttggtgggtggtggaggttctgactcaggctttacaaacatgacattgcttgaacctcaagatgaacgttcccacaggattccagagaaacaaagctgcctgctgcattgtgtggtaacaacattcaccttgggaattccggcagcaccggggaggtggccacacaggtgcaggttttctgaagcacatgaatggagttgccagagttcaaagaggtttttgaactttagacctaggctttcttggttgcatttggcctatttggatggtagatttaggtctggaactactaaagcagaaatttccaaaactctcatgaattattattattatt

SEQ ID NO: 109664 - DNA, 1033 bp, Homo sapiens
ttatttatcttctcaggccaaaaatctaggagtcatttcagattcctctctttctctcatttcttacatccagttcattggcaagtcctactggtaccacatccaacatatatcctaaatctgaccagtctttgctcccttcgctactatcatgcagcttcaagccactatccagttggcttgaatagttcttgtaatagccttgtcactgttttcatggctgtcactgctatcctctacccagcagcataatcagctttttataacgttagtcagattgcattattccactacccaaaaccctctgagcccccagccatactcggaataaacctaaggtccctaccatggtctacagaaagcttacatgatatagcctgcctgcttcccctaccttctctcctaccgctctgtccttgttcactaagctcctggcatgtttctacctcaatgtctttgcatgtgttgtttcttctgtctggaatcccctttccccgtgtatcaccctgaatttttctatcacttcctttaggtctgtgctccaatcaccttatttgagagggctttctcatttaaactgctatcactctccatttccttactctgcttaacttttctccaaaacatgtacactatctggcattatattacatacttattttgtatgtttactgtctatattattcctgtctgtgttactctactgggagcagcacttctcatgcattactgtttcttcagggcctggaacagtataagcacataatatcttttgaatgtgtgaatttaatccatgtcccctcttcctacaatactttagttaaattgtggcttagagtttgaaagaaaacattttgaaatttttctatggcctaaagtgacaatgacatcactcaactttgggtggtcattaaattagtctgttatttatttatttatttctgagacagagtcttgctctgtcacccaggctggattgcaatgacatcactcagctttgggtgatcattaaattagtctgttaatttttttt

SEQ ID NO: 109665 - DNA, 1044 bp, Homo sapiens
atttagggatatctgaccagagttgccctgttctcattagctatatataacataccacacatcacctttcagaaatttgaattagagagctgggtttgtcccagaaagctgcctcagggaagctagtagaagaatgatgtacttttacttctgtgtcagtcaatccctgttgtagacaatatcacgttacttcctttttacaaatcagacacaattcctgctgcaatgaatttctaacagaaaataataggaatatatcattttggtttttcttttcaatcatgcaatcaatcaaacacttattgaaatactgcaatcaagaaacaagataaacaaatatttactgagcccagtaactttgggaagtctcctgtttcctcaaggatcttacctcttagcattgtaatcagtgtactgggagggtcagaagacatgtaaaatgtagcccaatttttaaacatgcaaataacctggttgggaaggtcaaaccaacacacattaaacagaaaaataagctgagcacagtgtggcttttggatactctggagttgactattgctattggtgagttgtaaagaataaggctagaaacataggatgtgagctggattatagatcttgaaagctaaaaagaggtgcttattagcaggagggagccactgtgagttcctgagtctggaatgacataatgaaattgcactttaggaagatttttaggtctttaattatttcctcccacttctcattcatctgggagccaagtaatagtataaattatgcatctcaaaaattgtcatctgatttaactaatggaccgtgaaatgtaaaacacagtgtctcctcacatttaaagatgatgaagccaacggctggtgggatcaatgtctatgtaaaacaggcccgaggtgattttagacctcagacagacaaactttgatctactaaagactactacaattagcaatagtagcctaaagcaagaaaccttcttgtttctgtaatcaaactgtcccttaagaaagattgacaaatatataaaatgtg

SEQ ID NO: 109666 - DNA, 1075 bp, Homo sapiens
ttctttttcttgctttattccactcaatctgcactatgatatggaatggaaatagtgagagtggacatccttgtgttgttcctgatcttaaggggaaatcattcagtttttaattattaaatataatattaattttaagtttcttttgtagatgtcctttatcagctcccaccttaaaatagaaaaagggataccaggtgcagtggctcattcctgtaatcctagcactttggtaggccaaggcaggaggattgcttgagcctaggagtttgagagcatagtgagaccccatctctctctctaaaaaaaaaccaaaaaggaatagaaaaagaagagaaatcaagcccaaagtgagcagtgagcagaataacaataaagttaagaacagaagtcagtgaaataggaaacataaaaacaatagagaaaatcaatgaaatcaaaagttggttaattgatgagattagtaaagctggtaaacctctagccaaactgattgaggaaaaaaaaaaaaagagtgaagacacaaatagccaatatcaggtatacaaaagggacataattaccaacgctgcagacattaaaaggataataaatatcacttgcaactgtaaacttataaatttgacaacttaaatgaaataggcaaatttcttcacagcttaaaattcaaagcttatgaaagaagacacaaataactcaaatagtcctctacctattaaagaaattgaataattgtgaaaaaaaacccacaaagaaaacttttctatttgttcttgtgtcacttttggtaaattatattttctaaggaatttgtccatgtgtgtcacttaaattgtcaaatttattggcataagttatcatatcttttaaattaattttaaaatgtctatagtatttgtagtaatatctcctctttcattcctagattttatgatttgtgtgttttatcttatttctatattgtacatgggttttctactagatcaatttgtttttatgtttattattttcatctttcaattttctttgggaatattttgctgttcttttcctagctctttgagaataagtgctt

SEQ ID NO: 109667 - DNA, 1079 bp, Homo sapiens
cgggagtaaattactgcatttgaaggaatgccaatatcatagtcatgcaggcagttatatcaaatattttgcagaatgttaggataaagaaagcaacaaggaaatagactgaattccaacggaagccagcactataattcataccatattcccataaaaatgaacagacacatgaaaaaaagcaccatagaggtttcactctttattatcataacctaggaagaatttttctttaacactagccaaacatcatgcccataccctttgtactgctgaatcttcattgctggctgtcactgccctagaaatggagctgacattccttcaaaacaagaaatccacaattttaacagacatatcaccactatcttttcctttacaatagagtgcttactatcaactcactgctatttttactgttttctccaagtctttgtaattttcttggttgttgcaagatctgaatactacttggcaaccctattatggtcctttctctcgaagtcttaaaatactaaactgattttaatgttagagagatgcttgtattgcctttgaaccatgagttatgcaaaagaaagagagataactataaagagaaatagaaattattacagggctaatataaactctacacggatcagctttgtgccctatgacacaattaattgtaagataactcttaaagagtgttttatgttgcagcatcctgccattaggagggtatcataagtactattgcctgtcattcactacactccttgcctcctggtactgaacttttttattggtagtatttaatttgacaggggataattttggggtacctctttcagtgggaaaaatacaaagtatatgctaacttatatgatagtttaaatcatttatgtatatatacactttaaaccccagggagatactttttttaatggagcctattaacctgagcatgacaataactaatttcagtgcttttaaaaacctggtccatggaacacttgcatgagaatttcttgggggtatttgttaaaaatccagattcatagtctccatcccctgtccccctccaaaatatactg

SEQ ID NO: 109668 - DNA, 1010 bp, Homo sapiens
aatgcagtagggatagaaaatttgtcctcaaatacttctataggtctcccatatgattttttttcaatatagtagtatttctgacagagaatgaactgtttttcattactaaaggcattacctagttaagtttctatctggagataatgtacctgtttacctgtgaaagaaaaaaaaatagtaaagtttctatctggagataatgtacctgtttacctgtgaaagaaaaaaaataggtggcatagctcttctaattagatggattgagtctatatgcattttaagggcaatagtaatatatgtaatctgaccagctaaataaagctaacagtaaagtatcataactaacctggttgactagtatttctttttctcttgcttgattggtcttagggttttgacccaccacatcagagtgacacaagaaccatctacgtagccaacaggtttcctcagaatggcctttacacacctcagaaatttatagataacaggatcatttcatctaaggtaagaattaaaatttttattgttaggccaggtgcagtggctcatacccatcatcccagcactttgggaggccaaggcgagaggatcggttaagcccaggagtttgcgaccagtgtgggcaacataatgagaccttgtctctgcaaaaaatcaaaaaattagccaggtgtggtggcacacctctactgacagctactctggaggctggcttcagcctgggaagtcgagggtgcagtgagctgtgattgtgccactgcactccaacctgggcaacagagtgagaccatgtctcaaaaaaaaaaattattattaaaactgtagatatggatcattttatttttaaaagtgattatatgtgtgtgtgtgtatttatttatatccttacaaattcaagaaaacggtggtcgatttatcttaaccaaaatggttaactgtagaatacaaggagtggctaattgctgatatcagtagcccacatgccaaaaaattatctttagttg

SEQ ID NO: 109669 - DNA, 1040 bp, Homo sapiens
tatctaaagcatttctatttctttaacattctaggttatttcctcatatttcatactaaacaaactatttcctctgtttctgatgctaaactaactaaaatataaattgtatctagtatctgcatttctatcaactcatatttatctttagcattaggtttagttttgtataccaaaatccaaaataagttattaaaatgttgttttagatctgctttctctaacttctaaaaaaactggaatttagtagcaaaattgttgggtttcagcttattccatttttcaaaattaagctaaaattgccaataaatagtaaaaggaagaaaaaagggaagtagaataaaagtcctgaactctaaaagccagatggtttctgtagcatatagacttacagaattttgtctaaggggttagtaaaaccgattttactttacttcttaatattatgtctatatacttgatattatttttaaatattaatttattgatctctttctttttagtacactgtgtggaattttgttccaaaaaatttatttgaacagttcagaagagtggcaaacttttattttcttattatatttttggttcaggtaagctttattactcaatcttaagtttgtaaacatagtttctaaaaatatgtcttggaacaaagaaaaattacattgtgttgctaatcatttgaccatgtgaccattttttctgcagtgcttctgcattgtattcagtgaatacaatgatctgtcatatctagatttctaaaagaaatagcctgtaaactttaagatcaattgtatattgtttcatcaataatgtgctgtagtacttagattaaccataatcttagctaagagtgtaacctaatatctttcagatattctgcctcagaacataaatgtttaggcttttaatatatagttcatattttcggtacatttctgcctgtggaatcatctttgtacaaagtaaacttttctttggcttttaattttttaatttaaatttaacttaaatttaagttatttaataagaattgt

SEQ ID NO: 109670 - DNA, 1107 bp, Homo sapiens
cagcacactttcaggacatcatctgtttggttctgaatatgtttaagacatttatgagacatcaaaattgagatattaataaagcaattaggtattcaagtttggagttcaaaagagatatatggctggagatacacattttggaattaccagcatatttatactatttgaagacacagggatagaagaaatctcttagtgagaaagaggaatgtgagaaaaggatccataaaggtgacatcgaaggagcctccttaaggaaattgagaagaaataactagaggtcctgtgaaagccaggaaaatgtatatgacaaaaaagaagcaagtgtttccagtaggaacaaatatcagatacctatgagcatgtgcatccaaatagcctcatatgattctggaatgtagtgttccagggaagtttttgagttttttttcttatttgataaaagtatcttcaaattatactgaaaaattattttttaccctttggatatttacagggatatgaagattggttacggcataactcagataatgaagtaaatggagctcctgtttatgttgttcgaagtggtggccttgtaaaaactagatcaaaaaacattcgggtatgcatctggtaaataatggaaatcaactttatcttgatatcacaggacataattctaatcttgatattacgttttagttaaaagcctactttcctatgctaaaatactgtgataggctgcttctttagagcccaataaaagtaagtccttgccttttaaaatttataaattcactcttccccaaaattctttataggtgggtgatattgttcgaatagccaaagatgaaatttttcctgcagacttggtgcttctgtcctcagatcgactggatggttcctgtcacgttacaactgctagtttggacggagaaactaacctgaaggtttgcttgcatatgtttgagtattgctcttggtgaacaaagtgtctttggattataattatacttaactttggttaaagtagtaaagtttgaccagattaaggggaagtttttaaaattactatttcaaaaataaaaaggttttaagaaagaattgatgttatatctttat

SEQ ID NO: 109671 - DNA, 1001 bp, Homo sapiens
cttgtaacccatttattcattcatttaccctcagctattatttctccttttctccattaatacccaaacttttccaggaaagggttaatttaaaagcactttgcatttcatctgctagtaatttgtggcagcagcaagtgaggatgaaacaaatcccatgaaatgatatcagaataatttagtaagattatttgtgtttttgcatttctttttctgataatactaggtagtaatattaaaaggaaacatagctgcttttttgcactccttatacatttaaaccgacgatgcctagtaagtctagaatatgaaaaatgttttatatgatgtttaacaagtataagtgctatgctcttcttcacttcagaatcattcagtgcaagctggggtgtttagtggtcaatccagaaccgcttacttacttttctgatttttatttttcttggttgtttcagattgttttccctcaatatttgggttaatgaatggctcctaaatgaaaggctttgtgtcagttcaaagacatgctgataggatatgattacgttgttactcatgagcgttaaccttatttggaatcaatcttggaatcagctcttgagtttctaatcgcatttgacattctacctcttttctggggacatgttcagtttatactggctgcatgaaataagtcactataacagaaagagttgagcattttttaatgaaatcctcaagacaagccagcaaaaataccatacattcacattgattcacatttttaataagcattaacataggagcatgttcagtaaacactgtagcaagatctttgtatgtgtacgatccctgctgaataactatgcctaggtttattttgatttttatagggaaatagtgagaaatgtgtggatacatagtctgagttgcattaatatgtaaaggaaaatagcagttatattacttcagcccctagaatggttaaaaaaatgaaccatgttctctactaaaacaacctg

SEQ ID NO: 109672 - DNA, 1025 bp, Homo sapiens
ttttttttatttttttttatttttgagatggagtctcactcttgtcacccaggctggagtgcagtggcgcaatctcggctcactgcaacctccgcctccacggttcaaaaaattctcctgccttagcctcctgagtagctgggactacaggcgcatgccgccacgcctggctaatttcttttgtattttagcagagacggggtttcaccatgttgcccaggctggtctcaaactcctgagctcaggcaatccacccgcctcagcttcccaaagtgctagcattacaggcgttagccaccacgcccggcccctgggcagctttatagtagctgggattttggttttatatgaaagtggtgttatggctatagcttaagtaccttctgctgaagatgccatttcagaattgaagagtttttaatatattcagtgctttatggttattttctttttttcctagacctctggggccggagagtctcctgcttcgtggagccagattaaaaaacacaaaagaaatttttggtttgtacatatttaaacattttaaattattgatttgtgttgatgctttatatgaagtacttttaaaagtacaatgtggtcttttggttagataatttattaattatttgtcatttatgataattttcttataaagtttgtattacagtagtcgtgtattgaacttttgttttgttgatgatccctgttttttaatagtagactagaaccttgatcttatgttatctttacggatacttgtgaaactgagtgcagataatttatataacacttctagtaatggtgggtgagaaccaatataatatggtatcatggtacagtaaaccacttctataatttcattatgattattagattggattaataactgcagatttatccattcatacattcattcaacaaatttactgatatctgaatatatactaggtactattggaacatacactgattggatcaaaaggatgaataagtactgctcttgccttggagatggatca

SEQ ID NO: 109673 - DNA, 2768 bp, Homo sapiens
ccaggctggagtatagttgcacgatctcggctcattgcaacctctgcctcccgggttcaagcaattctcctgcctcagcctcccaaatagctgagattacaggcatgtgccaccatgcccggctaatttttgtatttttagtagaccacgttggccaggttggtctcgaactcctgacctcaagtgatccacctgccttggcctcccaaagtgatgggattacaggcgtgagccactgcgcccggccaacacatctttctagtagtaacttcgtcactcctgtttactttaaagtaaaccataatgaatggggtccaaattttgtacactcttaaaagaaaatgtgaatttgaatgcctttagatgggtctgtcttctgttgttttgcctcagtaccacctctccctattggatcattctggctattttaccacgtttctataatctctatttgagttataataccctgcctttaaggaataagtcaagataaaacttccaggacaaatatttaggaagagggcatgaaaggttctatattgcttttcaaattgtactatttagggatgggaatgaatatttattgatcatctctcagtttttaggcattttgttaatttgtcatacagacctcacaactctatgaggtattttttcccatttaaagatgggaagattgagactcacagaaattacttacccgaggatgtagaactaataagtggcagagctagaattcaaaccaaggtctagctgcaaagttttttgataagctggtctcacctaattccatttgttgtccagttttagtcccattactactgtcatccttgctcatctcaaagtcattcaataggcgcacattttttaaatagcactttccatgtgcttacttgatttactctgacagacttccatgttatctctccaatggttatggaataatgtctagacccccgattccagcattcagggcttttcacactgtggccatagtccattgtcccaacctaacagaaagtgcttttccatatctgtctttgttaacactgctgtatttgtaatggccttccctgacacttttatctttccagattcttttcctctatcaattccaattcaagtaataaatttttcattcaggtatctgttacaactcaggaacaggactccatgccctcccccatttagccagttgagtgactggggcttcccaaaattggactcagaaagccttttagtactctgaaaatacttaaagaaaagcaaaattataacaactgtcagacagtacactaaaagctttcatgctggtaaatatatttatttcttgtgaaacatgctagaggattattttaagagacaattttgttttattttacaggtgttgcggtatacactggaatggaaactaagatggcattaaattacaagagcaaatcacagaaacgatctgcagtagaaaagtaagaaaactgttttcatttatttatatgtaattataactctacattttttattcgtttggtataaaatattatatatataatatatattaagtaaacagaatgaaaaccttggggacagtgatagtttcttatatttttacatacaagtaacattttgcacagtattggacatgtagtaaatgctctatagtatgacttttaaaataaatactattgaataaatggtggaatcacttaatcacactaacgcagataacagttctaaaactgaaaaaaaaatttaaataaacaactatttgaaaacattggagacaaaccagaatcgaatagaaatgggcaaggagtgtaatcctgaaagatgatagcagcaagggggaaaatttaagagtatagctttttgcctgagggcactccccagtttatgtgctgcttgggacatcaaaaagtctgaactttactggatagaagtatcagaggacaaggttaatagctggaagagcagctggaaagttaggggaaaataatgtaaggggattagcattaattcccttctgtaagcaatgagatgtaagctacagaatggaattaactctaaaaactgcacataaattctgcccaggtccttggctgactgctagaactatacatgtgcaagggagacaaaagaactcaacagaattttactgctgcccattgcattggagacacagtttgttgaactaggtgaagttaacttcctactggaataaaaatagcactcttctgaggaacataaaagaatacagactgtctacaatgtattattatgaagtccagtctgcaataaaaaataagcagaatatgaagaaaatgtaattcatccataagataaaaagcactcaatagaaactgtctccaaaatgatccagatcttgcatttagcagacgagaactttaaagcagatattataaatttattataaacatgtttaagggcctaaaggaaaatttgaatgaacatatgggaaaacacagcagagaaatgaaaactcttgacttgaaaaacataattactaaaatggaaacatcattaggtgggtctcaacaccagactgaataaatcagaccagtgaacttgaagaaaacacaaattactcagtcgaagaatggagaggaaaaaagattaggaaaaatgaacagagcttcagagccatgtgggataatattaagctgtttggcatatgtgtaattgattcccaaaaaaagagaaaaaaggacagaataaaaatatttgaaaaaataatgactgaaaatttctaa

SEQ ID NO: 109674 - DNA, 1027 bp, Homo sapiens
taaaactaatacacagtaaaaaaattaggtaataggagctgtggtactagttttaaatttaaataagggaaagttgaatgtaaaccaatgtaattaggacagactttaggaaggagatggattttgagttaaattttgaaaaataggttagtaatgtagggaaaaaggagaatatgtctgatgagggtagacatgagcaagaaagatggaaataaaccaggcattttgttgccacaaggagacatgactagtttagtgaaaagaggtcaaaatttagactcagacagatgtagatttgaatgtcatatcccttccttactagctctatggggctttagaccagttgttttcttctcttgatccgggtgttctcatgtataaaaatgcgagcagtactataggtgaagtgctgaatactatgcctaatacataataaccaaacgaaagccagttcctttcttacattccttatttactgtcacagcagaatatatagagtttacattggaacatggtggaatatcagcttactccatagttaagattaggttcaattatgaaaggcctagggagaaaaatcagaattcaggcatttttcagtcttttaaagagtttttacaaagcttgtgattcacattttccctcaatatttgttggatgtgagagttcattataataacataacttgttttgcatacatttgaatttataatgatgagttcctttaattgtattaatatgtttttaaacttaaagacatgtggcattaagcttacctaataaagagaagagggattctgaagtcaattcctgacatgtgtgattttgggatatttacagaattatttttgggctttgatctttgtcagttaaaaagtatataataatttcccctttacagggtttttgtttgtttgtttgttttttcgagacagagtctcgctctgtcgcccaggctagagtgcagtggcacgatctcgcctcactgcaagctctgcctcccgagttcatgccattctcctgcctc

SEQ ID NO: 109675 - DNA, 1074 bp, Homo sapiens
gtgagccaccacacccagccagggttttcatatagattaggtaaggtagtagatgtgacaaacattttataaaattttaatgctatacaaatgctatttttagctattacacttaaggtgggtgctgaaaatgtaaaaaaaaaaaaacttagaataattacttatggcaaaaataactgactaaaaccgtcatttactgtaaacatttttaatggtaacatggctatattaaataggcttgtaacctgtgtgcactggttcttttattgctaataaataaattctatttaacggttatttcttgaaaacaaaagctgtgtattttaaaatagttacagtaataccctctatgttttaatatcttctctaatacaagtactaattttcaagcaaatgaatatagtaatacatgagttgtatgttttatattctctttttcttccttaaggtcaatgaatacatttttgataatttatctagtaattcttatatctgaagctgtcatcagcactatcttgaagtatacatggcaagctgaagaaaaatgggatgaaccttggtataaccaaaaaacagaacatcaaagaaatagcagtaaggtattttatggtgttattgactgtgtcataaaggaaactattacttggcacgattagtgctttggtagtgacttctgattggagagaccactgtaatcctaaaactgttggtactgaagggtgacagaaatggcattgcaaatgcagagaagccagcgtgtttgtactgatacgctttttgtagtttacggcataaaaagttgtattccctgtggcatgacttgaatagttcaaagaggtcacaaaattttaaatccatctatatttgcatttcacattaatactacaaactcaattttctcttccacttactgtgtcttataaatgaatcaaagagtaaatggatgtatttttaattttgtcttaataattcaaggatgcttgttatcagtcttaatatgaagtaatatgcaaattatgtcatatattttaaattgattaaacatggactaccaagagaatttaacctataatt

SEQ ID NO: 109676 - DNA, 1050 bp, Homo sapiens
cttagagtcctactacttaaaataccttagccaagaaaaagaaaagaagcattaataccaaattctcgtcaattctacagataaacatgtacgtaaagatgccacaaacttcaaaatctatgtagctttaaactattttgtgttaccctgttttctttccttggcatctatatttatttaattgtgcttggattataagaatctcagcatccatatatcaatattaatagataaactggacttcaggagagcgaggacagagatttttttcttgtttaacataggaccatgaacacaaaggtttattttcttttgttttctatctctataggtagagtacgtgtttacagataaaactggtacactgacagaaaatgagatgcagtttcgggaatgttcaattaatggcatgaaataccaagaaattaatggtagacttgtacccgaaggaccaacaccagactcttcagaaggaaacttatcttatcttagtagtttatcccatcttaacaacttatcccatcttacaaccagttcctctttcagaaccagtcctgaaaatgaaactgaactagtaagtaatttttaaattaataaataagggtttcatatgaaataattctcttcagtagttgatgagttgcaggaaaaaaagtttgtgtcagtagagcaaggaatatacatttgaaattcatatatttgattcaacaatataaaatataatcctaagaatttgttgttacagcccagtttaacttgttatttaatacgtgtctgccttagctctttgagtatttaaatggaacgtagttaagaaaagcccttactgccttgaagtgaagaagactttctttgaaaaatagagcttaaatttatttaatactttttgagacctcacttcttctataaaaaagtgttcccctctacttgcaatgtggttgtacctcctaaaaagatgctcacgtgttgaagggtcctaagcaaatgtgacattttactttttgaaggcagaaacaaccaactgttattcaggcaatcaaggttgtagca

SEQ ID NO: 109677 - DNA, 1892 bp, Homo sapiens
tcactgctataatgagcctttgatattaatgtgtgttgtgtttgtcaggtgtattaggacagaaaaaagcgttgagaatcagttaccttttttagtcagaaaaacatggagctgggcagatctggattccagttcttgctctgccactcacaagcttacctgactttaggcaaattacttaatctttctgaggttaatagtcctcatctataaaaatgagataagacctactttcttggcctctcatggatattaaatgacataaggtgtgtaaaatacatggcatttggtaattactcaatgtcagtctcttctatttcttccctgttttgttattaatggcatgtaacctatcatcatgaaaatggtattaattcttgttctcaattagccattttatcttatatatggattatttccatatagtcacttaatattattttaaaaaaagtaaagtttttgtctttcttactttcttttgtttaggtacaaactgcttcatattctggaatttgattcagatcgtaggagaatgagtgtaattgttcaggcaccttcaggtaaccaatctaaactttcatgaatttttatttatgtaatattaagagtctgataactcattttttttgtctctaggtgagaagttattatttgctaaaggagctgagtcatcaattctccctaaatgtataggtggagaaatagaaaaaaccagaattcatgtagatgaatttgctttggtgagtgcaaatttctatgatttaaaaaactctaaaagatatatttatgaaatattttggactttatttcttataatttatcaaaaattgtggacattctgcagttgtgttacactgtgtgttggctccacattccttttgtgaaaactgacttttaacgcaagcaaaaatatatcttctcttcaaacctactctacagtcggggcatttctggttacaaggtctactcaaactatgctattttagaagagtgtttattaaacaaacataggggaatcctaatgatgtggagaaactggaacccttatacacatattgctggtaagattataaatggtacagccacattgaaaaataatttggctaagttcctcaaaaggtaaacattgagttactatatgacacagcagttctactcctgggtggacacccaagacagctgaaaacatgttcacaaaaaaatcttatacacgaaatgttcataagcagcattatttccaatagccacaaaaatggaaaaccccaaatgtccagctaacaagtggataggcaaaatgtggtatatccatataatggaatatcagtcagctgttaagaggaatgaagtaccaatatatgctacaacatggacgaatcttgaaaagagtgtgctgagtgaaagaggcagtcaaaaaaggccttatattaatactacatttatatgaaatatccagaataggcaaattcacagagaaagctcattaatgattgccaggggctggaggaaggggaaaaaggagagtcctcgtgggagcaatgagatattgtggatttagatagtggtgataattgcacaactctgtgaatatgcgatataacactgatttgtactgtttgaagaggtgaattatatctctcatttacaaaatttaaaaatataggggaatcttgttaaaacaaagagccatcattcatgtaaatggcaaaattattatgcagttctctctcagtcttagaacttcatgatctctcatttttgcatttctgtgaatgtgtgctccacactcacctctgctcatctgccttctttaacagtttatgatttttttcccattatttgtttcctaattgtttatgttccagtttacccaccacatcgtaacatctgtgaga

SEQ ID NO: 109678 - DNA, 2049 bp, Homo sapiens
tcgcccaggctggagtgcagtgatgctatttcggctcactgcaagctccacctcccgggttcacgccattctcctgcctcagcttcctgagtagctgggactacaggtgcccgccactatgcccgcccaattttttgtatttttagtagagactgggtttcaccatgttagccaggatggtctcgatctcctgacctcatgatccgcctgccttggcctcccagagtgctgggattacaggcgtgagccaccgcacccagcctattttgagcaacttcttaagaaaacatcagaagttgaaagaggtatatgtgtcccataactcagatcagtagagctttgtgacattatttatttcctgtcactaggtgatagtactttttaaatgatttgtgattgacttttggtactaggtcttcagtgtattttgatagtgacttcttgattttctgtttgttgtttgtgttcaatttttgtctttaatttttatttgtttgttttagaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacaggtaagtatcagataattaaaaaatattacttttctctcataggaatttttgtaaccaagtattctaatatgtgacataaattctctttactaacatcccatgatatatttaagatcaaagtagagaactaaagccttaatttttcccggtcagtatgtacaatttttgttctagctagatacctgaaatggatgaaagaaactagctctctatagttttttcttataggcttgaatctttagaatactcctcagcatgtcatgcaaacacttgaagcacctgcttaattctccagccttccctcctaccactgtctccttccgctttatgtttcaacaataccaaactgtctctgcatgccacctgtagctaaaactattctgttttgtgcctatgttggccttctgcctgggtgattcttcccttcaccatccctctgtgactacctattcataaagtatagcttagatattagctccagtccagtaagacctttcctgacacctaagaggattaaaaattctcttctttgtgaagtctcattgtaggtagttctgttgttgtctttgtggcactatattataattatttgtttaaagacttctcctctgttaacctgtgaaatccttgaagtccatttattctttgtctttgttcccagaacctatctcaatgtctgtttcacagtttcttaaatttagctgaattctgagattgaattctgcagattaagtttgttgttatgtttgcctccaccacctagacctaagggtgtttgcatatttttaaaatctatgttttcatttactttttggttgtccttacgagatttctgagactcacctaaagttagctagacctttattttctacagtctgattttttaactatatgagtggtttgagatatttttttaaatcaaaacaaaaggagaaaaatcttcttgtttgaaatgtaagacttcgtaataaaacaggagtttatgaagagcacatagtttcatcctatgaatagcaactttgaagatacattcttaaaatatgaaattgtagattttaattggttgattttgtgttaaccagacaattaccaatctgtttattcgtgtttccttcctaatgagagaaaattccagttatattgctatattgtataataacattcctaggtcaagtcaaagagtttagaattatccttaaatatactatgtagtttaacttaaaatacagtcataaaagtattctctactactaatttgtttctgttcttttcagactacaagataaagttcgagaaactattgaagcattgagaatggctggtatcaaagtatgggtacttactggggataaacatgaaacagc

SEQ ID NO: 109679 - DNA, 1048 bp, Homo sapiens
gggcacagcggctcacacctgtaatcccagcactttgagaggctgagacaggcagatcgcttgaggtcaggagtttgagaccagcctgggcaacatagtgaaaccccatctctactaaaataacaaaaattagccaatcatagtggctcatgcctatagtccaagataggaagctgaagcaagagaatcacttaagcccaggaggtcaaggctgcagtgagccactatactccagcctgggtgacagagcaagaccctgtttcacaaaaaagagaaagaaagaaaaattgaatattatctgttttactcatcagtgactcaattctgcttaattttaaatttaaggtagtaaaacagtttgtttcctgacataacagtcttgtaacagtaagggctgtgggtaaaagatccatctttcagtaagaatgtgttgttctatatgagtgtaaataatatggcttcaaagtatcttacagagaatataattattttctcttttagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtatgtatatatgttataaaaaagtcccataaagctatttagatataaacatattatttaaagttaatgccttacatagttccatttggtgatgtgcaatatatacattttgctaggagtcagtcacatctcatgttgtaaattttaatcatgtacatcagacttttggaattctcagagtgagtttcaactattcatagtgacccagaaaacctgtgatgagtagcagtttgtgatcttgcagaaattaaactgtgataactaatgtttcgcaagttagctacttagcgagtgaaggagcctaggagacatcaattatttgcaccttcagatggttctgttgatctccgtttattcttgcattctcatgaagtgataattctttgttacttt

SEQ ID NO: 109680 - DNA, 1053 bp, Homo sapiens
aatcttgattgatttttttaaagtcttaaaattttactacaagaggaaacaattatttctttcatatcaaatgaaaaaataatttcttaagaaaaaattttgcctaacagttcaattaagtagtcattttttacacaattactattaaaccttctaaatatttaagctatatttaaaagattcttgtttctcatcataaaatccaaagataattctctgttttattataacatttctgaaagacatctctaaaatcttaatggagataccctcaaaaaaatgaacctgcatattattgtctaataaaaaattaaatatttctttcattagtgttcttactatagtcatttcagataaatgactatatgaatgcaagaaaattgaacttgcgtcataaataaccaattcattatgtctttcaggtaataagactaataaaaatatcacctgagaaacctataacattggctgttggtgatggtgctaatgacgtaagcatgatacaagaagcccatgttggcataggtgattgattcttcctgaaaagtttttcctgaacttttaaagttggtggtattatttggtggtttttaattttctttttgtagattaaagtacagtatcaaatttgtgaatgaaaattgcaacatggtaataatatagcacagtgtgccccatcagaaacttactataattaggccgggcgtggtggctcacgcctgtaatcccagcactttggggggttgaggcaggcagatcacgaggtcagaagttcgagaccaacctgaccaacgtggtgaaaccccgtctctactaaaaatacaaaaattagccaggcgtggtggcacgtgcctgtaatcccagctactcaggaggctgaggcaggagaattgcttgaacccgggaggcagaggttgcagtgagccgaggctgaggcaggagaattgcttgaacccaggaggcagaggttgcagtgagccgaggctgaggcaggagaattgcttgaacccgggagacagaggttgcagtgagccacgatcgcgccactgcact

SEQ ID NO: 109681 - DNA, 2053 bp, Homo sapiens
attttaaattcatattttccttttaaaaagtgcactttgacttattcatggaagtgttaagcaaacaaatgactcattttgctaaactcaaatgactcaatttgaatattttttatattcagtgaaaatagtgaagttaagtattttatagcattctgtccatcagaagtctgttacccagtacttgtgcttattagtgtaataattgatgttcctgctaaatccttaactttcaatattattttttatattgtattttatctttttatattctaattctttggaaattggtgttatgtgtctgataaatatcgtagccttatattaattacatatttaagtagaacaaccttttggacatctgctatctgctgtatattaggatttaatgttcctaagtgcatgttcaactattataaataattaagatatttgcagatttatcatgaaaattacagttatcagtgaacatgtcttttgtcccttttattataggaatcatgggtaaagaaggaagacaggctgcaagaaacagtgactatgcaatagccagatttaagttcctctccaaattgctttttgttcatggtcatttttattatattagaatagctacccttgtacagtattttttttataaggtgagtttcatgtatttagaatcaattattgatatagtaatatgaagtttcaatttaaggaatgttataaccttatacatttctctttaaaatagtttcaataagtaaaaataacagtattttgtcataaatctattctatactgacagaaagcaaatcagtggttgcctggggcccaggggttccatgcaaattagaacatagtacatttgatatctttaaagttattttgtcctgaaccagcaataagttttaacaccaatataatggttttaagtagagttcttagcctttttatgccatgaatgaccttttagtagtctagtgaaatgtgtgagctcctcaatatggagcttttatatgcataaaatgaaatacatagggttacaaagaaacaaattatgttgaaatattgtcctatctttgggtcctttggtacaaggtgggagtttgcagaacccacattaagagcccctgttaccaatacatttaataacaccagagtgtactatgttgcatatatttctataattgataactacaatccagtgatagaacacaagtagattgcatattgctataagatgatggcagtttttttctaacttatttttctagcttttacttgtaatatgagtatattgagatggaaagaagtttcgatagtttgatttattgtgtgttttaaacatttttgtgttgtaaagatatagccctaaagtttgagtaaatcttacttattgtactatatatgaaaagtattgagtaatagtttgaaggttgtaaattcaaaattatagtgttgcttggcagtgagaggagtcaagggttttttcattctgatgtctgcactgttgcttagaatgtttttagacattttttgataaaatgggaatcctgcattcctgttatatatggacaagtccttatcctttacttaccataccaactgagattgtttttggacactttaacagccattttttttattttttattttgtctttgaaacctaaatattttaattattttccatttaatcttgtttttcagaatgtgtgctttatcacaccccagtttttatatcagttctactgtttgttttctcagcaagtaagtaaatagaaacttgtgttttgtgttttgtccttttagagtaacgtatgtatgttcagattttgatagacgtttgaagggacttttttcatttttcttagtcctgcagggaaccagacagaacttttctgtttagtatatttaaccagcatgacattcagaatatttatttattctggttttcagtttgaggtgagtgttaataccaaaatgtaattctggatgcttttaaaaatagataataacccttaacagcttatgagagaattttgataacttatttgtgatatttctgta

SEQ ID NO: 109682 - DNA, 2131 bp, Homo sapiens
tctaaacccatctttgggttccagtctgataatgatatctaaaagatcattgtctataataataacacatgtaaataatgctttatgctgttcttctcatacttttaactttatgagtatagtcaccagtttcaaatgtacctgacttaaataattcaagggatttttagtagagaattaaatgactttttacctgacatttaacattatgttaacacgtaatgtaatagtgtattctttctgtttagatgtttggaaactggacatttggcactttggtcttcacagtcatggttattacagtcacagtaaaggtatggtactgaaattagaaatgtggacacattttgcaactgtttacatagttagttaactttcttcatttctttagccatagatactttccctttttccattttcaataacgattaatttcactggttactattttaatagttaaatttttgtcaaaaaattatttttaaagtttattattttgggaagcctcagctgatatttatgatcacatttttaaaaatctctaaaaattttgcttctctgtgtatagtgcaagacagcgtaatttgttttaggccatggagttgaaaatagagtaatcacatgaaatttgaatgctgtttcctcaaagaagaaaaacattataaacttgaaattatttcattttatactaggaccttttcattcatatttatctctgagggattttgagggattgtatctgtcttctgagagacttttagatacttatgtttattcttgagtttcatctgaaaggttaaggtaaagctttatttgtttatatttctaaggatataaaaacttttttttagatggctctggaaactcatttttggacttggatcaaccatctcgttacctggggatctattatattttattttgtattttccttgttttatggagggattctctggtgagtgaatatattgtattttaattggattgcttcaactataataaacatttattgtgataggttacattatgaacatattctgctcataacagatttcagactcctggtaagtttacttcttcagttgatcttactgatatggagaggaaaaaactaacatttattgaatatctacaatttttctagattttttttatataagatattgattcatcataataatgatccctgtttttttctgtgtagaaactgagcctcaggatcacaaagacaaaaaagtaccaaagccaagatttaaaccccaattgtcttatttcacaattttctttacactagttatattatgtattaatgtattatgtgttaatatatacaataaagtaagtcacatagaaccattaaatattaatcattaacttttctcacaaaagtaagtagtatgcatcatcttcattgatagaatcagatattcaactggctactcagatagattaaaaattaatgtttctcctaagattctttggtaagtgatggacaactgagggctctcttttggagaatttatattacatttgcctgctatgtctttgatccatttatcagacaaaaaaaagcttctgaaggtaggccaaaaaaatttggattagctaaatattaacttctatttaggatcataaaaggatactcttatgaatatttctatatttcaccatattcttttgaggtagtatatacaaaaacccaaaaagaatatctttataacacttactactatgtaaaactagtattcgtgagtacattaattttaaaatatgtttttgaagaagagcctctgaataaagctttcattctaagatttggataatcggccttctaaaatattttattacacactttttcttgctttacttggtcccttaagtctgtattactacattattcttctgatccactaccactaagatagggttatctggtcaactgcttgccattttcctaataaaaactatagttgttttatttttaacaattaaagcttatcttgttttgttagttcagttaattaaattatactgatttcagttttgaacattttcttggagtacttgttactttcaactgtagtgtctttatatgatgtcctgatttaagtctttcagtttccacttttat

SEQ ID NO: 109683 - DNA, 1032 bp, Homo sapiens
gtgtgtccatcccttttctgtccacttatagatgtactccaacacagttgctttaagtgacgagttcatcgcactgcagccattgtcgagggcaaggaatcagctgagcaaacttaggtagagtaggaggagtagagcctcattaactcttctgcatgctaaaggtcaattaaacaatatcaaaagatgggcagaggcataaataaagagcggggcatttttgttagcatggccctgtctctgaataatttgacctttattaacatatacgttaaaacctaaaaaaaaaaatccatttcttctttgagaagaaaattcagataaaaattcaacgtgatcacagaacagagatctataccttgttaatatatctttacaccttaactaccttttctagtacaattctaatgcttctgcttgtcatgttattcatatttatgaatgctcctgcatgttgagtaattaaagctacatatttggaagtgagagttgcccattttttttatcttgccttaatctgtattgtaaatacatgtgcatatttatgtttgtgtattgtaatggctgctgaagcatttcatatcctggctactatttagtgcatctataaatcgaacaatgtgtgtgtatgtcttatctttatctccacagacagattcattctgtcagtttgtacaaaaaataatagtttagggatgccttttgataaaaagggatgaaagcttaaattctagaactgtttatattaagatactataactatgtattaagtatggtttgaaggggaaaagtaatataagttattatttttctttttagaaattgacacttttccatttcttgccctattggtttcttacagattcttaatcacgtattttttaaattattttttattctcaaggtttctaatctttctctatgttcatttgaattttaaattctgttttattctcaaggtttctaatctttctgtgttcatctgatcaaatgaatggcttttacgaagcaccacttaaatagccttttata

SEQ ID NO: 109684 - DNA, 1166 bp, Homo sapiens
attgttttttattcattaaggacattgtcttataataagatttaaaataaagatggctatggaaacattttaaacttccttagaagatctctaatacaaatacagaaaaagaactgaaatttatataaattattgaccctcattaaaaatctgtttcaaattaaggattaaatttcttttgttaacaaatagatcaggtgaagccctttgcacacatgctcaacatttctaaggccatgaagtccagttagagtagagaagtcttctgagaagggaagcaggaaaggtgagaaattggacataccttttcaataagaaccctaaatcttggtggcaaatgaatttaatagaagaaactgaattttattgaaagaaatttggttttaacttagctgtaatatatgtttagttagagcttcgtgcactgaaaaatcatggctttattttgtgtgcttgtgttccccttaagaagttcccattagccctcttttgtgacagtaaatgtactgttctttgaacattcttttgtgcctcagattgtgaatgccaacttgttgctttgatcttaaacctctatatggtgaagagtatcattctgtaatatgagacttgttgcttttctgtccttccagatggaagaagataagggttcagtcagctcagcatatgaatttgctgaaagccagcacagaggggaggacagtaggcacctgctagctgaggcttgcagccagcaggacagttgttgcgtgcactaggtagtactgcgctggaccttcccgggcactcatccgctaagttctcatgcttggggggcatgtcatgggacacctgacctgacatttccatttctttactaattccttcactgttcctcatatgttgttttagtttcgttgttttccttttttgtggtctttacatttttcatatgtccatccctgaaaattttgtcaatctctctttagagttccaaagataaatcagacttcacctcacattctaagctgtgaagatattctcacaacctattgtcttacattcaagaaaatactcctttttacttctccttttgaaaatgtcatgctatttctgttatctctgaaatcattttcccccttgaagttgtagttgtgtatcatttacccatcttaatatagttggat

SEQ ID NO: 109685 - DNA, 1139 bp, Homo sapiens
gagtggatctatgtagagtgcttagaacctggcacatagtaaagcatacgtaaagtgtttgctgccattgttgttgttactgaacattggggtgaggtcctgcctgattgttatttcccagtcttaaagataattcatactccacttatctcaattgttggacattgttcattgaaattgcaggctagacatttttaattgaaattgcaggagcatttcacctaaagaaaaactccatgcagaattggaattcattacattcctgagtggttgatggaaatcattttgaccataataaatgattaaaatgaaacattaaaagtagatttacataatatccagcttcttaatttatataattattttactagacctctaatttaggatacaaggctttaaaataattttggatggttatactctagtaaattaaagcctttcatatgtttcccatattatagaaaaacatgtaggtttatatatgttacctttgatttgaaagtgcttgttgtaatgttctaatgcttttcagaagtccatatctttaaacaactgatgttttctgcttcacctcccgcagcttactgaaacaaatgcaggtatcaagtgcttggactccatgtgctgtttcccggaaggagaagcagcgtgtgcatctgttggaagaatgctggaacgagttataggaagatgtagtccaacccacatcagcaggtgtgaaatctctctaagtagcctttgctgcagatgagtatcctatctggaacaggatgaacctgccgctctagatacctaataaatcagcagctggttttaccaactgaagcaggaagtctgctatttattagcactctttggtggtagatttcactttgtggctttggggtaagggctttttcactcacaaaggaagagaaagcacctttgaagagacttcatctaatgaacaaaaaattttgtttcataatctttctaaaatgtgctcagtaggagtgtgtttatggtactcttttatggtttgtataactttcttttttaaattatacatatactatttcctttttatttttttaaaatttttttgctttttgtctttacaaaataatctcaacataacagtgaagtcaaaggctttcctt

SEQ ID NO: 109686 - DNA, 1699 bp, Homo sapiens
tcctggtgagccaaacttttctcttattgttactttagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaa

SEQ ID NO: 109687 - DNA, 1123 bp, Homo sapiens
ggttcatccatgttgcagcttatacctgcgtgtagttcctttagttgctgacttagtgttcactgtttggatataccacattttgtttatccattcaccagttgatagacatttggctggcctacaattagtttttttaaattgcgaataataatgctatgaacattcataaatgtctttgtgtggacatgttttcatctcagattcctagttgtggaattgtcaggttgtgtggtaaatttatacctaacgtttttaaaaaaactgctgaactttttccaaagtggctgtacttctagaactattcctgccacagtgcatgcggactgccgtgtctgcacatccttgccaatacttgtcttttttattgcagccatcctggcgggtatttactttatgtgtgtgagttatacctaggcatcccaactcgtgtatcgattggatgtgcagtttgagtgagtttcaagtggcctcagcgattgctgtaaaattagttactctagtagacatgtactctcttggaggtagtattttctgtagtcagtgagggtaataataatacttccagtgggggttccagtccctcagtgatctctggtgagaagaaatgtgtcagcgaagagtggtgctgatggctggtgctttggctctgttattgtttgtaccaaggttgatacagctactcgactagcctatgactgactggtggtggtaattaaactttgtacagattactgtgtgcagatagttactgtcttaatattaagtttcccagagattttacttttgagatagctgagaattaacgactcttggaatttataaaaatttagttgataccatttagttgctgccagctgcctgtgttcttatacataggagacatcggagtgagtgctttttaaaaaattaatggcgtatgtcaggtatatgtaaaaggacaattgcataatgaactcatgttaacatgatcaatccatggccaatcttgatttatctaaatgccattcatctttgaacccctatttattttgaagcaaatcccagatagcaaatcatttcatttgtaaatatttcaatatgtatgtctaaaagataaggactgttaaataaaaccacaatt

SEQ ID NO: 109688 - DNA, 2150 bp, Homo sapiens
atgcaaaaccttttcaacaaaatagtgtttgtcatcaggttggtactaaacatttataattactgtgtaattataaacaaaaatacataaagctttgaatataattatgtagcataaaagttaaggttgttcactatgatggcatcttagaattaaacaaaacttttactagggctgaaaagagaagactgatttaatgtggtgtgattattctgaagataaatgtctggctacagggaatattttgtactaaaaaatgattacacatatggctgtgtgtgtttgagtctgtgtctgtgagagagccagagagagtgagagagattgacagagaaagggagagacacacacacgccccttgaattgctttaactcctaagtgtttcagtcctcattccggtaaactccccatgctgattctttgttttaaactgaaccataggtacagtttcctttttgccaaatgtcaaaacaggtacaaattttaaaatgtaatgctttttaaatagaaaaatgtataaaattagaagtgcccacatataaaaaatacttgagatgaagattatctttagtgaatatcatctgcatatctctgtaagttcaattgtgtttcttacagtccctgtcatattaccaacagaggcaataaaagctgcagtgaaattgccatgactaaatcttttcacatatttcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctttattaacaatactgtacttgcataatatggcattataagtacatgtccttccttagacttttaaaaagttttaatgagagaaagtaaatttactcaacaaaataacatgagaaatcctttacgtaatatctttactggggaattcttatttaagcaaggtacactattttttcctcagacttaaatgaatgaagtgttcatttattttttatttgatgataatcaagaagtgagtagtagtagctaacttaatgtacactttgcttaggtttttaaacatgttactattaagactacgtattgtaaaccttctgtaattttcacatatgaatgacaggagaaagttaaacctaatcgaaggagttttggaataaaaaagtggtgctggggaaattcaccatggttcacaaagtatgcctttgtaaaactgaatcaacttttagcaagaattaatttatgtagttttaaatgttaaattgtgtatatttaacagaaaatacttatctggcacctcagcagttttaatgttaccttatacttttaacagtatgatttatattgaatacttagatgttttcataagattttatcaaatttgataatgtaatgataaaatgtttttttaaatgtgaactatttaacatataaatggggacacaaaacctgaattgtgatttctacataatgtgataattagggttcaaattatgactcatcatttaattgattataaatgagtatatttctgaactctttattgcctccatttttacaatcataatatagcaataatttctatttttatttcataggactgtggtgaagttatttatcatgacacctttatctttgatttctgagggaaaggggtgtatattttgtagttaagataaatgagaaagttcctaatagtacaaatgcccttttccaggtttatctttgctatttgttgccatttttcttaaatatttgctttatttgtacccgatttctggaggcaaatagtgctgttttttcaaactcataatatagttacataaatgattttatcagagcattcttgctatcttattttctttcctacctgttgagtaagtagcatttcttgctcaccaactcatttatttgactaggttcagtgtttcctattaatgtgtttttttattttcctttggttgattttgaaaaatctgtcacaaataaggaagttatggtaaaagatgcacagcctttgtagttagtggaattctcaataagtaatgtctttatggagttttaaagggaaattatttaaaggga

SEQ ID NO: 109689 - DNA, 2051 bp, Homo sapiens
gtttgtttgtttgtttgttttgagagggagtctcgctctgtcccccaggctggagtgcagtggcgcgatctcactgcaagctccgcctcccgggttcacaccattctcctgcctcaggctgccagttttgaccaaattacttccattggctgactgcagtggccttgagaaaatcatattattgatgagttgccagacaagttacttttatcactcaaggaacaaccaaatgttggagtaataaatcacaaggaatacaaggaatatttggggtaaaaactccaaaaagtttgagttttgaaagacttaatcagtgggaatagataagaatgatatactttaacgcttatgaggaagtcttaaaaaaaggattctactaaaatgttagccttatttctgcttttttcccccttctctttctttcatattttttcttttttccaggagcatggcctgttcttattgatgactttgtggaatttgcacgccctcaaattgctgggacaaaaagtacaacagtgtagcactaaaggaaccttctagaatgtacatagtctgtacaataaatacaacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctctttcagacaaatagtccattttcgatgacttattattttgttgaaattgctttaactgctaatcactgtggttgccaaatatttacttcaggagcaaagattttcaaacaagcatacacgatgcaaaataccaatctggcttctagtctctttactgttttcgtttcactcagattagctcagttttctcatcaaagcagaatgctatcttgtatgtatttttttcattacaagccccatgagctgcttttatgctgaaaatggtcatttccctgttcacttactgacatgtgaagaagggtttcttgctttcttaaacatttccgtaaggcaggctagaaatgtaatacttcaaatgtttgatgattatggtcttttgataggaatagattctgcttgggatatatatccaggcactctctaaggtctagggttgatattaacaaaggaatgtacttag

SEQ ID NO: 109690 - DNA, 1040 bp, Homo sapiens
ttacaggtgcctgctaccacgcccagctaatttttttgtatttttagtagagacagggttttgctatgttggccaggctggttttgaactcctgacctcaagtgatctgcctgcctcggcctcccaaagtgctaggattacaggcgagagtcactgctcccagcctactctttgttccttgttttttttttttttgagacggagttttgcttttcttgcccagactggagtggagtggtgtgatcttggctcagtgcaacctccgccttccggtttcaagcgattctctagtctcagcctcccgagtagctgggattacaggtgcccgccactatgcccagctaatttttgtgtttttagtagcgatggggtttcaccatgttggccaggctggtcttgaactccttaccttgtgatctgcccgactcaacctcccaaagtgctgggattacaggtgtgagccaccccgcctggctctttgttgcttttaaaaattggggcagcacttgcctcaatttttgtctttcctaatcactcatgatttctcaattataaagaatggtttcgagatgtcatctatcaataaaaggacttttaagttacttaggatgtaatttttcttgtgctggagaagtaaattcactcataaaaactaaacactttcttaactgctatggttccttgaaagagatcatagttctctgtcatgtgataagtgtagttctctgtcatgtgataagtgtagttctctgttgtgtggtaagcgtagttctctgttgtgtgataagtgtagttctctgtcgtgtgataagtgtagttctctgtcgtgtggtaagtgtagctctttcttatgcggcattattgccttctctacccttctctggtccatgcccagttaaaaagtcatttatattgtctttggcaaactttaagaaattcttggtttcttattaattttaagttttagatcagtatttttaatgatctctttgtggtcaggatcagtcagtaaataatttagagcataaggttacttagga

SEQ ID NO: 109691 - DNA, 1535 bp, Homo sapiens
gatctggaaggtgttacaaagaatgtagaaggaaaatgaaagcaaaaaacgattagaaggaaaaaaattgaattgatttgtttgtggaatctataagaaatagggtatttctaccataaggctctatgaggaaagtaaggcttggtacttagagcttttcaaactcttcgaaagttgaatgttttgcacatacagaaaaagcttaatattaatttgagatgattcagttggaggtggtaggaggttcacctgtttactcctgtactgtgtatataacaagaagcaagttttcagaaggaatgtttcctcataagcaagagaccatacttttagttaatttagatagtagacgcgattaattactgtgtcagtagtgtctaatacagtttaaaatgattgttatgctgattactatacattcttatttatccactgaagctgacttctactagtgaaagtgttgatagtctagtgaattatgtaattaaaacgaatagcctgtttcttttaaaagtaattatttagaacatttaatcactctagacctcttcttcccgcagctaacccccatgcgtgtttatatttatgtaatataaaaagactgaattcgaactatttgatttttaaaaaagtagttctaggaaataaatgtaagccctcatgggaataagtaagttattaatttatagtgaaacagttaatcttttataaacttaattttacgacgcagatgtgacagcatagaaaaactaaaggcccagatacccaagatggaacaagaattgaaagaaccaggacgatttaaggatttttaccagtttacttttaattttgcaaagaatccaggacaaaaaggattaggtaagaatttttaaaaattatatttggtgtttcagatatattcaaatacattgacagtgtcgtttttgtaatagaaagttatgtgttttgagcataaagtcatgaaaataccagttattgaaaagtaattagaaacaggaaatttttaatcagaaaataccatgcacattgagtaagtttaccctgggtactatatgtgaaccactgacttttgctttatgaaaactacagtcaatatagaagatagttgttaaaattccactgacagttatttatttatgcattcatccattcattcattttttcattcatgaccctgaagatattttaggatcttaggatctatagaaatagcactataagatttctgagtcatagaatgccagataaatttattcttttttgttatgatttatttgaaaactataaggatgaaaaatgaagtgcttatcattcatagtcttattatccagaaataaccactgtaaaagtttagatcaatccatttgtatttgtacatttgcttttgggatagttaaggggatatgagagtaaaagatacagtgtaatttgcaaattacctaaaaagattagatagtgctagtaggtaattacaaaataataaaagtatgtaagggttttagagggagaaatgagtaaaagcaggagtggtt

SEQ ID NO: 109692 - DNA, 1667 bp, Homo sapiens
actgcactccagcctgggtgacagagtgagactccgtctcaaaaaaaaaaaaaaaaaaaaaaagaaaggtgttagtaaatcatatttgatagcagtctatgagtgcctctttctctttgtttttgttatttaaaatttttgcctctctgataagtatagatttttttctttaaacaagagatatttacattgttgagattagggttgaattgcatagtttaggtcacagtttttctgatactcttaagaagtaattgttgtggtaaaatgaactttgttctaagaaaaaaagaatttctgttcagaatgcctacctaagcaaaatatggatatcttgaattagaatcccatgtccctatatacgaatgtctgattttctgaatgtgtataagtatgggacatatttcacatgaataaatgagactttaaaaaatcatgtctcatctgcatatatctctacactttaagaatgctgttagtaaggagaatggctttaaataatgggaaagtgtatgttagagtaatatcgtttcatgccttccatatattgtggtcatttaaaaaatggcatataaagcattacctttttcagttttcataatgtagcataatatgacactactttaatattgcattgttatttttaaagaccctcaagatgagaataaaattggaatagatggcatacagcagttctgtgatgacctggcactcgatccagccagcattagtgtgttgattattgcgtggaagttcagagcagcaacacagtgcgagttctccaaacaggagttcatggatggcatgacagaattagggtgagtatataattacaataggaaattagatatgttactgtggaactgaattatgtcatgaactttttagtgtaaatttaaagatttgctggcccacaaacattggtataaatagaaatgggttaacttgctagtttccatgttatacagttttttgggtttgtcaagttatttatatagttagtacagcctattctatttggctatattcttatcatttacttctaaggcaggttcattagtattaaaattatgcattaatatttactatggaaaagtgaaatgaccaagttttaaagttatttcctaatgtgagactttgaaccctgcatttataaaatcctagaatttaaaaactggaagatgccttagaagttactacttgtttcacttaacactttgacagctgattagctgaatgtctttggataaattgattgaaaagtcatgggtagaggttttacctgtgacctctagttgtccatatttaatgaggttgcagacagaagtaatcagtctgttggtaggtaacaagctgccctttctgttttttagtgggccactattgaatagtaatagctaacatttattgaacattattttatttcagttaactgtgctaagtacttctcctacctcttcacagcaactttttgagaatagttttctatccccattttagagatgaagaaattgaggtacagagaaattatagaattaggtagtattagagtcatgattcgagtctgagtgacattgcagtcagtcagcgtccagtcaagatacaaaaaccacaccaggggctaggcgcggtggctcatgcctgtagttccagcactttgggaggcc

SEQ ID NO: 109693 - DNA, 1040 bp, Homo sapiens
cagtaaacacctgttaatctcatggttccccaggggcatttgctgactgggcagatcatgtcatcttcttccctgcgtctgatcatgtcaccttcttccccgtgtctgcttgtgcatccatctcagagcactgtgcttggtcggggtttggagggtagcgcggcttcccttctgcagcctttctgtatgctctcaggacccactgtaggagaaacgctgggtggttgagcttccttcgcttctgtcctatttctcttccaaaactgtaccatattttctgtttcatattttttaaaagttagcctttctgatgaataatagatcaaaaataaatcttaagctaaaatgttttaatgttttgtgaggaaaaagtattactaagaatgtttagttagccatatagaaatatttagtcttatgtgattttacatagagtttcagtttattttctggtttcaatagaacaagttgaaatcatcgcagaaggataaagttcgtcagtttatgatcttcacacaatctagtgaaaaaacagcagtaagttgtctttctcaaaatgactggaagttagatgttgcaacagataattttttccaaaatcctgaactttatatacgagagagtgtaaaaggatcattggacaggaagaagttagaacagctgtacaatagatacaaaggtgagtgcttgcttgtgactttaagtaaattttggaccagattttccaaagagatgggcttatgagaaatgaaatactatatataacttaaattgggtggatgtgtccaatagaggtctgtagatcttagagttatttcaagaggtctgaggaaaaattattttcttttcactaaaatttcttcttggcctctttattttcctcccccattgtgcaagttgagaatggggatggggaactgttttttctgccctcatatgtataaaactcagctgaaccagtctaaggaaacctgcatactgaatctttaaagaattataaagtaatgcatacttttaaaaaagttcaactgcataatagg

SEQ ID NO: 109694 - DNA, 1068 bp, Homo sapiens
aaaattcatattaatgggtgatcaatgatgttaatgcctatgttttcaatggctttaaatatatatgaactttgaaatttaagattatgttgtcaacaaatactagaatttgtaaattcaaatacatgtaggtctattcaaggttgtcttttcataacttgttgcacattctttgcatgtctacaaataaaggaggttatcagttcttttcagtgattattatacgtctgctgtgtgctagagatagtgttaggcactgaagggatgtatatatcacagaagagacaaaaatcctcactctggtgaggggtaccttttagtagggagacataaataataaacatagtatatagttttcttctttactatgttagaaggtgttaagtgctgtgggagaaagcagtgttagggaaggggattgggggtgctagggcattgatggaagtagggttgctaaatatctgtatcaccaatgagataattttgaacagagtaggggatgagggaataagccatgcagaaatgtagaaatcttgaggaacagtgagaccaatgtggctggagcagtgtgtgtgtgtgtgtgtgtgtgtgtgtgtgtgtgtgtgtgtgtatgtatgtatatgtacatgtgtatatacagggggtcgttggagcagatgaggcctaggtggcaaggagtgggggtaggcatgggtggacactgtaaggatactgggcttttatcctagagaaatggaaatccattgaaggattctgagtggtacgatataccttgtttttttttgttccatagtgtcctgtgacagtattacagataattatttttaaaagcagttttttcagaagacccttattacagttttctttaccatgcagcttctatgtacagagttttgaattctgtttaagatgactgtctaatgttcaataaaaactaatggattatcaagtatacctagccacactagggttaataaaaacacaaccaaacctctttgatagattgttgaatatgttctagtggtttatatgtagttcagtgactatatgcagaaaactgggcctttg

SEQ ID NO: 109695 - DNA, 1506 bp, Homo sapiens
gtctggggttccgggtgagtagcctccccccgccccgaagccggggcttccctctccgcccggccggggagaaggaaagactttcccggcgcgcctctccctcctccgctcccggctccaataccccgcaagtctcccaggcagttttgcttggggcggggtatcagcccttttcctttctccatcacctctcgaggcgtcccatgcttttggagaaggagagtttccccggccagttggtggaggttatatttacctctctactgaaaacatgggagactgctgagcttgggggagggggtacggaagtgcaacctgttctcatttcataaaattagggaacacagactagcgagcgccctttcgagcacctattttatttgcttgggggtgggaggagtaattgctttattatagtagttaagggccatttgtgattttttttaaaacagtttgtcaagttactctccttttttgtttgggggggggaaaaagtcctctccaggcttgcagacccttgtggtcgagttgtttactttggtaattaagtacctgactctgctggacgctcttcgcgtttcagaagcgctgtttggcattgtacagtctgagcgtgagttgaattccgtgcaggttactgtatgaatagtaaaaatgatattgttgtcctttgctcgtggggaacataaaggcctctttgaggagggtgtgtgtgcgcgcctgtgttaagggaatgctccagtgtctttgtttttagttggtcttatttttgctgaatgacacttctagtcccatcctccagcttggcagtattttgttgtcatgtatggatatatggtttagtctgacacatatttaacacttatgttctgtggcaagttgtgtaggaatttacagtttgaattggtaagaaaactttaaagtgcaggttaatgtatagattagtattacagtgttcagagatccaccaggcagtctaaacagtttctagtttcttaagtatttagatggtcatagacattactcctgaagtttccagactcttagcatttagataagtatagtaagctcgaagtaatgacgttaattccctgggaaacactcagccacagctgaaatgtgtgctcttcaggatggtctccagatccgcatcatcccctagacagtggggtcccggaaatactcatcacctgttcaggaattcaggcatcaagtggttcgtagggagagttcagcttgtaagcttctattcttttggttaatattaaaattagctagttttgaaacttagccataacccatgtaattctaccagtggtgacaagatattaatttaaaacatatcctgtggctgaactcagtttatgtcatgagaattgtcgtgatattctctggtttagctaactcaccgtaggggctgggcacggtggctcatgcctgtaatcccagcaccctgggtcaccgaagcaggaggattgcttgagagcctaggagtttgagaccagc

SEQ ID NO: 109696 - DNA, 1635 bp, Homo sapiens
agtctgcctacttgggtatgagggttataattcatattaatgcctctggtttgagattatttcttgtccctgttagctggtaaagtagattgccaatttgttctaatctgctcatggaactacattcacaattttaaaatgtgttttcgtgaatctttaaacaaaactgttttcaatctaacctttatgtcctaagagttccacaaacattcaaatggctgttttagtaggttacaaagcatagtaaaatgtcatatttaacttaggatagatgagaaccaatgtgtaaatattgcagtgtgacctatttcaccttagtgtacgtaatatatttgaaaagaatagccatgtgacttctacactagcattgtgggaattgaaatgaagactagagagagaagatgtaaatggattttttacctcagggaaattttaaaacaggttccatgtccttttatcagcttccttgaaacattgtgaactttgttctttggcatatggtctctgagagtgagaaaattatggccaatctccagctaatttatgttcttaaatcataactgaaacccatgattgggcctacgtgttgataagataaaagaatatcatctaattatgtgattctggcatttttttggtgactgactttggcacaggaaaactaaatttgacttcaaatactcagaaataagtttatattacaaacatgtaatatatgcaaatgaattttaataattttgcataacttggtttgtatttttgtttcatatttttaatgctatctttatatgtttacgtgaacctttatctatagcattatggtgctatggataagttatataacttttttttcccttttaattatcttcctgtcatttctatgtaaagtatcttggttaggaataggggaaaagttccatgactttttaaaaaatatatgttatatatgtttaagacacattttatgttttaaaactaccaatagtgaagaattgattctgatcttattaattctgtagtgttgttcatttattttaaaaatcttatttttcatttttttcagattgaagataaaactttccaagtccttggtaatctttacagcgagggagactgcacttacctgaaatgttctgttaatggagttgctagtaaagcgaagctgattatcctggaaaacactatttacctattttccaaggtaatgtctcttctttataatatccctcctggggcatgggagaaaactgtttgaccagagacattccactgaaagagattagaaagatccagcttcctgtgaccactgctgtgacctttttccctcagtttcccccaccattctgtgtttctttgccaaattcctgccctctgtagtttcccattcacttctctcgttcacacagatgctcattgatagacacatacccattttcttcctgaattctgaaacaaatccttccattttctttgtcagagcatatctccctgctcagtgggtggtggtatctcagggctttgatgtctgaacacttttccccacccaccatccccctgacaactggaatcctggtgattttggaggaggtgaccactgagagaggagtctgtggaccagttgttccttgtggggaa

SEQ ID NO: 109697 - DNA, 1073 bp, Homo sapiens
aactcctgacttcgtgatccccactcctctgcctcccaaagtgctgggattacaggcatgagccgccgcacctggcctgcatttttaaaattataatactgcagcctttttgttgagggaaaaatacgtaaaatattcgacaaccttaaaatatctaaaactcaagcctggatgtggtgactcatgtctgtaattctagcactttgggaggcccaggcagatggatcacttgagtccaggagttcaagaccagcctgggcaatatggtgaaacctcatctctacaaaaaaatcaaaaaattagccgggcgtggtggcacgcctgtagtcccagctacttgggaggctgaggtgaggggatcacctgaccccaggaggttaaggctgcagtgagctgtgattgcaccactgcagtccagccagggtgacagagtgataccctgtcttaaaaaataaatcaaaataaaaataaaacccctgaaattccattttaaaaaagaaaagtttgaaattcatctttattggtactagcttgacagatgcttttctaacaaaatactttatttccaagaagttcaaagttgttgattttcctttgaatagttggttgtctttaggttgagagtgagattctttatatctcggttattaaataaatgaatgtcttctaatttttcttcattttttccctttttccataaagatgtagccatagctgtaacgtataaccatgatgggtcttatagcatgcaggtaagccttactggttttgttctacagtgcagagctgaatctgaccgcttttatactgaatagggtctttcactctctggtttcccttaagcctttgactattatgactgtagttaagagaatatcttatgcttgtatttcagacccaatttggggaaattaccccctatacagtttctaactgattgtttactcagttgggctgtgattcctttaagaataaaaacttggcaaaaagtaaaagctcaaatcagacattcacaagcccctaaagtgtgtgcctgtatttacagcaaaagcagcagttttcacattttttgt

SEQ ID NO: 109698 - DNA, 1042 bp, Homo sapiens
acctcctcagattcagccaggcctgaggcagtggggcctgaggcagggtagagcagtaggaatggaaggaagagatgcataggatagggaagaatttggcagctttgtagtaactgtccctatttataaaataaaaatttttaaaaaggaaaaaaaaataagatgccagaagcatttatgagtctaaagcagaagaacttctagtgacctcagtgagaatgaccaactgttttaagtattcagggtttgcaagctattctctgctactagaggccatgtttcacagaacccagcagtggaaactgttgcatgtgaaaagcgaaggagtacgaggcatggatgttgcatgtggaaaacaaaggaggatgaggcaaggatgacaggtttcaagcctggatgacaaggagcatagggatgccagtcagggagctcacaggtctggagaagaaggtagagggagatgatttgtcggccccgccatgttcgtcttaagtcaccagtggagcatccagctggtaatgacaataatcggaggtcacctggagaaggaatgtcggggctggaaacagatttgagctggcagcatcaaaatgatcattgaagtatcagaagcagacaaattgattttgacctgtatattctaccccacaaaactttaggttttcgtctcctcggataatcaaccatttccatactcatgtaatctaggcatactctggagttattacaggtttggttccagaccactacaataaagtgagtcaaagtttttggtttcctcatgcatataaaagttatgtttatattatactttattgtgtgccaataacattatgtctaaataaaaacaatgtatataccttaattaagaaatgctttatggctaaaaaaaaatgctaatgattatctaagcctccagtgagatgtaatcttgttgctggcatagggtcttgcctcaatgttgatggctgtgattgatttatagtggcaattgctgaagattggggtgactgtagcagttttcataaaatgagataccaag

SEQ ID NO: 109699 - DNA, 1072 bp, Homo sapiens
attcaatacctgtttacagatattgttacttgttgccctagaatgtaagcagagactgtgaaggcagggacatcatatgttttgttcctcactatgtccccagtgcctggatcagagcctggcacttaagagatgctcaggaaatggctgttaaatgaatgaaggaatggatgagtgaatgaatgaacccaaagctcagatagctggttttacttttgatcccatttattggtgtatttgggttaattttataccttttaaaatttttgtatcggtatataaaatttggattttattgttggaaagaagctcttttgagggcatttaatcctatcctctccccagtatagcaatccagcttgctgtttgcagtcttcctattctgtggaagtgttctgagcagcaagtcttcgataccttgcaaatgaatttcatttatgtttcttaacatttattatgttcctaacctgagtcaagtaagtgcctcggtatttccagcatcctctttgtcatattaaaatgtaatttttagtgtcaagtccagatggatatagtaatagcggatggacatagtgatagtgagatggtttttttgtgttttttttcctgagaattgtcctgttgccacatggtaccttagtaggttttttatttttcctaagagttgttcacagtagaaaatacttagataaaaagagcagatggttttctgaacatattgttttccccactcagcaggaactgggggtttattctcttcctagattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatggtatggaaggcttttctctttcctctgcttgtcaagttttgcaaatcatcattgaacatgcttttctttctgtatggcacactgacctctc

SEQ ID NO: 109700 - DNA, 1023 bp, Homo sapiens
aatagatattaacataaggtttagttgccaaacaatctttcaatgggttaccagcaaaagggctttaaaaagaaattcctaggagcccacaatcagggaaaaaaaagttttctttttctccatggggttagggtgagatgggatgtcatggtatgaggctcccaggatcttggtgctctgaggcagtaacatgtggtccacccttgttctcactgttacaagctgaaacggattcataatttgggcttaccatttgctcacaaccccaaatatacttttccgttgccaaatttcatgcagctctctatttttgactaagattcatatgctgctgcaaatgcgagatgttttcttcatgaaatgcaaagtgttaccattgaatgaagacagcggtaaaacttgatgtgatgcatcatggaagattttggtttgctactgattatacactattgaatatgaccattgttttttaccttttagggactgtggagtttattatggactcaaaacataatttctgtttcatggagatgaatacaaggctgcaagtggaacatcctgttactgagatgatcacaggaactgacttggtggagtggcagcttagagtgagaatattttttctattaaaaatcagccttggctgggtgcggtggctcaagcctgtagtcccagcactttggcaggccaaggcaggtggatcacctgaggtcaggagttcgagaccagcctggccaatgtggtgaaaccctgtctctaccaaaaatacaaaaattagccgggcgtggtgccgggtgcctgtagtccccggtactcaggaggctgaggcaggagaatcactgagcctgggaggcagaggttgcagtaagccgagatcgcgccactgcattccagcctgggtactccatcttaaaaaaaaaaaaaaaaagatcagtcttgatgggagggatgtgagggctgaaaaactacctaaatggtaccgtgttcactgtttgagtgatgggttcatcagaagcccaaatc

SEQ ID NO: 109701 - DNA, 1029 bp, Homo sapiens
aggtcaaaatatcagatcttacttaaaggaagtaaaaatggagaaatcctggtgattgtgcctaacagtttagcttaacgaatgtgatatttatcacccctaacaaatatattaacatacatgtttgcttttatataggcatgtagaagtccaggtgtttggtgatcaccatggcaatgctgtgtacttgtttgaaagagactgtagtgtgcagaggcgacatcagaagatcattgaggaggccccagcggtaaggaccttggaaagaaatttgtaagcttctccgtaatgtgaatcttactctgattttcacatcagaaatctgtgaatctggtgtctctcacccctcaaactcctgctggacaactgttgcctaatagcagtgtagtgaaaagacctcctgtggtattggggatgaggaggagattgatgttctgggggtagacacaacagggtcatgttccttctggataaaatatgggaaaatctactctgattcacctatctgatttacagcgaaaagctgtctagtgaggtttcaacgcacattttaaattgtaatgaatggccaggcgcggtggctcacgcctgtagtcccagccctttgggaggccgaggtgggtggatcacctgaggttgggagttcaagaccagcctgacccacatggagaaacccccatctctactaaaaatacaaaattagccgggcttggtggcgcatgcctataatcccagctacttgggtaggctgaggcaggagaattgcttgaacctgggaggcggaggttgcagtgagccgagatcacgccattgcactccagcctgggcaacaagagcaaaactcttgtctcaaacaaaaaaacagaaaattataatgaactagaattaattactggaatggaatgatctgattaattgaatctattttttgtggaaaagccttttttaattaccatttcagatgttctcaaaatatgtgagagattttcctgccttactggttatattatagagaagagagagtctctc

SEQ ID NO: 109702 - DNA, 1032 bp, Homo sapiens
agtttcttcatctttaaaattgagataacaatgatagtatctatttcattaggattattgtgaaaatttaagtcgatgttgagtctttagcacaggacctgaggcacagaaagtgcttattaaagattagttagtattggccgggtgtggtggctcacacctgtaatcccagcacttcgggaggccaaggcaggtggatcacctgaggtcaggagttcgagaccagcctggccaatgtggtgaaaccccgtctctactaaaaatacaaaaattagccaggcgtggtggcaggcacctgtaatttcagctactcaggaggctgaagcagtagaattgcttgaccctgggaggtagaggttgtagtgagccgagatcacaccattgcactccaacctgggggacgagagcaaaacactgtctcaaaaataaataaataagtaaataaataaatacataaaagagtagttattaatgatgataatttaacactattataatttgatccttggcataacaaagcatcttttaattttattttatgttgctttgtattttaagtttaaaaagctgagtaatttatgttaatgagtaccttgaatttaagagaaaagaagtgcactgtctaatattagttaaagtggtcattttgggctcagttatgctagttttaccaaaaaccttgaacttatcagtcgagtccttatcagccagttaagatcgtattctcattctcattctttgctctccagtaacatttctgtgtgattttcatggtgttttaaacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggtatgtgttaaaaattggaagccacgtcttacgtttattcgtttactgtgtcagtattttcgttctttatgatgacagttgatatttgctagtgttatcagggttgaag

SEQ ID NO: 109703 - DNA, 1046 bp, Homo sapiens
acctgttttaagctcaggtggtttaaagattttcactttagcttatttattttttcatccctgagagcactagagaattgtgtatcctgctgtccatccgcatttggcttcttccccagggttcttctcccagaaggtgacgagagcgaagaaaccccacgggatgcaggaagaaacagtgacaggcaaccaagagggggaggatggagaaaacccttgccttagtcagagcaggccccaggggacgcagaaacaaaggccacacccccacgagcacgtggccagactgcccaatcgtcgctactgaagccgggctctggtctttgattggtgttcgtggagacgccctcacattcttggatcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggtgggtggaggggccatggctcagtgggcagaggcgggagcgaggggtgcacggacccgcgtgagcggtgggaggtgcggcggaacccagggtcggtgtggggaggacggtaggaaaaccccaggcactttcggaggggttctgccggcagtcacggcgtcgggaggaagacatccccaccagcccttccctttctccccgcttccgcacatccacgcttcagcgcgcctttggcttctgtttttccatttctgaggactgggcccgccatcctccaggctcccctcgccgtcgctgcagctcgtagccgtttacatcgggctttcgcagcaccccttaggtgggagcgttgttataatccggttccggggaagcccaaagggatcaacgacttcctcaacgaaacacagctagtaagaaatggggccgggatgccctcaaagccatttttcagttcagc

SEQ ID NO: 109704 - DNA, 1093 bp, Homo sapiens
ggccgtgacgccgagagtgcggggcgcgcggctgggagcctcgcgcccccgcccgggcccgcccccatcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtaaagtcactgggaagctggcctggggcggggtttccccctcttctcgtattttagaaacggacagcggcagtgcagccctagtttgctgtaagtttccttactttgttactgaggcccccagagctccacgcataagtggtgtgaccagaaaccttttaacaagacccgcctgagcctgcgttagagctcccgctcggaaagtaaaagaccatcctaatccgcggcgctgcggaaccggtgtcccgtgtgggaggaaccgcggcgttccctgggcgtagggcccgcgaggccagcacagtccgcctcttggcggagcgccctgggccggtggttccgcgcggagttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggccctcgcccggcgggtggcgccaggacttcaggtgggaacgcgcgcttgggccgggggcgcgtggctgg

SEQ ID NO: 109705 - DNA, 1001 bp, Homo sapiens
aaagtacatccatcagaattggatttgtgcgtctgtgcctttattttgggaaaccttgcctgttccctgtgggggatgggagaggaatgtgaaaagccgaagttgacccagaaaaggatgattgaaggtagttgtattaagtggtggcaccgaaatgattccaccctgaactttctgaaagggtgattagtgatcagcagcagacgttataactttctcaaaataaatttatggtagattttctatctggtcacaagtgaggaggtgaaagctgctttttggggccaactctttgcttttaaagcaagctaaacgcaataccagaaaggtttccattctgtacttaacctgcttgtccttctcactcttccttatcctcccgcacacgctctgagcattgactgagcactctgaggaggaggctgactcaggctgacccttcccggccctgcaaggctctaaggtagaaccagtgttatcacaggaaaggcccaagccaaagctcagagcagctgttcctgagaaagtgggagatgaggatgagtaggaggtagagatgcttataactgctctgcccagagaaaactcagaaggtgcagaagagttttcaaaataaagtgcaggccccatcaagtaaaaaatgaaacattgtatttcattaaaatggtgatcagttttctcttttcataaaagacattcaaatggtgagattgtaaaaaaaaaaaaaaagaaaaagaaaactttctaattctcaaaaatagaacagcttgaataataactcatgggttttgaaatgggtcatcttttaaaatgggtcactttggctagaatcattgcacttggtgactttcacattgtaaagggtccagttctttctgaggcccaattgcactagaatctgcatttcagaacacaggaggtatcaggaagaaactgggagaaattcagagggaaattgtctcttctcagagtaacaaaatgtcccctattcagggggaatt

SEQ ID NO: 109706 - DNA, 1117 bp, Homo sapiens
ctctgtatggggtataagaaggtgctggggcaatacagatgagatgagaagcatctttcagggaatgggttgatcccaattcaggcttcccagagaaggatgtctgtagacttcatattagcaagggaggaaggtagccaggccacaggactgctggtgtaaagaccagggcatatgaaatggcaagtgtgactgtgctttcagccaataatttggtattgtcaaatgatgggaccaaacagctggagaggcagatcctaaagggtcctgtgggccaggctggacttcatcttgtcactaactaatggagaggctctgaaggagttaaaagagctcagtttgtctcgtggttaaatccaagttttacaaaggtcacgctgactgtaaagtggaaggtgggctggccaggggatcatctagtctgggtgagaagtgatgataacatgaaggggtgaagagagatttagaagaagtgattcacaggattaaacatttaaataatggaagtggagaaaatggggggggcggttccagatttcaggcatagatgaaagaagtgcagttaggcacatgtaaagagaaacaggaacagcaggttttaggggagaagataacagaatgggtgagaaatgacacttgagtaccctagtgtgctaggtaatcatctgtctacttcccttcatttgtcatgtatattcccatttaatttgcataaagacttcgagttaaacggtcttaccccaatttgtcaaatttctgcgcatgatatggtacaagaaaccgtaagtggctaaggcggcattggtgttcaaattgcctgactacaaaggcagtgcttgttggctacattctgttgcttcccagtttagaacatgttacattgaggcgcctgctgcatttccaaataaaaaagtacagaaagaaggtggctgtataaatctggggctcacaaagtaattttgattactgagagtttgctttcaaggagcaaactgtgactccttgattatgaaccttaatttaaaaaaaaagaaaaaagaagtcttactcttattcctgccttgtctggggcaagccttaatggatttttactgctgtgaattttcttttcattgaa

SEQ ID NO: 109707 - DNA, 3888 bp, Homo sapiens
agacagtgtaaagcaattttttcccttttcctgtcctcctttaaaaaaaataaacagccgtatgcctctgctaagtactaactacctcatcaccttttgtgcagacagggcaggttacatttggttttaaggaattaggaatatgtttctttccagcaccttagtaacccacgcgattgtgattcttttctcttcttgactgtgataggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagct

SEQ ID NO: 109708 - DNA, 2105 bp, Homo sapiens
catcagactttgtaccctctctcttccatcccttacccttaccgattaggttggtattacctaaaaatccatagaaaatgtccaggtgaattgccttatgctttctaccccataaggtataattctagaccagatcggttatgagaggctctattccagtctgcacctgctaagaatttgaatctattttagtaccaatcttggagttcttgtttggctctactcttagccaaccccacagagtctaaaattggatctgaatccagtatttgccagccagtgacagacataaactaggttctttataaatgtttcatgaattgacctgcatccctgcattgattcaggatcttattgtccattgggaaggaagatttacttagctaggagtaacaattcccaaatttgccctagttgcaatatttttttaccaagggtacatacaagtcaggttcacttctgaaagtaaggaaacacaggatagcattcacttgatgatcataacacagtctgggtatacatatgtgtttgtgtgtatacatttaaaaaaaaggtcgtttatatttggttttggaatcaacttttgaatttgtctaaacttgttaagaatttacaagttctatttaaagatatctgggccagaaaccagaaccacttgtgtttaaatactattgctattctgtacacagctcaaggttctggtattttctcttaagcattcctcttctccccttccaccaaaaaaaaaaaaaaaaaaaaaaaaaaggaattgtgccgaattagttggtttctatggggatatggggattaagtttctacaagattcaaggcagaagaaatatacatttatatattaaaagataaaaaaattatttgctaactcttagaattatttaatggccccaaacttggatgaaacatcaatttccagacactcttcaaatatccaaagtgtattcaaatatcacagagtgtatgttttttcagtgctaccattagcttgctattgacattaattttcttttactcatttttcactcaagaaattttactgcaggataaaactccaggataaaactgtcaagtgccgggcacggtggctcatgcctgtaatcccagcactttgggaggccgaggcgggcggatcacctgaggtcgggagtttgagaccagcctgactaacatggagaaaccctgtctctgctaaaaatacaaaattagctgggcatggcggcacatacgtgtaatcccaactactagggaggctgaggcaggagaatcgcttgaacctgggaggcggaggttgccgtgagccgagattgcgccattgcactccagtctgggcaataagagcaaaactcagtctcaaaaaacaaacaaaaaaactgtcaagtaaggaagttgataaataagaaaaactagttatgtaaaatagcattaagttattaatttactttaaggagatgttattcactaattatttttaaacaaaaacgaacttcagttggaaactagaaattactaaaaactttgttcaacatattagtaaataatgccagctgtacatgaactgacaactatctgatttatatgttgctattctttctttattttaggtgtggaaattaaaagaacacacatattttgactggggctttgatcaaccaaatgctaaaaaggtatatttgtaatatttataaactatctaaatgttgttattagagaatttaaaccatattcctttctttaaccagggatcacttaagccaatcagataacaaggcacaactctatccttaagatcacaaaagatggcagtgtgacaatcatttctgttactaaatatttacccactcttctgtgctttcctgagagcctcattcatgtctgatcaacttatatacattaactcatgtagatataactttaagtcattatgtttgtttggaaagaagcttttcctacttattttgtctagagatgcctacttagttgtttactttttcctgatgggaataattctgctgtgatatttgcaaaaatgttataatggttcaatctgtaatcttacgttttgtttgcttgattatgcatcatgagttcat

SEQ ID NO: 109709 - DNA, 1863 bp, Homo sapiens
tccaaacttggtgacagagtgagaccctgtctcaaaataaaaaagattcttaaaaagaaagataactgttagaattctaactgtagtcaaattgtgtcttacaccattctgacttaactctacagtcaatagtatgaaactcagctctgtaaatggggaggaaacggaaggttattagtaactcacgaagtacatagtatcctttcagctagaaaaggggagcttaaggagtactattgcaaattaccccaatgttctaattgttcaaatgcaaatttttgttgattagtttttattaacatgagatagtgctgtgtaccctatatgaaatatattatgtgattttgttgtagtgtttatattaaaatgaaattatgtgatttgaatactgaattttttgcatattgaaatgttttcctttttttacttttagccacataaagaagatccctaatagtcatttctcaacaattatatagtcaactgatgtaacaatggtactaatattgggacgcagactaaacagagaggatcttggggtgcgtgattccccagcaactaagcgaaaagtttttgaaatggaccccaaatctctgacaggtcatgagttttttgacttctcttcaggatcatcccatgccgaaaacatactccagatatttaatgaatttcgtgatagccgcttattcacagatgttatcatttgtgtggaaggaaaagaatttccttgccatagagctgtgctctcagcctgtagcagctacttcagagctatgttttgtaatgaccacagggaaagccgagaaatgttggttgagatcaatggtattttagctgaagctatggaatgttttttgcagtatgtttatactggaaaggtgaagatcactacagagaatgtacagtatctctttgagacatcaagcctctttcagattagtgttctccgtgatgcatgtgccaagttcttggaggagcaacttgatccttgtaattgcttaggaatccagcgctttgctgatacccattcactcaaaacactcttcacaaaatgcaaaaattttgcgttacagacttttgaggatgtatcccagcacgaagaatttcttgagcttgacaaagatgaacttattgattatatttgtagtgatgaacttgttattggtaaagaggagatggtttttgaagccgtcatgcgttgggtctatcgtgccgttgatctgagaagaccactgttacacgagctcctgacacatgtgagactccctctgttgcatcccaactactttgttcaaacagttgaagtggaccaattgatccagaattctcctgagtgttatcagttgttgcatgaagcaagacggtaccacatacttgggaatgaaatgatgtccccaaggactaggccacgcaggtgagaagactgttttcaaatatagttaacaaaagtttttaatatatctttaaacctcctgaatgcaatctcagtgttgtcatttatatgcactgtctacctgtggctgtatataattttagatttattttggattatatgtcactagaatgtctttcctagtgaattctagattcaacagtagcattttttgttattgttgttttgtgctatcaaacagtgtagcaaagggtctttgcaactgtgcatatctcaacatatttctactaatttctcttaacctttgtagggccccaaaccattccacttttctttccaaagagtctttggatacagggtagctaagattttagtaggctctcttggactgcctctacttataaaaaaacaatttgctcctgggcacaggggctcacacctataatcccagtactttgggaggccaaggt

SEQ ID NO: 109710 - DNA, 1015 bp, Homo sapiens
aaactaatttctgaacaagtacatatacatattcctttaaagggtgcttggattatactatgaattagttttttagaactagcaagctgatgaaagagcaccattttcctacagttagaaaaaaatgcattatcttaccttgtgtggttatgcgtatctgaatcactgcaaaactgcatttgaaagtcatccttaatattgccaggattctgattgggttagataggatctttggacttttttacaattttcaggtcaaaaccaatagaaaaaaatagcaacagaaattttctgtggaataatgatgtcactagctcccctataaacgttctcaaagtaagtaatttccaggctgtaccgtttggcacatgcacagagaagaaacttaactgtttataatagtgcgtggtttgtttttagagttttaagaaaaaatctggagtatattttaatgtaatattattatattatttatgtacgctaataattattattttaggtccactggctattctgaggtgatagttgtcgttggaggatgtgagcgagttggaggatttaatcttccatacactgagtgctacgatcctgtaacaggagaatggaagtctttggctaagcttccagaatttaccaaatcagagtatgcagtctgtgctctaaggaatgacattcttgtttcaggtaaatatagaattattacagtagctacttttaatttggacacagcttcattattttaaacatcaacagtgtcttaaaatagtgaaatgtgaatactcccacttgaggaagatcagtttacaacaaataaaaccaagaatgactttttgctcttaaaaacaggtacaaggccaggcgcggtggctcacgcctgtaatcccagcactttgggaggccgaggcaagcagatcaccgggtcaggagatcgagaccatcctggccaacatggtgaaaccccatctctactaaaaaatacaaaaattagccaggtgtggtagtgggcaactgtagt

SEQ ID NO: 109711 - DNA, 1058 bp, Homo sapiens
gccgagatcgcgccactgcactccagcctggtgacaaagcaagactccgcctcaaaaacaaaaaacaaacaaaaagcaacaacaaaaaaaacacaggtacaagatgacatggaatgatttacaaaagatccaccagaagatacctttaatcatgtcatattttaaatgctctcaaatgcatgtagaatatgctgtaattttttaaactttacctctttgcaagtcagaagtactcatagaattaagcatttctaattcacccatgttttctgaaattctccgcaaagtttatgaaataagatttgctttaaaattcttaacttgaacttctttatgattgtgatatgttacctttaaaattagaaaataaaatgacagacttgtacaaagtataactatagtatctatgatgggaagtctgttaattggtaaaataatttcaccagctttgcagattattatatatattatccacactgagaaatataacaatacatactttattttttacaatagtatgctttttgaaaaatcggtcaattaaaaaaaaaacctttagaataataccattatttgcgtgcttctgatgtcttactcttaaattaacaatcttttatgtttgtaaaattcacatcctatatttaattattttggatctataattatcacttatcaagataacaattggtaaagtttaaattttctctgtagaactatttccattaaatttcaagaggtctttatttattgagctgaattctcaaattcttgaattagatgaatgaattccatgttttctttacctatgccttggtggcacagatctcttggtgacagctatatcatgataaattatcgtgtgtgcattgttttgcatttcaaggtggaagaatcaacagccgtgatgtctggatttataactcacagttaaatatttggatcagagttgcctctctcaataaaggcagatggcgtcacaaaatggctgtcctccttggtaaagtaagagaaaccactttttattactattgctggtacctttccaaagtaaataccac

SEQ ID NO: 109712 - DNA, 1298 bp, Homo sapiens
aagatactaatttgccctacctttctcttatttgtgaaaagaaaatgtacataaaagctctgtgaactttaaagttcattttgtgtcaagtacttttctaggtattgtacggactaaaagaaaggcctgaccagcactctcatagtctagtaattctttcctaatattttagtttcacagctctaatactttataataatcaaatatttcattacccataagtgtgaatatttaagctaaattgtaccattctcagtgtgagcagtattacccccaagggggcaaagattgtttcttagaagatgaaaaaaaatgtaccctttcttgtgtaaagaacagatatacatacattaaggtaaatagatacacaatttctctgtggtattacaattttattgagggaagactattaggaagaaaatacctaaaaaggctccgtggattgtgatggtggtaggggatgatgattttttaaaaggttcagaaactctgagctaaatatattgcaattatatttatttagcaagggcattttaaagagaagagatcccttaattctttagccaactacttcaaaattcagacttttgataattaagatttttccatgtattttacatataggtatatgttgtcggtggctatgatgggcaaaacagacttagcagcgtagaatgttatgattccttttcaaatcgatggactgaagttgctccccttaaggaagccgtgagttctcctgcagtgactagctgtgtaggcaaactgtttgtgattggtggaggacctgatgataatacttgttctgataaggtaagccatgcacttttaaagaaattaccaatattaagtacaagaagggaaatacagaaggcttatcaagtaggtagccaggtcacatagtgtgaggggtcttttaaaaattttctggtactatatgcttttggagaaaaacattgaattctgggttgctaaagtgagactctagtatatctaacaatttgctctaacaaatgtgatccaatctttttgaaatgagactatctgtgtagaagttttctactaaataaattgttctgagcctttgctgtcatctacaaaatctaaaaactatttatacaaaacacagttgagaagtgaattagcaaagggtaagacatagtaactaaatatgctgcttccaactgggtcattttctacatacttttgaagtatttttcagaaaaaaggaaaggaaacctccttagtgtaaatagaggatggctcaaagttgttccggttcagtaaacttctgggac

SEQ ID NO: 109713 - DNA, 2408 bp, Homo sapiens
ttgaccagactggtctcgaactcttgatctcaagtgatccacctgcctcggcctcccaaagtgctgggattacaggcatgagccaccatgcccagccaggttttgtttttgaagaatcactctcatccttgcaagaatatttgttttatatagtaactgtgttattgacagagaataataaaatttagcttagaatcccattgtgtgggaagttaactgtaagatgttatttgagacatttctatggcccagccaaggctcctaataacagtgttttgttaacttagttataaattttttcctcattcattcattcaatttttgggtaatcccatataatgaatattgttcctactccttggtcatgtaaccgccactttctataataaccttcctgtaataggagaagcaagccaggctctttaaagatgcttttgcttaactaccattaagttaaaacccttttatcagtccacatcctacctcccacatcttggccccaattactaacatataatcttttttttttttaacttttattttaagttcaggggcacaagtgcaggtttgttacataggtacactgtgtcatgggggtttgttgtacagattgtttcatcattcagttcttaagccctagtacccattaattttcctgatcctcttcctcccccaactctgcaccttctgaaaggcccgtgtgtgtgttgttcccctctatgtgtccctgtgttgtcatcatttggctcccacttataagtgagaacatgcagtatttggttttctgttcctgtgtaagtttgctaagggtaatggcctccagctccatccacgtccctacaaaggacatgatctcgttatttcttgtggctgctactgacatagcatctatcttgaaattcatttcattcatgcaaagttgtccagcgcttacacagaacacagagagcagagttgggccaaaggaccttagcttttatcatgtctcccttttttttgactgtgctaaagcattattttgcttttctgtttgttaccaaatcctttatcttcaatggttaattttttgtttatatatttggttaaacaggaaaactgtggtatgtctgtgtgtaatggtaaaatatatatcctgggcggaagacgggaaaatggagaagccacagacactattctctgttatgatcctgcaacaagtatcatcacaggggtagctgcaatgcccaggccagtgtcctatcatggctgtgtgactattcatagatacaatgagaaatgctttaaactctgaagacaggatacctcaccgaagaagccacactgatccaagatgggaggttttaaaaactctacagtgggaacttcacatatctcctttgtgccatatgcaaaaaatagtaaaaataataatttggtgcctttctcctcaaaatatcaatctttcaaactataataaagcctttcctataattgaaaaaaaaaacttttttgttaaaggtaatggtggttgttacttggcctttgaagagtgtacctttgtaagtatttgtaagaagtctatgtgaattaggaaatgtctgtctgcataccttttaggagcgtgtgaatggtgtcttcacttattatgtatgtttatctgtatgtatattccttattttgtcatatatgtagagaaaattgcatgacttgaggcatcatttaggttgaagaagttaatgcttaggatgcattctaggagaaaaaatcagttttaaaaacctttgttgttaacaaagtatatccagattggttaattttattgaagggtttttttctgtaattgataaaaatgtaatgacaacaattcaggcatcataaaatactgaactattgtgactttattcttagaattgctgtcttacattaaacatgtttttagggggaagttaggtaggagatagaaaaataagtgcccctacaagggggattaaaattacaagttaattcctaagagaaaaatggaatggcctttgaaggaaaaatgacccactatggctctcaaagtttttatgcatcatctcttcaatcctctaagaaagcctcttttcttaacttgataaagcagtggaaacccattttgcaatattgttttgtgaaaaacagggacagacagccaggtacagagactcacacctgtactcccaactactcagcaggctggggcaggaggattgcttgagcccaggagtctgaggctacagtgagctatgaacgcacacggcaccctagcctgggcaacaggttgcgacactgtctcaagagaaaagaaaaagaaaaatagggataggttttccttcctagcccagtagagtttgacctcattagtatggtgctttgggtgaggacctcttccttgattatcccacttt

SEQ ID NO: 109714 - DNA, 1748 bp, Homo sapiens
gtccatttcatgaatataggacttcacataaaaaaagactttctcaagacaactttatattctagtatttttctgttgtaaaaagtattaactatttacttttattttgttatacatttattttaatatccatgtgtttattatagtaaatttgaaatgaaatcctgaaaaacagaatttttttaaacacagacctcacaccaatattaattttttctctacataatttaaaactacataaattaagtacttaaaatttatattgaaggccaccaagaacttaggttgaatcttagaaaatttaaataactatttttaaagttacccaacttaatattttaattttttaatatttatcttcctttactaattcttgataaataatagcattagacttgataaaataaaaaagaattttagagtagaattaatatatcaaaaggggtatatcaaccaaattggtgtcagattgtattcattctctcatcacataaagatttttcttttgataggtgatgctcatatgaacctttggtttagaatctatatatgtacatgtgtatgtatgtagatagtatggttgtatacacacatatataccaaacaccatgaattttagcagtctgtgatgatcagcaaaaaagcacataaagtaaaaattagttgaccatgctaaattcaattctggaatttttttttatttgggcatttctagaactttttacatttgaaagtacatgatgagtattagtaacgatgacttatgtataatcagaatctttatgacaatttagttttacaaggtcagaagagatgagtttgctaaacccagctgtgatacctcagttggaaagggaattcaaaggtatgctttgtagaacagaaaagtatagtttttttttcatgaactttaatcattttctgtttttcctctatgtgagtcagctacaaaagtggtctaatttttacaacagtagaacttcctccttttctactgtaatcttcccactgactttactgcacaggtatgaaatactagtgtattggatcttcagtaacctttttatttcctagatgattgaaatataggtatttactccatttaaaccaggtgataagatgatgtaaatactcagggagggtattaacttgttacttttgctcgtttggggtgtaaagtgccatgactgaataatcttcaattcatgattctagagtaagtttaatttggaaaaaggggcttcacacatggtggtggttgaacattgattcttttatacttaaaaagatgaaaatgttttgtggactgatacattttatcttactgaatatgaattgtttatgtatctctactgtcaaatagcctttttgaaactcaggaaagacaaaggttcaattacaccacttttgtcaataagcaaaccaggtattttttttttctcctgttgtctggatatggcaatagattttttaaattgctgtgagaacccatatatgaaaagagaggagttgaattgtgtgtgccttttatgtcttgagatttatatgtggaaaagacgacatctacttcaaactgtatttttttcgtttttttttttttttggggaaggggggagaacggggtcttgctctgtcgcccaggctggagtgcagtggcgcgatctcagctgactgcaacctccacctcccgggttcaagggattctgcctcagcctcccgagtagctgagaccacaggtgcgtgccacc

SEQ ID NO: 109715 - DNA, 1075 bp, Homo sapiens
cattcataacttattttatatattgttccaaagaaaagaatttgttttaatggtttcaaaataactgcacctgaatttgtttatgtgccttaagttctctagtgctatttcaacttttttttcaatctaaatgaagcttaccttagataaggttcatatttgtttcctatagagtaaataaacttccccttcttaaattgtgtaataagcaccaacgtgtggttgcttggcagaatgagaatgttaagggagattgttggatgtttggagtttcattatattttttgtttttattttttgatacctaggtgctttttaaaatattcagacaaatatctatcttacattgattaaacccgtgtaaattcatttgcagtatctacatcgaatgtcaaaaaagtatacttatttttgttccatacttatgtacaattttttccctcttcaggctttttcatttacctttttgaaaaagcacttactctccccttccctatcacccctcccccaaggtttctttatttaaatttttattgagagttgttggagctctaagacaatacaaatttagagttgaacaaaagtataatctgctttacaactagtatagacctaaggtcatttgctttcaattagaggctccagagtcttcatagtggaaagaatgctttgtatttaattgttcttagttaagttgtagcacgtgaatacttacttacatgttttgtttaaatatacttcttgcatagtttaattttttaaaagttgtatctaataaaatgtcttttaaccattattacttgactatatggttgtattaaattttgtttacgaaaaatttgttgttctgttttattttaagtatatttaaggggttgtgcaaaaaagagatggggaaaatactggatatattaatatatgtgtgtatttactggtatgtccataaaataactggaaggataaataagaaactgaaaatattagtgtgtaagaggaaaggaaatggtggctgaaggacaagtaaaaatgaaactttactgcatacgtatatgtgtgtaattataaatacatataa

SEQ ID NO: 109716 - DNA, 1056 bp, Homo sapiens
gcaatcttacaggcctgacacatcatttttttttagtttgatgttggctagtattttcatctaagcattcagcagttacagagttgacccacgttttccattcccttttctcgctcacatgtaaaaaatgcggtataatattatatagaattcagcaatatcatttcccctttcttaatgagtagagggtattcagcgtagaaaaatttaaaaatacaagcaaagccagagaaaaatgcccgcagttttacgatctagagatactacccttggatgtatattcctgtttgtgtatactctttaaaagatagggcagatgatgccctgataaggagtttagtttttcccgggaagcctttgaaggttttgagaaggcgagtagcatgatccgactgctatgtagaggaagagggctggggaggaacctacgaggtcagttactgtgctctttgcagtagcttggactaggcccgtggcagggagatggggaagtataaacagatttttaaatgttttaaggtagaatgaacaagacttggattggtgagggaatggtgggaatctttgcttttttgatttttgttttgagcaactgagtaggtggtggtgctgtttactgagatgaagaatggaagagagaaatttgaggtgggaaaaacgaattctattttagatgtattaaattttagatgcatgttagttatgaagtcggtgtgttgaggcagttggatgtagagggctggaactcaaggaggagagaggctagagctagagataaaaatctgggagtggctgggcgcggtgctcacacctgaaatcccagcactttgagagaccgaggcgggtcgcttgagcccagatattctagaccagccttggctacaaggcaggaaggaccccgtctcttaaaaaaaaaaaaaattgggagtgatctgtacgtagatgatattcaaaggtatggtgctgtgtgagatcactgaggggaaagagtgtggagaagtgaaaagggcgcagacactcaaatacctctaggtctggtagaggaagaaggttggg

SEQ ID NO: 109717 - DNA, 1057 bp, Homo sapiens
cttcaggctctgtgtgtaagatatttatgaagcgtaaatgaatttcatgtttagatttgggttccttcccaaagatatcttactatgtatatgcaaatattccaaaatccaaaacagtatgaaatctgaaacagttctggtcccaggcatcttgggtaaggaatactcaacctgaataaaatatttctaagaaaaaagtcttcattcctcttcccagtcagtccctaacaccagcacctccaactatgattctcatttctttcactatagattaatttgtctcttctagaacttaagtgggataatttagcttgtactcttgtgtttgccttctttggcttgccataatgattttgaggttcatttctgttgttgcctgcatcaagagttcattgagtataccacgatttgttcgtccattcctctggtttggacttttgagacatttttgaaatgtcattggctaatggaaaatggattgtagagtcttattcagatatttaataaaggaacactggttgtcttgtttacaaaagagaatgtattttcttttaagactgtagaaaggacagggccaggaactatgaaatcattatcagcatcttaggaatgcctgtctgtatggaagcagatagaaaatgattgtactactccccttccccacctatttttttttttttttttttttttgagacgaagtctcactctgtcacccaggctggagtgcagtggcgcaatctcggatcactgcaacctctgcctcccgggttcaagcaattctcctgccctgagtagctgggataacagtgcatgccaccatgcccagctaattttttgtatttttggtagagacggggtttcaccgtgttgatgaggccggtctcgaactcctgacctcgtgatccacccgccttggcctcccaaagtgctgagattataggcgtgagcagccagcatgcccggcgtccccctccccaactttaaaccagatgggaagtcttgagtgagagccccaagttcagtggttctgatattcaaatgatgtgaggcacataga

SEQ ID NO: 109718 - DNA, 1536 bp, Homo sapiens
ggatttatgggattttttttttttttttgagatggagtctcgctctgtctcccaggctggagtgcagtggcgcgatctcagctcactgcaagctctgcctcctgggttcacgccattttcctgcctcaatctcccgagtagctgggactacaggtgcctgccaccatgcccgtcttttttttttgtatttttagtagagacgggttttcaccgtgttatccaggatggtctcaatctcctgacctcgtgatccgcccacctcggcctcccaaagtgctgggattacaggcgtgagccaccgtgcccggccgggattttttttttaatgggattgttttattcaaagacttgtgtatgtggggcttgtttaccgtattgcagacttgttaattagtttaatataagtctatagatttgtgtttattgtaataatgatcagtaatagtgatacctgctaagtaccagagaaaggatctgtataatcaattatttattgagcctttaactatgttgcttatattttctaatatgctgaatgcttagtgaattctaagacactgtgtgggctaaccatgttttcatcaaagtctggttcctttcctttccttatgagggctcttccatgaaagccaggctccttttgaaaagtctgaacaatgtgctactttgttcaaggatttttctcttgaaagggaaacccatgcttgttaacagatgattatgatttcttttttttttttggtggaaacttttaaacttaggcttttggccttaaaagaaatatgtatatgtgtgtatatacacatacccacagacttgcaagtaccagtattaatgtaatatttatttatttattttgtttgtacacatatatttgtaagtactggtatgcagtgttactacaacccaactatttaactgaataattaaaaattattaatttatcattgcttcacagtgaagaactgaatgtcatcatgtctggaatcaagcgaaccatcaaagaaaccgaccctgattacgaggatgtatctgtggcccttccaaataagcggcataaagcaattgagaattcaggtagaaatcctgccttaggaaattatttctttattgacatatgcctccgctagaaaacttacaggaactagaatgaaatgaatttccactgttatgtataatttgaaggggttcgtgagagagattagctaagggatctgtttaatagtaatacaccatgtgtgctgtaaaaagtggaagaagatctggcaggaacatgatcaagcagacagtgaaagcgagacaaactgtgagttttagcgatcactgtatgttaggtgtaatcataaagtctatgatatgtataaaggtgtgctataatcgtgagatggtcatagatggtacatggattaaggtttttaattttaataggtaacattttaatgtatatagaaaaaagaatgatctcatcaaacttgtagttccatagctacaaggataaagctaaaattatttttaaatgcttgttaattaaatgtg

SEQ ID NO: 109719 - DNA, 1049 bp, Homo sapiens
ctgacctcgtgatcttcccgcctcggcctcccaaagtgctgggattataggcgtgagccactgcgcccagcgggaaaccaaatcttgatttggttttacttgcccaaaagtgtcagaactgcgaattaaacctaagtgtttcttttttttttctgagacggagtctcgctttatcacccaggctggagtgcagtggcgcaatctcggctcattgccacctctgtctcccaggttcaagctattttcctgtctcagcctcccaagtagctgggattagaggcatgtgctaccacgcctggctaattttttgtatttttagtagagacgaggtttcaccctgttggccagactggtctcgaactcctgacttcatgatctgcctgcctcggcctctcaaagtgctgggattacaggcgtgagccaccgcgcccgacttaaacctgagtgtttctaattttacagcctggagattctgtgcacagcacagctcctggatgctgtttacgtaggtgtgaaagaaaccttctagctcggcaattccgtgatcttgctcaaggtctttcaactctgtcgtgtttattctctcgagagcagccgttcttcaacggtttcctctgtgagactttatattctaagatgctttagtactttagtagatggaggaaatttgacaaataaacagaattgaaaaacattgctctttgatcatgccagtttgtaatttgagctcccatctcaagctactctgaacttcttgaaaaatatttggctatagagtcattattggattagagcagcgatttttctcagccaggtgttgactgtgatacagaaaatttccaagttactttccacatacttagatgtcaagggtttgatttatttttgataaaaatatgtttgtatttatttttcagattataaattcatatgtgttcattttttgaaaattgttaaatacagaaaagtaaaaaagaatagaaaagttcattcgtgaggctgccacccccaaaatcagaactcttcactgtttggatttaccttacctt

SEQ ID NO: 109720 - DNA, 1084 bp, Homo sapiens
cccagcaagctgggactacaggtgtgggccaccatgtccagctgagtttaaaattttaggtgggatgattgtagttgtagttcactctttgagattactgtctcactaagcaggcattgtcttcttctatccaattgttaccacactatattagctgattttgctcccctctggaaatagctaaacatggtgatggggtcttgctatgttgcccaggctgatctctaactcctgacctcaagcagtcctcccgtttcagcctcctgaagtgctggcattacagtgtgagccagccactgcatccagccccagctatgttttagaaagaaagaaaaacaaaatgattaacttgcaaagactcattttgcttgtttaggtgatgtagttgttaaatattgcaggaattttaaccttgtttttaagtttaagtaggacttaattatttagttaggtttttgaaggacgaaaagaattcaggtttcttttttcttcttctctaggtatatacctccggataagagggaagaaaatgaccagtcaactcataagtggatggtatatgtccgagggtcccgtagagaacccagcattaatcattttgtcaagaaggtttggttcttccttcatcctagctataaaccaaatgaccttgtggaagttaggtaagcacgcttgaggtatttaacctaaattgaaatgcagacttatttttgaagtggaagaaaagtgatttaacttcaaaacatttcctggaaatgcagtagtaattgagaattggctcttagtcaaaatgtagttggaggccgggtggggtggctcacacctataatccaagcactttgggaggccaaggcaggcggatcatgaggtcaggagattgagaccatcctggctaacacggtgaaacccggtctccactaaagatacaaaaaattagctgggcgtggtggcgggcgcctgtagtcccagccactagggaggctgaggcaggagaatggcgtgaaccagggaggcggagcttgcagtgagctgagatcgcgccactgcactccagcctgggcgacagagcgagactctgtctcaa

SEQ ID NO: 109721 - DNA, 1484 bp, Homo sapiens
accactcagaatcatcataatcccttttctttgtacagttgtttagatacttgaaagcagttattgggtctcatccatatttgtttcagttgtcacttgtgtgactttgttttatgttcctttgccattcaggttgtattctttggtatactccagtttatctatattccttttaaaataacctttttagaactgaacctaaaactccaggtatggtgtaaccaatataaagtaggtgaggactattaacgtatgtcctaggtttaattataactcttagttctttgcaggactcttaagatgtttgttgtgttaggtatctaaagtaatttaacgaataagggaggatttttgcggctgccttcaaacttggggttaatcttatttctggatcaaagcacaaatgtttttcttacacaccctgaatctcttcatcacagcacattacctgacaaagaggtgggtggatgctgctcttgttgaagcactttcttccacgtttgttcagttgtcaggacgacccttagccaacttcctaaaagccgtgattgtgaactttgctttttttttttaggtacaagatagtggtgactagatatgtgctaggctcagggcgtgataaagggactgtgaagatgagcacggggccttggctttgggaaaccaaaaaggtcttcctgcccttggtgtgtgtgaaactggagcgggccagctcgccagaggaatcctagtgagcctcttccaaaccttcgtatctgttttatttcactcaaatgtagaactctctagagcagcattgtccaatagaaatatactgtgagccacatctgtaatttgaaattttcgagtagccacattagagaagtaagtacccagaagaagtgatttgacattccatgccctgcacagtcggacaatgcccagtcatattactgtgcgtactggggagagtggtctgggaactgaggtctgtcaccttggggacatggactagcacacagtggctaaagcatggccctggagcctattgcttgagtttgaattctggttccgttgcttatttgctgtgtgaccttggcaagttagttgttcagcctcactgtgtctcagaggggctatttcatagagtggttgtaaggattaggtaagttaatagttctaaagggcttagaacactgattgggtcatagcaaacagtgaaacgtaggaatgcagtgtttgctgctactgctgttgtgaggaacagagatgttcattccgaaaagacttgagggaatgctttggttcttttaaagggctttcatgtggaggaagaatttactccttgtgattccaaatggcatatctagaattaacatgcaggaggtagaagaagtcattttgtaatagagctgttcagaaatgtaacacagggtctcatgcagtggtgagttcagggtcactcagagtgatgctaaaagaatgattggccatatgaataaatt

SEQ ID NO: 109722 - DNA, 1098 bp, Homo sapiens
agctcctttgcagctgatttcttccatccagggcactctagttttctttgctttcttttctctttggtttataaggtatttattaatttctctgctttctaggctcccctcatatctcagggatttttcctgtcctgggctccgttgttagctgctggctctgtgctcgttaattcacatctgttacactcttttcaggtcgtgttcttgaactctgcactcactcaattcagttttccaaaaacactgtctgttgagtttctttctccttgtcattttcttttttttttgagatggagtcttgctctgtctcaggctggagtgcagtggtgtgatctcagctcactgctgcctccgccccccgggttcaagcgattgtcgtggcctctcaaagtgctgggattacaggcatgagccaccgcacccagcctccttgtaattttgatatcttctctcattactaattctaagccagtattcataacaaatgttttcattttaaaagcattctctctcttccctatgcacttaaaccatattgttttgagtacttaatgatatatcaattaaatttctaaatttttttattatggaaaatttcagacatatatggaagtaaagaacataatgaaccctcatgtgcccatcaccagttattaacaatttgctcttttccatcaattcccgcccctccttttttcttccttcacaaattacattgtgctgagaattctccaatccagttagcatgcacacacattcctttctgcccactaaaatcagtcatagtcactattcagggaaggtcatattgtgaacatatgatctttctttaagtcttcttagcagagagtttcaaataaattgtctcagttgagcatgttcatgattcattttgtttctgcctcagtggaggaataaatacaagggtttagggtagggagcatacctcatggcctgtatctgtcaaatgccaattaaagatcctcgctctctagtgacattcatcagatcaacctagttccctcgtctgtgaaaatgacattggattatatggtctaagtttactctagctgttagcgttcaataattgaaagt

SEQ ID NO: 109723 - DNA, 1051 bp, Homo sapiens
aacttctcttgtggataaaacactgtcaaacagcattgaatgctacagagaaatctttcataaaaggaagtcagtcgaggcagcagaattcattgttgtcttgttttaagaaattgccgtagccacccaaaccttcaacaaacagccatcagcatcaaggcaagaccctccaccaacaaagagattacagttcactcaaggctcaaggtgatcattagcactttttagcaagaaagtatttttaaattaagttatgtagattattttgttaaacataatgctgttacatacttaatagatgacagcatagtataaacataatttttataagcactgggaaacagattcattgtgagttgctttattgcagtattcacttcattgcagtagtctagaattgaatctgcaattatctctgaggtatgtttgtataaaactgtatgtacatgaagtcaaccacgatctttgaaaggtagaaaaataaaacaaaagaaatataccaaaaagttggagcaactgaaataatgacattgtgaactatttctcatgccctgtttttggttggttttctcaaatatttttgcaattttatataaataaacgtttattttttatttttttgagacagagtctcactgttgcccaggctagagtgtggtggcgtgatcacggctcactgcatccttgacctcccccggctcaggtgatcctcttatctcagcgtcccaggtagctggaccacaagcgcatgccactacactcagttaatttttttattttttgtagagatggagttttttttccactgtgttgcccaggctggtctcaaactcctggactaaaacaatctaccctcctcagcctcccaaagtgctggcattagaggcgtgaaccaccttgcctggcccatattcaatttttataatggaaagaccatttcttagtgttcccttagaccctttttatagtattatagttttgtgtacattttctctacatgtgacataatcctgatactgtacatctccaaagcacccttactttgtggttt

SEQ ID NO: 109724 - DNA, 1055 bp, Homo sapiens
ctctgtcgcccagtctggagtgcggtggcgtgatctccactcactgcaagctccgcctcccgggttcacgccattctcctgcttcagcctcccaagtagctgggaccacaggcacccgccaccacgcccggctaattttttgtatttttagtagagatggggtttcaccgagttagaccaggatggtctcgatatcctgaccttgtgatccgcccatctcggcctcccaaagtgctgggattacaggcgtgagccatggcgcccggccggttcatatattttttaaaaattgtgcttaaaaaacacgtaacacaaaatttaccgtcttacccatttttcagtgtacagtctagtggcattaagtatattcacattattatgcagccatgaccttagtccatctttagaactgttttcgtcttgcagagctgaaactctgtacccattaaaaaatgaccacccactcctcccgcccccccagcactggcaactgctgctctactttctgtctgtgtgaatttgactactctagggtacctcatataagtggaatcataacatatgtgtctctttgggattgccttatttcgctttgcataatgtcctcagatttcatccatgttgtagcgtatgtcagaatttccttcctttgtaaaaaaatttatttttatttatttatttttgagaaagagtcttgctctctctcacccagcctggagtgcaatcacggctcactgcagctttgacctcctgggctcaagtaatctgtccttagcctgtcaggtagctgggactgtgggcgtgtgccaccatgaccagctaatttatttacttactcgtttatttatttatttattttttgagatggagtctcgctctgttgcccaggttggagtgcagtggctcgatctcggctcactgcaagctccacctcccgggttcacgccattctcctgcctcagcctcctgagtagctgggactacaggcacctgccaccacgcccggctaatttttttttttttgtatttttagtagagacggggtttcactgtgt

SEQ ID NO: 109725 - DNA, 1026 bp, Homo sapiens
aattcagtgtcatgaagcttttcccttacattttcttctaggagttttattgttttagcttttatgtttcgttctttgatcctgagttaattttggtatatagtgtaaggtaagggtccgattgcattctttggcatatggatatccagtttccctggcaccatttgctgaaaatactgtcttttcccccactgaatggtcttgggacccttgtcaaagatcatttgaccatatatgtgaggatttattctgttccattggtctgtatgtctgtctttatgccagcagcatactgttgattactatggctttgtaataaattttgaaatcaggagtctgagacctccaactttgttcttcaccttctctccctttttttgtattcatcatataataatcagcaatagccatttaatcagagttcactaattaaatcttactctgtctagagaaatctgctgtattatatcagaaggtacttattgagcgctggtccaggtgctgggaatacagaaatgaacacggtagcttcttccttcagagtcaaattcttagtggcattgaaaatggggagggtagacagtaaacacaaaagcaaataaaattacttcagttacaaataagtgctgtgaagataagagtagctgggggataaggaagtagcttattcttgggtggttaggcatggtctctctgagaaggtgctacttcattgagacctgctggtgagaaaggcagccatgcaaagatttggaggaatagcgttgtaaggagtagcaacagcaaaatcaagaggtcccaattttgtgaataatttcactgagatttgtatgttaaaccagattagattttcactgaggtatgtgtctgttaagccagattagattaccttctagaataaatcctttagttcttcagattgaaattgcctttgaagtgtgattagaagttatctctcacatcccggagattacattcttggacgggacttgagctttctgtgacattgatgatggactcatgagc

SEQ ID NO: 109726 - DNA, 1061 bp, Homo sapiens
gtatgtggagttgactggatgttaaaattgttggaacaacaaaacaaaatacttggctttttttctcttaagttcttctaagcagtgttatgtttaacaaaaggaagtttatcactgttgattggcaaagctgtcacaaggcaaaaacaaagctcattcatacggaaatgaatggaggagataaatgaaactcaaatggtcaaatttttgtctgccagaatcagcacaggtaaaatgtttgctaggatatatggctgaaactaaggtgtaggaatcgtgtttggggattatatacatggaaaccacagtgactagtgatagaaaaaatttagaggcctttggcatggagttaaattttaagggttagagttggttgggaattgaaatgctttattctgtctgtaaccacactagaaaattattcattcctattgtcagtaggtagttctgagttgtcttgttcactaagattggattatcttttgccttgtgatagtttcattttatgttaggtaaaatttagtaggaatatatggttttgactgttccaccttagaacaaaacatgtttgttaaaaggcaattggaaataaccaggaagtatgaggacttctgtataatagttaaatgaaggggggaaaaaaagaatgtttggtgttgtaagtagacagctaagtagaaataggatccaaatctttgatgagagataaatagcttctaattggtaggcaattttttttttttgagatggagtttcactcttgtcacctacgctggagtgcaatggcgcgatctcagctcactgcagcctccacctctctcgggttcaagtgattctcctggctcagcctcccaagtagctgggactgcaggcacgtgtcaccactcccagctaattttgtatttttagtagagacggagtttcaccatattggccaggctggtcttgaactcctgacctcaggtgatccacctaccttggcctcccaaagtgctccggttacaggcgtgagccaccgtcccctgtcattggtaggcaattttacctaccaggtagaaaaa

SEQ ID NO: 109727 - DNA, 1027 bp, Homo sapiens
tatcggggaagaccaataaagtcagccaaatgttaggggtagtaagttagaagtctttccagtgtacagcaggacacagatgagtagattcttgccaagttacagcttttctttgcatttgttttctaaaacaatattaaaatgcaggtgtagaggcttggaagaccccaaggaattttaggtttttttctttcttttttttttacggagttttgctcttgtcacccaggctggagtgcagtggcgtgatctcggctcaccacaacctctgcctccctggttcaagtgattctactgcctcagcctcccaagtagctgggattacaggcacccgccaccacacccggctaattttgtatatttagtagagacagggtttctccgtgttggtcaggctggtcttgatctcccgacctcaggcgatccacccacctctgcctcccaaagtgctgggagtacaggcgtgagctaccgcacccagccagtctttttatttctttatattgctagagaatgtcacaggtttgtattaaatataagtgactagatatctgaaatcacccatttctcctgattgtaaaatatgtatttttacacacacagcaggaggattctttgtttgcatctatgccacctctttgcccaattgggagtcaccctaaggttcaaagccccaaacctataacaggaggacttggagctttcacaaaagtgagtatgtattagggcattgtcccacaagtcataatactttttgtggcatgttggagttcattgccactacccctacaacatgttactttttagtgggtctcaactcctcattctgagacgtgcttccatgtatttaatgatgtcctcagggcagcccttggagtccagcaagatggggattcatggagcacagtgtgtttgtttctctctgctgtcatttgccacagtctctaaaacaagtgactgtgttattacaggagcacaggatcaagttcagatcctacttttggtccctttaatagctggtatggac

SEQ ID NO: 109728 - DNA, 1142 bp, Homo sapiens
ctgaaaattatctggtgatacctgagggaagatccatctacttatagaagctggaagtctgtttttggggataggttggcataggattggaatcgagtgtgtctgtttgacttcatttagatcaggggtccccaacccctgggccgcacagcagaagttgagcatggacgaagaagcattactgcctgagctccgcctcctgtcagatcagcagtggcatcagattctcacaggagcgcgaaccctgttgagaactgtgcatgcgagggatctaggttgtgtgctccttatgagaatctaatgcctgatgatctgaggtggaacaatttcttccccaaaccaccccccgcctcctgtcccaattcatggaaaagttgtcttccatgaaactggtccctggtgccacaaagcttggggacagctggtttggatgtattccttacttctgctaggtttggagatggaaagagaaatacagactctacctaggtttgtaagtcttaaagccccatggaaatgaggcagtttatctgcagttaaagaaacttttgctttgacatatagagaaaaaccgtttgggcagtgttgaaaaggataggataaaaggaaattatttccctctgaatcagaagtagaagggtacagcattcagggtcattggaagttaaccgcccttgccaaaatgcagtgtgtcagctcatcatccttgcgttcattgaccatgatgtgtcagttccactctcacttggtgttttttcctcatacctaagcagtggtatgtccaaaagttaaatgtgtaagaaaaggacaatgtaaatatttcagaagtcatccagggagctacttagattcttgtgatatccttggtgcaaaaataaaccattgggaaggaagctattccaataatcactggaatgaaggtggagaaggaaattggaagttagtatttgttgagtgaatattcatagtccaggtagttcaaatgcattatctcaccaaaagagaagtaaaaagacttcaaggctttgaagtgggatttgaaaggcaaagaagaatggggtcctggagtcattgtaaatgaaggaaagtcttcatttttcctgagacagggagacaacatcgagcactgtaaagttacacta

SEQ ID NO: 109729 - DNA, 1018 bp, Homo sapiens
gttagatttgattaggaacaggtttcctcctcgtctcctcttgtcactgaagtcttggctctttttgaaggaaagtaatagaattttggttccagatgttcttattgagaaagatgatatcagtctgaatgattaaatccagttttgaggactaagttgcaaaacatgagttttcaacaggctgctctgtaactacagtgcaaagtttgagaagtggggataactaatggaagtaacacttagagcacaactattcttttgaattattttgcctacattgcagaattaaaggggagagcgttgtagcttgtaacatgggacgttacatgtgatttaagggatcagaacagcccatctgaatttaacaaattaccgattagttctttatatttttttctaacttagggcacatttttagttggccagccatcaccccagacttctggaaaacaactcaccactgggtcagtggtccaaggaacactgggagtcagcacatcttctgcacaaggacaacaaacgctaaaagtcatctctggacagaaaaccacattgtttacacaggtaaatacgcccatgcacacaccccaaatatggggtgattatggcatttatttacatatttacatgtagtttctctcttttcacaaagaaattaaggttacataagaaaatgaacaataaggccaggagtggtcgctcacgtctgtaatcccagcactttgggaagccaaggtgggtggattgcctgaggtcaggagttggagaccagcctggccaacatggccaacatagtgaaaccccgtctctactaaaaatacaaaaattagccaggtgcagtggtgcgtgcctatagtcccagctactcgggaggctaaggcaggagaatcgcttggacccgggaggcggaggttgcagtgagccgagatcgtgccattgcactccatcctgggcgacagagcaagattctgtctcaaaaaaaaaaaaaaaaagaaaaaaaaagaaaaaatgaacaata

SEQ ID NO: 109730 - DNA, 1413 bp, Homo sapiens
agtggtgtagatacaaggaaggtgtccagcaggcacaccagtggaccttttaaaaatactcaactattgcttttttttttaaagaaatattcacataccataaaagtccccattttgtagtatatagttcagtagtgcttgtcattcacatggttgtgcaactgtgattaccatcatctaatcccagagcattttatcatcccagaaagaagcccaatacccatcagcagtcactcccattccatccttctgttctaggcgaccgctgacctactttctttggatttgcctattttagacatttcatataaagggagtcatataacatgcccttttgggtctgcttctgatgcttagcattacagtgcagagttcatccacgttgtgacttgcatcaatactccttttcatggctggataatactcagtttgatggatgtaccatattttgtttatccattcatcagttgatgggcacttggattattttctactttttgactgttgtgaataatgctgcagtgaatatttgtgtacaggtttttgtataaacacgtttttatttctcttggctgtatacctagtgatggaattgctggattataaggtaactttttttgttgttttttgagatggagtcttgctgtgtcaccaggctggagtgcagtgacgagatctcggctcactggaacctccatctcccgggttcaagcgattcccctgcctcagcctcccaagtagctgggactacaggcacgcaccaccatgtccggctaattttttgtattttagtagagatggggtttcaccatgttggccagaatggtctcaatctcctgacctcgtgatccacctgcctcatctcccaaagtgctgggattacaggtgtgagccactgcgcccggcctgtgataactccttttaactttgtgaggaactgctaaactgttttcccaagtggctacattattttagattctcaccagcgatatacaagggttccagtttttccacaaactcacccaaacttgttcttgtcctttttttttaattatagctattgtagtgggtgtaaactagtatctcattgtggttttgatttgcgattccctgttaatgatattgagcatcttttcacgtatttattggctatttgtatatcttttatccatttacatcctttgcccattttttagttggttgtcttttaatcgttgaagtgtaggagtactttatatattctagatatgtctcttaccagatttgcaaaaattttcttgcactctgagctgtcttttcactttcttgatagtattgaaccacaaaagttttaaattttggttttcattcctttttaaattttttaaattaggctgggcgcagtggctcatgcctgtaatcccagcactttgg

SEQ ID NO: 109731 - DNA, 1012 bp, Homo sapiens
taatttttgtatttgttatatccctccctccttttttccctttagtggttcagtcattttctaccagcaagccacctgccattctgcctgtagctgccccaactccagttgtccccagctctgctccagcagctgttgcaaaaggtacgtaggatctcacagagttctcgtccagaagttttgttacttttttattgtcgttcacgttctctcctgatgtccagaagctttatgcgggacattaccataatctgaatcttttgaattttcagcatttgtgaatcagtcacttggcaaatatgtcctaaatgctcatatggtagacttaacattgagggaaacacagagatgtataaaggatcatttctgcccttcagtaatttataatcaggttgaaaacaattgctgtagatagcaagcaatcattgataaacacaagacatttggccagggaaatgattgctgaaatattgcagcttgggatgtctgatcagggttgacggggtgtggagaagggcaagactttgtactgagtatggattataacctggactttaaaagagtagaggttttttagctgtggggagtcaaggggtaggccagattaagggcacaggagagacagactcagcttcccctttggggaagtggctagccagttagagggactcatttggggagtatactcatggtaaaggaggtttaggtaggggccagactttggcgagctgtcagtgggagacatgcctgcccacaagagtagatcaggatagcacggtggattagagcaacacgtgtgacattgataacaccagtgtccaagcataggggatctgatttttgctttctgccttgtgtctcagaacactaagataatgctgaaagttgataaactagctggagagatgatattgaaacggtcccagtattagaacgtagaacaaaccagcattgtactttagagtagcattgttttttttttttttctttttttttttttgttttgagatgg

SEQ ID NO: 109732 - DNA, 1035 bp, Homo sapiens
tagagatacagcccatttgcaagggttttagaattcacatccagttagttttttattgttttcactgtgttgatctgtagaaggaatgttttacatttttcatatgtaaatcatagattgttttgtatgcagttaaaactctgtattagcatttggtgtttatgagtgaggaaagcatttagcgtttgcctgcagtgtaccaggtcctgtgcaggttgggtacgttcactgtctcatataatcccagcctcctgtgtgatagctggtgtcatctccacttacagatgaggaaactgaggataagcagggttgaataacttgctcgagatcacagagccacgggtggtgaaacaggatacaaacctggttctgtttgactctaagaccattcatctttcctctgaaactcagtattgcacagtgtagaaatgcagtttttaagacctcccaaagtgacgtgctgcgtcactgcccatcattagctagattgagtaaattgctgcttagccccagttgttttgacagaatcaatagcccttgctgaggggccagcagcctacggacacaggagcatgctcatgggcaagaccaccatgcacactcagaggggagccacaaggcaacctccacgccactcagatttgtagggctctgaacacatacaccaggtacagaccacctacttattttttccaactgtaatagcaaagcagtaatctctttctgtagggtaaagtttgggggatcattttgatgtctctcagagtaaacttttggtgacagtttcccagcctaacataagaaattcaaacaaaaaaatctctcttatatatgtgtgtgtgtgtgtgtgtgtgtatacatgtatatatatatacacgtgtatatacacacacacatatttttctctctccttaaaaatacagaatgtaagagctggaaggtagttcagaaaccatcttcccagctttctcagtttatagatgagaaaaccgagctgggcttggtggctcacgcctgtaatcccagcactttggg

SEQ ID NO: 109733 - DNA, 1041 bp, Homo sapiens
ccattgcactccatccagcctgggtgacaagaacaagactccattgtctcaaaaaaaaaaaaaaaaaaaagagtctgctctctcgcccaggttggagtgcagtggcacgatctcagctcactgcaacctccgcctcctgggttcaagtgagcacgtctggctaatttttgtatttttagtagagatagggtttcaccatgttgaccaggctggtctcaaactcctgacctcaagtgatccacctgccttggccttccaaagtgctgggattacagacatgagccaccatgcctggcttgctttttatttttaagaactttttctttacagaattattataaaaatgtttacagaaactttagcaagcataaaaaatgtgtttgaaaaactactcataattcctcctctgaaagataatcactgctaacatctctcagtgcctttctttcagtcttatatgcgtattatgtatgtgtgtgagagatgattgatagatagctatgagttgggaccacatggttgagacttgtctgtctcagttgcttcttgggtcacttgctgaacatgttaggcctgattatttagacctaagtgagtgggaaggagtttcagcataacccacatctcctcataaagaggccaggctgggtgcagtggcttacacctgcaatcccagtgctttgtggaggctgaggcaggaggattgcttgagcccaggagttcaggaccagcctgggcaaccatagggagaccctgtttctacaaaatgtacaaaaataaataaaaaatggccgggtgtgatagctcaacgcctgtaatcccagcactttgggaggctgagatgggaggatcatctgaggtcaggagttcgagaccagcccagccaacatgacgccccgtctctacaaaaattagctgggcatggtggtgggcgcctgtaatcccagctactcgggaggctgaggtgggagaatatcgcttgaacgtgggaggcagaggttgcagtgagccgagattgcaccactgcactccagcctgggt

SEQ ID NO: 109734 - DNA, 1034 bp, Homo sapiens
cccttcgtatagttaggaggaagatgacgggaggcatggaagctgggatagccatcctgagtcagtgctaattctgacacttcagaacatcgagtcagtctgacctgcgagtgagctttcattgaccacttagaaactattagcaccttggacaaactactttctttcagacctggttgcttcatgtctgcgatgggaaaactgatacttaacttgcagatagtggtgaatcaaaagtagtatatgtgaagtactcacacactgcggagcattcagccatcgtcccatcctacttctaccttttacatattgtaatatgaaagctaaaccatttctcgatgtgagtcagttttaatcggctacatagtgagtggcattcgattttaaaaatgtcaacttgggatctgtcaccatgctacttaccatttgtatgtcacactgtttgaatgtcggacctggtttgtttttctccagatggtatgttacttacggtcatgaactgatttggaagaacagggagccgctagtgaaaatctggcatgaaataaggactaatggccccaaaaaaggaggtggctctaagtaaaactgggattggacagtagtggtgcatctggtccttgccgcctgagagccccaggagacatcggctagagtgaccatggctatgctcccgtctggaagatgccagcatctggcctcccactgttttcagctgtgtcccccagtccgtgtctttttagaatgtgaatgatgataaagttgtgaaataaaggtttctatctagtttgtaagcagatgtgtgtgttctctctttaaggggccgacacggctctggcattttgctttggttgttgcattgacaggacctggggagagtgcaccctgaaaggcctgatcagaacatgaaggcgctggttgcctgtctttggaccctccagtgcctctgcttagccttcactcttccttgcctccccctcccctgggttggctgcacataaaagtcgagagtatcccctctccagcacaatctg

SEQ ID NO: 109735 - DNA, 1009 bp, Homo sapiens
ggaggttagatattctcatctgcagggagagtacagagaaataacaatccttttttgtggttagcaattacaagggcctttgcctccctcattgtgaatttgccctttctgtttacccgtattagtttcaaactttctgtctctatcccagtgggaggatggaagatggacagtctctctgggtttcttcttgattccaggtagctgtggacccagtccttaattagtttggtggatactgcctaggaaaagaaatgatagccactgtgtgaggccaacaggttgatctttgcacctgcctggttcccagagaacctgaggtaaggatggcttgagcctagttctttggctgctgtggatgtacttgcttgtcagtgtctggactggccaggtctgggttggtatagtagccccttcagataaaggagctttggaggggtgaattggcccacccagaaacagaggggatctgtgaatagctattagaccccaagtggtatggtaagtcctttataggaaaatgagaaaaagggttttactacctttcttgggctgaggaggaagataacctgaggtcattgaaccaagtagtgctttccaaatcagtgcatctgcctttttaaaaattaagatataattcacatataaaattcaccatttaaagcaggggttcccagccctgggcagggactggtaccagaaccgggctgcagagcaggaggtgagcggcaggggaacaagtgaaactttgtttgtggggttttttttgtttttttttttgtttgtttatttttttgagacagagtcttgctctgtcacccaggctagaatgtagtggtgtgatcttggctcactgcaatctctcccggattcaggtgattctcctgccttagcctcccaagtagctgggattacaggcacctgtcatcacgcctgggtaacttttgtatttttagtagagacagggttttgccatgttggccaggctgggatctaggttgtgtactcc

SEQ ID NO: 109736 - DNA, 1097 bp, Homo sapiens
acaaaaaattagcttaggcgtggtggtgcacgcctgttaatcccagctactagggaggctgaagcagaattgcttgaacctggaaggctgaggttgcagtgagctaagattgcgccactgcactccagcctggacgacagagcgagactctgtctcaaaaaaaaaaaaaaaaaaagtaacgaaattaagatttctttagggtggcaaggttttgccttcactattttcaaagcatttcactattagtttatacctcacattctttgaaggtggtcatgattttatgccatttaacatatgaagaagcctagcatcagagtttaaaaccttttctcatgctggtgaatactttcttcaaagaagctagaggtaattaaaaatcagaattctttccccctagtctttttcttttttgaaatcaaatcagccatttggcatgaagagcgtagcagtagagagagatgcttgtgatctgtcttgcaacttgaatgtaagctgctttgaacaacataaatgtgaatggtcatgctgcaggtcttaaatctttattgttagattatccaagtgactttaacctcaggaaatgccatttgaactgtcttgtgtcacctcagacttttcttgtaggaaataattattctagtaatagtgattctagctttacaatgtctgtaagtggtgcttaatcaattacctatatatgagagtctcaagaataaactgtttatttagtatgtcttgtcttcttcctggggtgccaattagtccagctttccttgctgagcactcctgattgcttcttgtagactgcaaagtgaagttggctcagcttctggttttaatcagtgatagatttatggggtgacaggtctactccgtcccactttctttctttggattggagatgttttccgaatgggtttttttttttttcgttttatattttgaaagaacttgacaagtttgacctagagagtttttaaagctttgtgagaccagtgtgcctctctgctttgtagtattcatacctagacaatggcagcatgaaagctctagtcggttaaagatttctcactgctacaccaaacacttcatgt

SEQ ID NO: 109737 - DNA, 1172 bp, Homo sapiens
catggtggggcagaggttgggaagatggcgtggcgaggctgggcgcagagaggctggggctgcggccaggcgtggggtgcgtcggtgggcggccgcagctgcgaggagctcactgcggtcctaaccccgccgcagctcctcggacgcaggtaatagccgccgcgctctggtcttctcgcctcttggtccctgagctctggccgtgtatcctcgggggcggaggccgtctgggcctcttgtgctggccccagctcacccccttcaccttacctgccccttctctctcctctctcgcctccgtccagtcctcgcttctcgctccccttgcccagcccagccccccgcgagcctgcgctttctcctttcccattgggaaggacgtgactggaaggggaactaagctgagggttcattgcgtgccacacttcataatcgcgagtggaaactgttgagccagtttctgaagtgaagaagttagtacagctggcagaatggcggtttttattctttttccatctaattataaaggttgtgttccattacaaccagtcgccttctttagcttgtgatctaagggaggacgaagtctgatggaaggtatcactttgtgtctggcaaagtcgtaggagaggctttattgttgaattgagacagtggaagatttcgtttccggttgatttggaaagaaaactgccgaaccttccgagtagaagtgtgaagcgtatggttgatcagtattgctgatttttgcatcacagtaattcatttctaatttgagagagaagagagaaattcctcacctgtttaagaatctgatgtgcatttggctttgaaaattttcctcctcttttgttcaaaacttcattccttccaatttctgacttggttagatgggtgcctcgaatccacctgattgctgataagaaacattgtttatcaacacgtgggatagtcagtggtaaataatcgaggctctaatgtggcggagccattgcctaatctcaaggatcacctgaagagtttgtatggattttatgtcccaggcctcaccccagtcctcccaaatcacaatcaggagaggggtgggtggagtggaagaacctatatgtccgacaagcattccaggtgaattttatcagggacttgtgaaaactttacatacattgtatctt

SEQ ID NO: 109738 - DNA, 1779 bp, Homo sapiens
cctgcatgacccagagctgtgtcctgacggcgtctccttcttttgcaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaactcttcgtgtatcaaacaattctctgggaagggagtgagatatccctgaatggctttgggacctgcatatccagcaatggagttgcatctgggaaggactggtagcaaagctggttggttgcaagggccatggggccctgaacacctggaatcatctctgtgggccttagtcccgctgcctgtgttcctggacatggtccccaaataaagctccttggctgcccataagagggtggggagtggaaaggtgagtggttgtggtg

SEQ ID NO: 109739 - DNA, 1128 bp, Homo sapiens
aaggatgtttttacatatatgcgtgctttcttagaaaaaaaaaaaaaaaacaataggctgggcacggtggctcaagcctgtaatcccagcactttgggaggccgaggcaggtggatcgcaaggtcaggaggtcgagaccatcctggctaacatggtgaaaccccgtctctactaaaaatacaaaaaattagctgggcgtggtggcgggcgcctgtagtcccagctactcaggcggctgaggcaggagaatggcgtgaacccgggaggcggagcttgcagtgagccgagattgcgccactgcactccagcctgggcgacagagcaagactccgtctcaaaaaaaaaaaaaaaagaaagaaaagaaaacaatagatagtgtaaaacttaaatgaaatacattttagtaaaatctagattaaccagaatgctaaaggaatttaatcgagtttctttctcctctgcttctctggcagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtaccgagtccttcaggaactttggcttggcatgtctgggaggaaactggcccctggcagggatggactgattgccatctttgtagggttctgggcattcagataagcacttgcagcagcgctatttacttgctattgggagggatacagcctccgaatcacaagattactcaggcacctctgatggggttctcattttactttactaatttgtccttttgttgcttgtgagtagcgacactgacttaagtcagagagtacatgtacttagtgattcattcacatacacaatgatcacccctggcatacttaggccagagagtatagatacttgtgattcattcacatacacaattatcatccctggtacatgtacttagtgattcattcacatacacaatgattaccgctcccggaggcctactgagaccagccagcacatgtttgcttttttgcaatcacgcagcggcaccaaacttcttaccctgtt

SEQ ID NO: 109740 - DNA, 1050 bp, Homo sapiens
tcctctgctctatcgggattcttctcatttgaagaataagttctgcagcttacaaaaaatgtttcacaggcacgggcctacggctttggacttcagaaggagagtacttttccttactatactatttcctattgcaagaccatattttcagaaccaaaacttaaggcccactatgtgactggattttggggacatgaaagcgttgggatttctgggatgttttaatggtataaagctaacagaatagtctattggaatcagggactgccttggaagtgggtcctagcacgcatgatcagtacacctgcaccttcattccagatgagacaggttcttggctaatagttctttcatcgctttcagaatcatttctttctgtccttggattttcaggaaattcagcttagtttcttacccctctgatctctagtttctttctccctagattgctcagctacctctgaaacttgaatctgaagtgatggagaatggggataacttctcagtgggggaacggcagctcttgtgcatagctagagccctgctccgccactgtaaggtaaggcagtttggggttggcagcagcagagaatgggaatgttttagtgcagccttgccctgacacactggggtccaaaggtattcctggctctgatccctgttggcactttctaagagcatgaccagagataactctaaccctgacacaatttgggtatattggttctggggagggagaacagggttgctttgtttttaccttcatccaagaccaacttttgtttctggccattgagtagttgtacgactgcaaaccatagacatagaagattttttttttttttgagacggagtcttgctctgtctccaggctggagtgtagtggccaaatctcggctcactgcaacctccacctcccaggttcaagtgattctcctgcctcagcctcccgagtagctgggattacaggcgtgcgccaccatgcccagctaatttttgcatttttagtagagatggggtttcaccatgttggccaggatagtctcgatc

SEQ ID NO: 109741 - DNA, 1050 bp, Homo sapiens
agtagctgggattacaggtgcccaccaccacacctggctaatttttgtatttttagtagagacagggattcaccatgttggccaggctggtcctgaactcctgacctcaagtaatccacccgcctcggcctcccaaagtgctgggattacaaacatgagccattgcacccagccgaaagatgtattttaacaaatacacgcacaggaaaaaatctagaaggatatttgccgatatttgcatttataaattgttctataactagtattatttacatagtaaaaatagtaaaagaataaatcaagttttatggagctgaggaggtggcccagtgtgctgtcagagctcccatctgtctggttgtggaatgagccgtctgtgaccatcagggtttggagtcttctctccctatgcatgtgtgttaaacatcttccacagacagcctttgccaatgggtcgcttagggtgggaccactgagaaattcctgtgtttctccctagatcaaatttggaccccttcaaccagtacactgaagaccagatttgggatgccctggagaggacacacatgaaagaatgtgtaagtgaagagcttaggggaagccgtgctgagatggtgagggtggaagcacagcagtgcccttgccacaccccgtctgctctggccgtgcctccaggatgcctgtggacaaaggcttcgtggcagggctctccaagtctttcagatacctgggaaaagctgatccctctcaaccccaccgcccacactgcctacggtcatattggccttgcactatccattgattgaagatagtaatgacaactacttagaattaagtgatgcttttaatttattagtcataacagtgtaacatactttgaagcgtccacatatacgcaaaagatatataacgtggccgggcgcagtggctctcgcctgtaatcccagcactttgggaggccgaggcaggtggatcacctgaggtcaggagttcgagaccagcctgaccaatatgatgaaaccctgtccctactaaaaatacaaaaattag

SEQ ID NO: 109742 - DNA, 1023 bp, Homo sapiens
tagaattagagtctgtgtctcctggattgaccaagacatgccagaatgccaggatccaatcagatgttcagtaaatattagttttcttcctttggatttaagccaatgattatcaaatggtagaatcctatctcaaagaatttcagtaaaaactgctgtggtggaggggtggaaggcctcatgtctgcccgtgttggttttcctttggcccccaaggcagctttgtggaatagttccttgagacaaaaggtagtctgaacaccacttccctccccaggctgctgctagtagccatgacacttagccattgtgctctgtctctgtcgagtttagtgatgataagcatttacttccaagggattctttcctagcaaggtgacagggtggcagctacctctgtgtggctactatggttgtcctggttttatttctctgtgacaaagcctgcagctccccaagaatctgtggtcagtctgaactggccacccttgtctccccagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcaggtaaggatgtgcaaagccttctttgaatccattggaacgtagcagtttatgaaatatcactttcacccctttaaaccggatccttgtttgtttgatgagcaattagtgtctcagccccctactgaaaccaattttctaggtttattgttgaccccactttgatgacattgagtgcttttcacagtcataaatgtgcacattctcaatgcagaacactggggcacacagccaagtacgaaagaggagcagcacccacaactctgctacccagagagaagcactggtaacattttggtagctatcttgttaggcttcctctagtaatatgtaggt

SEQ ID NO: 109743 - DNA, 1665 bp, Homo sapiens
gttggggaagacaatgcattatatagactgtttttagactccgcagtctatggagcacaggggctccagactcactcatttcccagcattatgtatctgatttgactttcctggaaacattcttactagttgctcataggttgatatctccatttgttgtgactcccacaaacaggctcagatacaagtaggaagtccagaagtgaatcagttgcagatatgtgttattggaaatgtaaagatgaatagaaaggctttgggtacaaggaagtggttccagcagtgccatgatactgcccgcattcactgagcattgcagttgatggggtaacaggtatgccttaaaagccaagagaatgactaggtccctaagaccagctgctgcatgtgctcagttcttagtagtcctctagatgaaggaagttctccagcattggcctggcgtgtattgataatgaattatctctttgattgttgttttccattatcagttaacggggctgttccagtttacggtcagactggcatctgagacagaagctcgattcacctcggtggagaggatcaatcactacattaaggtcagactgctgtaggccttttaccgtgatctgactcctcttggagtcggtttaccctttgctgcctcagctgggtgtacaaggaggaggcttgtgttctctgcctatctaatcccacagaatctccagcaatctctcaaccgtgcttggaatgggaaagagattaccgtaagagtttctaagtatatttgtaaattatgtcgagctgagaacttcattggctaatttccagaatgttcagaaccttgtcagttcagcttaactgactaatggagcattttccttacactgtttaaaaccatgtattgttttaattcttactatgtccaattgttcttaatcagggatggccatcaggaccccctgctgagcttttggcaggacaaacgtggcctcatctctggattctgttgcagtggattggggtgggacccaggcttctatagtttgaaaagctccatagcgaattctaaactgctctcccaacttacaaacgagtaaatttaattgataccagagtatccagctcttcccacctttccccaggaaccccttccgtcttgccgtgggtggcaggcatcttgctgctgtcctaactggcactcttaaacaatttcctacagggatgtcttaatccatttcacactgctgtaaagaactacctgagattgggtaatttatgaagaaagaggtttaagtcactcacagttccgaaggcttaacaggacgcatggctgggaggcctcaggaaacttacaatcatagcgaaaggtgaaggggaaacaagcacatcttcccatggcagagcaggagagagagagaagggggaagtgccacacactttcaaacaaccagatctcctgagaactcactgtcacgggaacagcaagggggaagtccacccccctgattcagtcatctgccaccaggcctctcccctcacacatggggattattatacaattcgagatgagatttgggtgggaacacagagccaaaccacatcaaggggtgtccaatcatttggcttcccagggccacattggaagaagaattgtctcaggccacacataaaataatacta

SEQ ID NO: 109744 - DNA, 1066 bp, Homo sapiens
catggtgcactgagccttcagaggggtctggtctgctctctgggacccctactgatggccgtgccatgctccttcagtagcagcagtaaacattgcctgagtcccttttgctgtggtttagcttgcttctcctggtgcttggctccatagctggggaacaagtgccattctgcatggtggcggcatgtgcacacacttatggtgttcccatattcactctgagtttctttttcctcgccttgaaccatttctgctgttggcgtttgtaacctttccttctttcagaaaatgccttctgacctaagatatttttctaaagtttaacacaagcctctttattcagtctcttttcccatgtttactctgtgctgagatagatgttttccataacatctttaataggatttttttttgtttttaaagagtaactaagattagaaaaacttaatgtcctcctatgcatgcggcctagaatacctccagaattcctagaataccctcctggagtttccagggcattctctcagttagaaacaggaagtatttaaatacgtgccctccatcatctgattcgctgaagctttgtccatgcgcggggttgtgtagtactttctttgcccattaagtgttgtctttctcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccaggtcagtctctgggataggagcgtcatctttgcttgtttgagcccttcctctgctgacgtaaaagagggatgattgtggggggctccaccctgagccattatttcacctctggacccctagaattgctcatggtctgatttgaccgtaacaatctggatttgactggggcaggtagggataggagagaggtaagtgtggaatccaggaataaaggaatcgaactctgttgcatgtgt

SEQ ID NO: 109745 - DNA, 1467 bp, Homo sapiens
tgaaagttgataactgttgaagggtctgtgctcttcctttaatttttatgtatgtttaaaaattttgcaagacaaaaaatgtcttaaatgttaacagcagttcattggtattggtaagaatatagtttttgttttcttcttcacatatttattttccaaacattttaaaataagcataagttactttgtaaagggggaaaatgtttaaagcagtggggcaggaagggaaccaagaaaagggagtggagtaagaggattttcttgagacgaaaaaaaaaaatcagagcatccaggtttctaaatttttctttgatcagactgtttaaagacaacatcacaaacttcagatagagagtttgtggaacccctttttgtttttttcaattttcagttccatttttccaaaccatctgacacttgctcctttatttgtttccacagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccaggtaaataggaagcgttcatgtctgctggggccacggagaagcctcagttgctgggtaggtgctgtgacacggagctcattctctctccagggtcctgattcgggagctgaagcgtctggacaatatcacgcagtcacctttcctctcccacatcacgtccagcatacagggccttgccaccatccacgcctacaataaagggcaggagtttctgcacaggtttgtcctgatgggggctagaggcctcaaaggggagtcagcatcccagcgtttgatacttgtccgggaggctcttcaaggccagagatggggattataaacctcattaccaagggtattcatgatttaatggaataatctctgattaaaatccaattgcttggcgggactcctttctgagcaagtgagaaaacagaaatacagatttgggccgcatgcggcatcacgtgcctatagtcacagctactcaggaggctgaggctggaggatggcttgagcccaggtgttcaagtccagcctgggcaatatagtggaccccatctcaaaacaaaatacaaggaacaaaccccacagattaggagtctattggccttggccctgaaaagctatatttcatagagttttgctttttcttttaagtagtaaaaggtagtcatgacatttgagtagattttatttaagcatcgagtattgtttatttgtgaaacttatgtgcattgtcattgtggagctttgtattaataagagattggaactaaaatgttcttcaatataggacaggttgaataagctatggtatatccatagagtactatgtggcccttaaaaagaatgagggagctctataggtactgatagggaatgatctccag

SEQ ID NO: 109746 - DNA, 1049 bp, Homo sapiens
aacgagacctcggtgagtgacagcatgaaggacaatcctcatatgcagtactatgccagcatctacgccctctccatggcagtcatgctgatcctgaaagccattcgaggagttgtctttgtcaaggtatgcattggtgggtggtctctgccctcctccctggtgacctgtggtcaggctttggtgtggcgtctctcagttcatgctgagtaggggagctcccttaaccaggatggccctggctgagatgactcatattccgttagcctccaccttttctcacttgccacctgtccctcctgacccctcacacctccccgctttgggagtggatgtgctgcggagcggttctctggaccagtaggaacagagccgtccctgggccctgaccactctgtgctctgctcctcagggcacgctgcgagcttcctcccggctgcatgacgagcttttccgaaggatccttcgaagccctatgaagttttttgacacgacccccacagggaggattctcaacaggttttccaaagacatggatgaaggtatttctcactgagcctttttttaatactctggagctcactgtgcttccagccttctagatgattctccaaatgtgcagatctgtctgtctgtagatcctgagagcacagtgactgctggtgttttcaccaggaacattgcaactgcattttctgtcttgtttgacctgaaaataaattcaatgaattgagttagcagaaaggctttgaacagaggcatctgagattctgaaacacacacagattttaaagcaatgcattggtttctggatgcctacaacctggcaggttttctggctgttgtatgggctgtgcctgcaccagaactgaaatactgtacccccacagttcagagtaacagtaaagcccctgacattgacagggggcttcctgtgtagcaagcagcatgctcagtgttttatgcatgttaccttaatccccgcagcaggcctgtcaggcgggtgttgtttcactccttgaataatgagaaagctgctatctggaaag

SEQ ID NO: 109747 - DNA, 1078 bp, Homo sapiens
gttgggtttatcaggatgtaagcccattgtaaattgaggagcatctgtgtacctctcccccgagttgtgacaaccaaaaatgtctccagctgggcgcggtggctcaggcctgtaatcccagcactttgggaggccgagatgggcggattacctgtacggcaaaaccccgtctctactaaaaatacaaaaaaattagccagacatggtgctgcatgcctgtagtcccagctattcgggaggctgaggcaggagaatcgcttgaacccaggaggcggagattgcagtgaaccgagattgcgccaccacgctccagcgtgaacgacagagcaagactctgcctcaaaaaaaaaaatgtctccagatgctgccaaatgtcttctgggagcttaactcgtctcctgtagagaactactgaactaatgtatgggtttttgaatgtatttgcacaaacagcatattgtgttgtctctgcctttgccttcagtacctggttgactgtgatgaagtgatcttcatgaaagagggctgtattacggaaagaggcacccatgaggaactgatgaatttaaatggtgactatgctaccatttttaataacctgttgctgggagagacaccgccagttgaggtaagatctgatggtgtttgcgtgtgtccccttctgtctctgcaagggaaacacagccggagtgagtgatggagagacctcagctgaatccagtgtctgtgtcttattggcaggggccctgttttctggtgaacagactgctgtgccttagttcacacactgattctgctctaggagagcaggattgtggggctggtgagctgaggtcttctgtcactgagaacttactaatatgacaatggcagggagaaggatatgggctcagtgagggcagagaagatgtgtgctgctgttcattcacagcttagtttcctaagctccatccacctgattgaagcattatgaagctcttttttaaataaacaagtgaataaagtgccaaggtagggaaattaaatattgcatacatttgaaagcactcaggtcaggtgctgcggctcttgctggtaa

SEQ ID NO: 109748 - DNA, 1041 bp, Homo sapiens
agcagagtggcagagctgggccagagctgctcctgggagtgcaactgaaatgcttgggagaagagcctcacagggagttaggctgtcattaggcctttgtgttaggaaagcatgtgtccattagggcagggatgttaacactgcttgttttaaggttgtaagtattttctgtgtcttggggattgtaaacaaaatcccattgttgactcagagttgatgttttttattctatccagatatttttaaaactacaagtaagcgtgtgcatgttgagcatcttccttgaacttgattttgccaacctccttaactcagatagtctgtagagagcccttttctattagaaagagcccttagaacaaatccacatttctttgggtctctgccctgcagcagtttccagaggcttgtctttggaactaatttgtgctcttcagtgttaaaacttgtctcccatgaattgccctgaaggtctctgggattggcacctttatttagctgatttcagttaaatccctcaaaccagatttggtgaatggtttaattactttagaggtccttaaatccatgtccccagatcagcagcatcagcatcagcatcatctgggaacttgttagaaacacaaattcttaggctgttctccagacctactgaatcagaaactctaggggtggggcgcaaaggtctgttttaacaaaccctgcaggtaattctgatgcaacttccagtttgaaaacctctgaattaattgaatatttgacaactgatttattcatttaatcatttagtaacatttattaggtgtttattatgtgccagtgacatgtgcagacactgtttggcactaagaatataaaggaataagacaataatctgcacgtaaagaagtgtacagttaagaggatgagatacccaaacaaataggcacaaaataatctgatgaaaagagccccatctctttggggtactagcgggaaagaggttgggggagatttcagaggagatgatgccagaactgagcagacaaagtagaggcaagc

SEQ ID NO: 109749 - DNA, 2603 bp, Homo sapiens
agcgtgaccaacatggcgaaaccctgtctctactaaaaatataaaaattagctgggtgtagtggtgcatgcctgtaaccccaacaggagaattgcttgaacccggaagcggaagctgcagtgagccaagatcgcaccactgtactccagcctggttgacagagcaagactccatctcaaaataataataataataataaaatgatttttaaaagccctaccctgtcttctaaaaaatgacaaaaacaagtaaatgaagaacatgggttagcagcagaataggaaagaggctgggcctaagaatgacggtgggatactggaatgtgtgcggcatatttactttccccaaagggcttccattcctgttatctcaggtgtctccacagaaacccatgagataggcagctaatgagtgagaaaacaggtaagtggcctgctgagtcatcagggtgacagttctgtatgggtagactacagttaatgtgtttttcctcaagtccttagcgatgagtggttagtagtctctaaatgaccctcctctctgtgtgccttgtccagggtaaactggttggaatctgtggcagtgtgggaagtggaaaaacctctctcatttcagccattttaggccaggtaagatttttgttattgtccttttctgctgctttctctggtttgcaagagtctcaggaaaaacgaacaaatttcctggagagtcaggaaaggtggaaacaaatgaaccctcagcctgcattgtatgcccccaatcccccgcagttccccccagttctcccccttcacagccttctgcctggaaggaggcctggtgggcgcctgatggatgactgactgttgtcccagctggaaccatttggtctcatgccttctttcattcagcatgtatctattgagtgccacaggtatgcccgtgtattgaaaatgtcagagataagagatgagcagacaccctacactgcagcgctgccaacagagttaacctgtaaagaagcagggcggccagcactcccagcctctctgtcagacaggactgtcagggtttgatctagaagcaaagcccctctgttttctgcctaatccctgaaagagtcatgcccttggggagttcatggtccagtggggagcaaggccttgagaacacaacaagcacatctccaggcagggagtgaacagcgtgcagggcccagcacacggtggccagtgctgagagtgagggacaggatggggccggagtcatcccactgagacacactatcattgctgtgttttagaatcaaacaatccagaaaaaaaaaaaaaacaaggtgcccacatgcttttacattagaattaaattaacttgacttagatggttgagatgagcataaacttatgattatctctacaccctgatggataaggtccactgaattgaaatgaaacagagggggagcaggggtgcttttgtagcccccagattatggaatgctttcttgtcttgtttggcatcagctgtcacagttggtgagttgtggtcctccttgagggtggtggtgcctggggctgtctgagtcagatcatggcaggcatcacctccaccttctgctttatgacactctccagtggctgggcccagccattggtcttgtaaaaagcaccagacttcctaggtgatttatgatgaccaaccagatttggagggccagtgaggagagacagagatggggggagggggagaaggaaagaaaaggtcaattcgtaagtgctgctctgccatctagcaatgtgctcctttttccagggttgactaggcagtggttaggttgaaaaccaagtcaggctttgcttctggacaaatcctggcaaccctgtctctggcagggaaacgggttgggctggtcagccctgctttaactgtagtttacatctgttgatagcgctgcaatgtgcggtgtttgtgcagcagccagaagtgccggctttccacagtagaccccctggggacttctgaaccctttgaagtgcacatcagaatgctaccagtttgtggtgtacgtaggtacacctgtgtgtgtacacgctgtgtgagggtgtttgagaagaccagcttatatgaacaagtactgcacaggctggttagtgaaactttgcttcaaagctgtagcatccctaaaccaagacaaatgtctactatcagtcccaaacaaaagaaatcatggaagggggtaaaatggataagtcaattcatatcaaaccattgcaactgaacacaaacttcaaagcacatggttcatcactgcttgtgggcaggcaaggtccatcattggtaaatggacactgtgtatatattataaatactaggtgatgtctaacctggactttttttttcccttggtcctcatttcatagaagcaactggtctagccagcatcctaggtaattgccttggatgagttggcctgcccccatgttgaggcagggattagctggaaacccctacagcatcctctccaggagaattctgcaagaacctcttgcttgtgcttctcctaatttaaacagtttgcacacagcaaatgggctgcagagggaagtgtttgccttcaagtt

SEQ ID NO: 109750 - DNA, 1051 bp, Homo sapiens
agctgtacgcctatagttccagctacttgggaggctgaggcaggagaattgcttgagcccaggaggtgtaggttacagtgagctgagatcgcgctactgcactccagcctgggtggcacagtgtgagactcagagtgagtctcaaaaaaaaaaaaaaaggtgggtgaggagagagtgtgctggggcagggagcaggtgtggttacaacttgaataggctgcctgagggaatgccttatttaaaaagtagtatttgggcaaagatcaaaggagatgagggagagagctacctgggtatgggatgggtggggaagaacattccgggccaaaggaacagaaacacagaggccgcaagtggtgagtgtgtctgttattggagtggaatgagcatgggagagagtagtggatgccaagggcagaggtggtgcctgccagagcctctggtgagacttcagctttactccaagtgggaagaggagcctttggaggattcacagcagaatgacatgattggacttatgtatgaagaggatcattctggttgctgcaggggagacaaggaagcaaggagaacagtcaaggctctgttaccacagtaaccgggagaaagatgaggatgtcttagatcaaggttgctggtgggaggtagtaagaaatgtttgtccatgtaactggaagtagggaggaggtttgaatgcagtgtatatgaaaatcagcaactgaccagaggcatggtaagccaatccagaactagactgagaagaggacaaaaagcttccagcccttaaaagctatgagcaagaaggggacacagtctttagtgacaccacttgaaactatgagtgtcattgaagggcatgcaagtcaggtttttacttcagttaactttttttttttttttttttttgagacagagtctggctctgttgcccaggctagagtgcagtagcacgatctcggctcactgcaacctctgcctcccgggttcaagtgattctcctgcctcagcctcccgagtagctgggattataggcacgtgccactgtgcctgg

SEQ ID NO: 109751 - DNA, 1365 bp, Homo sapiens
ttctcagggagatacccttcacttccatgcaagcctgttcctttggttgtttgaactctcaagttccaaggcaaggctttgaagacatgagagtttcttggcaagaagatgttctctgcggtagatgaaactttagatactcttttctgacggtagcaatgtaagcctgtgacagtctctactcctagatacatgcggcgctgtgagtgtgggaagtgggcaggctttggcattctgcaggaggggtctggaaggaaaacacgtagtgagcatctgtactggaggtcagcatgccctttgcttttcctacctgctttttactactccttagaacaaggggctacgtgccagtcagttaaatgtcattaggtccgctttaggctggctgagggggaaaggcagtttagcatgtaatttgtcatgtggaatattgggtcattgataaggcccctggacctcttgaggttgccccacactcccgtgaccccttgatgggcctgagattgggctgcactaatgagctaccttttgcccttcagcttccttccactgtatagcctgatgtgttttgctacgtgagtgtacgccctaggcttgtctccctggtcttgatccagtgtctcatctttgcacctctctcacaactcctatcagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagaggtaagtggtccgccccctgcctccctgcccgcaccccaccaccccatgctgatctgccaccaataggcggctgctgttccttttcacaaagtgctttgtggctaggagtgattttgaactaaagagcaaattagaccagctctaactctaaaaaaaaaccaactaagcatttagcaacagaaatgaataacaactaatcttatgaggtgatcattttataagcaaggaaatgaaacattcaagaggattttccaggatttttccccaaagaggattctattttagttgtatgtgagctgtgacaattatttctgattgttacaagtctgtgagcgcccttgtgcactaggctgt

SEQ ID NO: 109752 - DNA, 1117 bp, Homo sapiens
tgcgccactgcattccagcctgggtgacagagtgagatcctgtctcaaaaaataaataaatacattaattaattaatttaactgggcatcttatatttatctggcaaccctgtgagtagtcccctcttctgttctcaacagattcattctgatttgattcttctagtgaatgaatagtgttttcatggtcagtgtcctgtgataaagttgaggcttatggtttataggtttatatggttataggtttatgttatatctaagattctgttgttctgacaggtgcaaattcaagtagatacaagttcaagtatggggaggcccttctctgcctcttagcacgtcagggcagagtgatctgaagccgaaactctcctggtagaagggagggtaaggctgcggggagtaggaaggaaacatggggctggagctgtgaaaaccagtaggtactggcatgtttcttaatagttcattgaggcctaaaagaccttcatcctttgaataactctttaagggagagaaatgatggaaattctgtcggcatgtggttttactctgtgaaggtgatcaaaatgtttggcatgttactcttagttcaatctctcaggaaggctttgaacaaatgaaagcagcagccatttcagcaagcgggggccacacctaaggttactcgagagtgaagattatctcagaagtttagaatcatgacacttcggggaagataggatcagggatgaatgggagacgggggcttaagggagagcttagaagtttagaatctaagagagaaagggtttgtttttggggagagggattatgtatgatatttaatagcacctgcaaactttaagatagctggggggttctcagtaactaaggagggtcctgaccctaaaagctatcttttctctaaagattttgtaatgtttaaaatttttttaaattaagataaatatattttaaatcatactgtgaatccaactggtatagcattctgtagagaagatcactggcttaagaggattgttagaaggtggctcacacctgtaatcccagcactttgggaggctgaggcgggtggatcacgaggtcaggagatctagacatcctggctaatata

SEQ ID NO: 109753 - DNA, 1729 bp, Homo sapiens
tggaagttgcagtgagccaagatcgtgtcactgcactccagcctgggcgacagagcgagactccgtctcaaaaaaaaaaaaatgtaattgacttgtaataacagctgaccgtgaagttgcagccttcctagcgcctgagaggaaattcatggtgtcaggttacttcagttgcatagcatcattaggcacagtttcttctcttctcctattttcaggctttcacagtggtgacagtcttcaattccatgacttttgctttgaaagtaacaccgttttcagtaaagtccctctcagaagcctcagtggctgttgacagatttaaggtaagtggctccttcccctgcccccgtgtcaggagccctccccacacaactaactgctggctctgttcaaggggccacccaggctggcctcactgggcttaagcttggctttggccttttggcaagttggtaagaaaaagggggcagtggaggagactgaattgagggatgagacttgtcaccttttttaattaatgtgaatttttaccttttgtgaacggccatgatctgggctcccaggattgcagagttcccctttagagctagccccttccacctgggcctgacatggatgtgtcgcaactcactgggccttgaagtggcttaaacctagaagaccagcactgtggggcatcttccccttgatctttgctactgtcactttgattgattgacatgctgaatcctttttgatactttctttttcctgccctgtggtgctactcacgatgcagggaaagcagttacatggaaatagtcataaaactaggtcatgttgagaagtgcagttaagtaagtctcagcttcttttcttgcaggtggttagttgatcataccttggctgtgttctttgttccttcagaatactacacatacatgatacaaaagggagtatatttgggagggtggagagaaatagatatttgatagtggttaatacttaacaaaaaaagggatgccatgtgggctggaattccttgatgttgccactgcatagattagctcctatgtccctgcttgtctttattggccagtgagaggaataagaaagcaattttggtgatgtgaaggcttgaagctcacatgtttgagggatgaatataatcatcttggaggttcaggagaaaacaaattggattttcttcttaagaaacatggaaactcagttcccgagatttgtttgtattctacttgtttacagttgaccgggtgacttttatttggtcaagaaagctagtcctggctgggtgtggtggctcacacctgtaatcccagctctttgggaggctgaggcaggtggctcacttgagcccaggagttcaagaccagcctgggcaacacagcaagaccccgtctctacaaaaaaataaaaaaatagccaggtgcagtggtgtgcgcccacagtcctagctacccggggggctgaggtgggaagattgcttgagcccaggaggtcgagcctgcagtgagttatgatcatggcactgcactccagcctgggcaacagaatgagactcttatctgtgtttttgtttttttttgttgttgtttgtttgtttcttacaaaaagagaagaaagaaaaaggaagggagggagggaagagagagaaggaaggaaggagagaagagagaaaggaagaaagctagtcttcgaatgtgcccctcccccaccccaacgtggccac

SEQ ID NO: 109754 - DNA, 1078 bp, Homo sapiens
aggctggtctcgaacacctgacctcaggtgattccccctgctttgggcctcccaaagtactgggattataggcatgagccaccgcacctggcctcttagtccctccctttttaattctccagtgccattgtgttgtctttcctattaattccttaggcaaaaagtcaacaacaaccaggtaagcaaacacaactgccaattatagatacaattaatgtgttcattccttctcaacctaagaaatttacaagaagaatcagaaaaaggtatcatagaagatgatgattgagttcatacatagtgactgctttctgttagattcattcctgtcacttgatccatttcaaacctcagccttttataccagctttagtggtagagttgatagtcataggtgttgaagggtggctggagacctacagagtcttgtttggaggtggaggaacaacatccctaggcttcttttaacttgctttgaaattggcttgctttttattcatagaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggtcagggaaccctcagggatggggaacattttagaaataccacatttgctggaggctgaggcaggaaaatcacttgaacccaggtggtggaggttacagtgagccaagatcatgccattgcactccagcctgggggacagagcaagactccatctcaaaacaaaacaaacaaacaaacaaaaaaaaaataccacatatggagatgatgctgtggtcctctccttactggacctggaggttcccccaagaattagtaggtattttttcattcatgggattaagctgagaagcagaagagtggggagccagcccttatgcacaaatagtgtatgagttgtttttagtcaacataagtttgagtttaattctgaaattacagatcatcctgtggttcatatttactgacaattttaattgaaggtctcaa

SEQ ID NO: 109755 - DNA, 1049 bp, Homo sapiens
tcagctggtgaaccctgtcccacttgacataggagtgtttgagtcactgcgttggagttggtgctaagtgatagggccctcctgcctcccctttggaagcactcagtctctgtggtcactattgagaataaatactttcttgtcttcattgccttataaagagataagaattcagtaatgttttattacaattcaataggtcacttttattaaagacagtacgattacataacatttggcccatcctagcaagcaggattatatgctcattttattgagaatgaccttaagcagattaggtagttctcaagtttgaatgagctttaatttggcgtggcatcgcttttcctttcagatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaagtgagtttaaagattttgtatgtgcatgtggtagaaggaccttggattctttgggtcttataattcacacactttgctttctgagcacattacgtactaggactagtgtctagtatcgtaggacataatatcatagaatctttgtgttcaaaagggatcttagaggtttgaacccataacctcatctcactgatgaggaaattgagacctgggaaaatgttgatttttcccagttaaaacacagctagttaggaataatccagtttcgaagccccctgtgtatattctcatcctgcccatgattttccagcctggtcatgaggctttcacagaagacaatatcaaattactactgagagcatcacctttgcccactctactctgtggtttcacgggaaatagtttgtggcccttgaggtaaactgggagtcaggatggctggatgctggtcctagctctgtcaaacgtgtaagtgcccacaaagctaggagaaatggcacagatggggcattcagaaagatctcaacacaaattgaaccagtgtgc

SEQ ID NO: 109756 - DNA, 1917 bp, Homo sapiens
gaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttcccacttcctggtatttaatactgttgctgaatgtgccttgtgtgagtgtgtgctccggcgttgcaggacctcagctggaggtggcactcggtggttcttgggggctggccgccttccctctgcaggtggtgttagacatatgctacctgaggtaacatgttttcatttttgggagggagtcgggagtggggcgggcccatgggagggtctctggatttttgatagcctgctttgtttgctctcttctgtactattaaactgctgatgtttattttcaggaatgttttgcaaatgcacttctcactcttccccagtacaactgtaggtacactgttcctttttatcaaataagcacgtttgaaacgatccaaaaaaaaggtcttaatttcatgtaaacaaatgtatccatgtgtggagatactggaataaggtcaaagctatacttttgaatgaccatgtgtttagagttaatttcagctcattgataggtttatgttacattagaaagagtaatggttttgatgatgtcctgtaaggaagaaagtttgcaattagacctagctcctgcagaatgccctgagtaagttactgcaggcagcttgtaataattgggtcttccaaagttttgctttgcttgcgcactggtccctgagtggagctgcctactctttctaacttaacataaaactatggcattgtgtgtgagtgccgtggagatgttgacagtggtgtgtgtctctccctgtaggccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgaggtgagtgaggggtgtttgcttcacagcagagagcaacttcctagcttgaggttcattcctctagggccctgccttatcctttatcttcctcctgagacaaatgaaccgtgtccttgcagggtcccctcactactctttgtatcttatagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatggtgagtaagcctcccagctgaatcctggcagcttctccttaggagatgagttacttccattgggttatagtaggcattgctgaggtctcacagctctgattggaaatttcctcaaagcaggttc

SEQ ID NO: 109757 - DNA, 2044 bp, Homo sapiens
aatgcaagaacttcattggctcccctctaaaaaaaattccatggattgctgggatttttattttttattttttgaaaaaaatggtacctatccgtattcagcttggtggcttcacagtccctcccctgaacatccgtatattccttattctctcatttatggtgcagaacactggggtactaacctctaggaaactgttctagctgccagggaaagctaagagccctcctttaacaggaaagcagcagcatgctttttcttctctctgccgtttcagggaagagcaccttaaggccagtgttatttcatgggattctgccctagagctgagaaagtaatggactcatccataatctcttttatagatttgaaagtgtaaacaatacacacttccttttttggaactccaattctaatatgtttctttttcattggaaattgaaaaaccaggctggttttgagattagtactagcagtgagtaaacctcctgtctgtggacttaaatccttttgaggaacatttcgttttagatttttacaagttttctaatctggcacgactttcaaactagcttaatctgttcttacagaaacctgtgtaaggacagactgcccacatacgggctccccaaataaaatggcatttttatttcttgtccctgctcgggtttcaccgaaccttggtagccataatcagaacaaatgaaacacagtcaagttgttgtgttctgtttgtttttacctgccagccagctgatgctgacatttatacaccaagatgatccaaggttttggtgacgccggtggggactgccgctatatgtgcagggtgcccgggggtcatagtaatgttaatggagtaccagaatctctaacagtgtggtcctgtgtagccacattgctacacttacagagatgctttggggcctttttggattaagacagttctaaaagaccaggcctcacctatgatctgtgtataaagaattagcatcgcactgtagatctgcaagagaaggccgcctcctgcagtgctctctcttggtgaatgctaactctgctcgagggccttttggggaaaggacagtgtaaaacccttagagaggtaagtttcccacccttccaacctctctccacctgcagcttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcaggtaaggtaatgtttattcactgggaatgctttccacagccagacagctatgctaacagtctcaagttttcttccagtttgtttagatttaaatgatacatttgtaactttttaaaaactaaattttggttggatttttcatgaaaacctcttttttctttatcccctaaaaaatggtttgaaatgtcattgttatttaaaaacccgatgtgttggaacttctttaatctgctgtttcctctttttccccccctttgaaagtttcgcatagtgtaaacattcactatgtcttttaccttccctgctcctcccatctgggaggcgctgatgctattacccagtgctgaaaaatggcactctaaaggtatgggaaggaaggagcccaaggcaaccacctgctgtcctttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacc

SEQ ID NO: 109758 - DNA, 2917 bp, Homo sapiens
gactctatctcaaaaaaacccaaaaaaacaaagagcggaccctaatgtaacctatggacttcagttaataatgaatctgtattggctcatcaattgtaacaaaggtaccacactaatggaagatgttaataataggaaaaacagatgaggaggacgggagaggtacagaggtatatgggagcattctgtactatctgattagtttttctgtaaaacctaaagatgctaaaaaaaaaaaaaagaaaactgtttaaaatttttaaatatctagcttaatgttccccaatgggttcaaatcatacaaagttagtgtttaacctcctgacccttgcttggaatttctcagttaagatgagtccagtttgcagtttgagctgtttcatcagttccgtttgcctctcgcctgtgtattaactgtgctcttgcctttctccctatctgctggaacagttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaagtaagatgccgtgctgagtgatgacagtgaagcatcaaaggcctttttttttttttttttttttttttgagatggagtcttgctctgtcgccagtggcatgatctcggctcactgcaacctccgcctcctgggttcaagtgattctcctgcctctcagcctcctgagtagctgggactacaggcgtgcaccaccaccaagcccagctaatttttttgtatttttagtagagacggggttacaccatattggccaggatagtctcaatctcctgacctcatgatctgcccgcctcggcctcccaaagtgctgggattacaggtgtgagccaccgcgcccggcccatcaaagccgttttagaacattcaggctaagattagatcatctggggagactggtctttagctaagagctgtgttcactaaacagtgtccattaaacacgggctgccctctccgtgcgtgttgatagctttgtgatttcggttttctctccttagacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaaggtaggcgcctctggtccaccctcatctcccccatgccgggtgggcagggcctgagctaggagtgtgaagtccacagctctgtgtctttaaagagccgagctgtccagtggagggcgggcggcctggggatgactttctctttgctcttttgctttatctcctatttcacctttgatcctgttttaaccacgggctttctctctctctctcagccccgcttctcttcctgagtctgcagggagattatgttgctgccttgtgacagaatacatttttgtggtagctgattgtcatgattaaaatgtagtttacaactttacattttaccacaggaaccttcagaaagggttgggggcccctgaaaaagaaagttcttattcacaaattgcattcagggatcattttcctgggtggaaagaaaggcttttgctctcatcattttctgtatcctgggaggctccttatacagggtaaatgtgtagttccctaggaagggtattttttcccagaaggtgaagactatgtacataattttaaaggagagacttgtgtgagtggtggcaaaacctggagacaaaaagtggtggcaggcggggagctaggtgtgcctttcccccgaggagatgtgtaacgaggacgtgtgcccttgttaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagtaagttctaaccatcctttccgacagtctccaggggcccggccacggccagctctaacactcttattctgttgcagaggttgtgctcagctttgggctaggtagcagtcttagagatgccttcaggtctgttgaaaggggtcgatggattttggcaacagctggaaggatgaaagggcagtgttgccagagaagaaatggaactggcttgatttctgggtgggggtgaaatggaactgactccagttctgcacaggactgtgcttctcggttgtgtgttaacatgaactgacagtcggtgcaggcagatgtgtcttgcagtgctatgagtgggtgagagcacgttgtgtggcccgggctggtgagccagcaccgggaacataccaagtgcctggaggcagttatcacatgtttggcaggtctgtggcaaataagccctgagaaaactagaggactgtcgaggattttagagtctgacctggagtccgtttaagtttggcttatagtgtgactgtgtggcaagtgttggggtggcagccgtggttttccccagtctgtactgatgcagagtagacaagagagcctttgacgttcactctgtttcctgggcacctgtttcttacacctgctgtgctgccttacacttgagaccttgattaaatctattctctacacatttgccttgaggcatcggagcagtagtactgcttgtactgtgcgttttccatatgtgggtaagctggaggttcatggttttggtaagtatgtgcctaagatgcatggcaattaggtaaaactaatttgcagttttgtttttgtttttatttttttaacgtttgatgcctcttgttaa

SEQ ID NO: 109759 - DNA, 1021 bp, Homo sapiens
cttactgtgagaatttctactccatgctttgttacatgagaattctgagattagtgctatttcaaccacttttatgggggtttgttaggataaaattgcactgagtgcctgttctaaaaccaaaggcagcaggagagccctgagtctctgccatcagtagtgccactgcagtactcacgagaaacctggggaatgaagacttgcctggcagctttcatttgaatctttttaaaaagagcctttgattttgatgttttccaatataggaagtaacttactacctaggaggtggtgaaacatgacatagttatatatagtaaaaagaacaaaaaccatgcaatcagaggattttaaaaatattaagtccatttagttttctatgaataggttttagtgaaaactgtcactaggcattttagaaatgaagaaaatgaaatcagtgtgttatacacataggaactggcatttttttggttcccaccatctggaatagtcttacagatcggaggcactcggtaagttatttgtggaaagaatggatgaaagctgtgaagattctggtttcctattaatgctaatatgccatgctcatgtaaacatactgatggattgcttgccaagttttcctcttctgatgcttctcaaacatcaaagatgtttatagaacccttctggccggacacggtggcttacacctgtaatcccaacactttgggaggccgaggcaggcggatcatgaggtcaggagatcgagaccagcctggccaacacggtgaaaccccatctctactaaaaatacaaaaaattagccgggcgtggtggcgggtgcctgtaatcccagctactcgggaggctgaggcaggagaatggagtgaacccgggaggcggagcttgcagtgagcttaggtcgcaccactgcactccagcctgggcgacagagtgagactctgtcttaaaaaaaaacaacaacaagaaaaccccttctaactcttgaacttggttcacctggaaaagcaaaaga

SEQ ID NO: 109760 - DNA, 1015 bp, Homo sapiens
ccactgtgcctgggtgacagagcgagactctgtctcaaacaaaaacaaaaacaaaatcaaaaacaacaacaacaaaaaacaactgagttcttccctgtttttcttagcatgtccagagatatacctagtctccagggtataacaattctttttgtcttctaggctgaggtttgagggaaaaaatgtcctttaagttttatccatagtagagttgaaacaggttgggatttttcagaagagactttactcaaaatcctaagggaagagaagggagaaaaaatgaaaataaagtcattaacaataaatacactactttggctgggccctgcctcatgagaggccagagtggcttgtggagtttggcaacaccgccccccctagaggtaattgctgtgctgcgctccaacctctccaacaattgttagactcttcagatccctgttgatacagagcattccaggattgtgaagtgggagccagccacatccatgatgttcatggagcctagaagagccctgtggaaacaaattttacctggttacactgagatccagacatgcacagaccagccctcttgaagagagcttgagcttcctgactggggctggaatggagagagacaatgaagttcctgagagtattgccaggagaaaaaggtgtggctgaatggatcagccgaaacatcaggggcttgaatccagagggaggatggggtctcgctatgttgctcaggctggtctcaaactcctggccttaagcagtcctcctgcctcagcttccaaaagtgctgggattgcaggtgtgagcatctgcacctagccaacaatcatttattgtatatttcacagtagctagaagagaagggttgtaatgttcccaacacaaagaaagatagggctggccacagtggctcacgccggtaatcccaacactttgggaggccgaggcaggtggatcacctgaagtcgggagttcgagaccagcctggccaacatggtgaaaccccatctctact

SEQ ID NO: 109761 - DNA, 1056 bp, Homo sapiens
cttcctgccctctggctgctcgcgtgcgcggcgctcacccgaggctggtccttggagatggggaagaagcggcgatcgaagctatcggccaccagaactgcttgtaggggcggcggcggttcctcctccgcccctctggctcccccgccaccgctgcctcccggccccgcgccgctgcgcttgttagcccgactaaccaccacaccaggcggcgccactacaggggccgccatcttcttctctcacggtcaccacttccgcaaggaagctgccaccgcacgcagtaggggacaaaaaggatccagcacttgaaatgcgatggactaattaacgaagggaaggagacgaggagggagcagtgcgcatgcgtcttccccgggagcccacaggggtctgaggttgatcccggaggcgcgaggagtcggtacgggtcacggttgtcccggcccctgaggcgcagggtaggagtggggtcccatagatgtcagactcggtctgcaagtatcgtcggccttcatttgtaggtgaacaagccgagattcttgtggcgtgataggacttgtggtcgccacgaaggggccagctccatcgggaatctgtaatcgcccagcagtttccccgccccgcgcatgtgaaatatgtagccctccgtattcattctagaaacttctgggaacccagcgccttggggagatagaaccgagccagatgttcccccgctgcgaggaactcagaacctgcataaatagagaaggtggcaggcatatagtagggagaccagtaattccattgagcgctgattttgggccaggcacgatacaagcattatctctgcaaaacatcttattcattcgttcagcaaacgtttcttgaactctcagaaggatgaaggaagtttacccagctagtaagtggaagaactggtattggaacccgatctgtctgactgcagagttccacaatcttgctgccaagttatgtggggataacaatgactattttatgtcatctattcattcttccagcctatcagcctcctgtgtcttaagcagagtg

SEQ ID NO: 109762 - DNA, 3338 bp, Homo sapiens
cgggatcaacctcagacccctgtgggctcccggggaagacgcatgcgcactgctccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtgagcgccgcgcacgcgagcagccagagggcaggaagggtggcagggctggagcaagttctcatttcggctaactacaacagcatgcccttgaaggacctgcgtctatgctgttatcctaaaaccggatgcagagggactgtctaaaccctgatgactgctgaccaagttagtggccggcagatttgggcattcgtaatgctgtccacctcgggtttgaaaggaatgaagagagctaaatgtagaaacagcgcttgagagaagccttcacgcggggattcagtgcccctagaagaggctgcgccgcttttaaccttgccgatgacggttgcttaggtgaaaagaaacgaccttttgcctctgaaagggcggtaatatgccttaaaaagagcgggctagatctcaggcagtgtattttttttttccttccaggttctaatgatagccggtgctatctgtcgaaaggacaaaatgggtttagtggttgattgccatcagcccccgagttgtctagacaatggggtattggactcagctgggtcgttcagcagtcagttcagaaagagggaactgcattggatttaaggaaaatcctctctaattccctcgaaaaagcctaatggctgttcatttttgacaagtgacgggagatggctaacctctgacacttagaaagggatcaaggaaggaaatcttatggggaagaaggccttagcaatgcttaaatttatggaaatatgattgatttccagtattatcctttgccagcagtgaactgccattctgtcacagctctgtgtctgatacaaggcacatagattctgtacttaccatccccaaattgcaatgtctcagactcaggcttagagcatggcatgaacatcaaaggcaggaacctgtttatctttgaattggaaagatacagcaaaattacactgtttggaaatacgaatagaggagtgaaaattgttgcagtggggtacccaaagggattcgagacctcaagttttttttcatcttgtatccttcaggtcctcttgcccctggccaatgtggcattaattgactacactctggaattcctgactgccacaggtgtacaggaaacatttgtcttttgttgctggaaagctgctcaaatcaaagaacatttactgtaaggccctgcaacttttctttccatgtttcgccatctttttccagttttttcaggatgaatgtaactaaggggaaatgtgagaggggaaaaatgtgtctacttagatgtcattgtaagttctaagggtattttctacacttatcaggaggtgagcagctgaaactttgtatctgtctgtcttgggttttctgtgacaaagattaaagaataaacttgggttttttctgaatctcattataaagtttggtgccagtggactttgcttttatttaatggcttcagtatggaagttacaatgataacatctttgttttcccactgagtttctaaatcttgtttgttctcaccttcaaggatataaatgagctccttgtcatctttgtattcccactgcctagctcagtcccaagcatatagtgagcacttacatgtttgttgaaatcttgaaaactagggaatcgcattgcttatggaagtccaggatgtaaagactaggacattagcatggtctccatcagacagttcctaaatgttatatggattgcagaaggggaaagctgacgtgaagcgtgttcccaggctactttgtgtaccctaggcttcagcaggattttgagttcaaattgatgtttagggacaaggggtcaaggtatggagaggaaataaccatgtttcctaacccataaaacaagactggtgacacaggatgctgaaagcattcattatagttcataatactctttgaagttgaagacgctggcaagaacccaaaaaagccatcgagaaggactgtgagtgctgaaagggggtgaaaaatggggaaggctcaaatgatctttatgcttgatacactcattcccctcaccctcccttcctttaggaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggtcaggatgggaaaatgacaggaacaagggttaaagaccagcagagccctgagactgcttttttgcagttctgtccctcctgtcctttataggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctggtgtgtggatatctggggtcctttgagatggggaagtgacaggcttcagtgggagaaacaaattaaagtccttgtaacttctccccacagagcctgtttcagggcagtagtgatggagtggaggttcgatatgatttactggattgtcatatcagcatctgttctcctcaggtgagctctttagggctggggctgcacacccaaagagtagaactctgtgggtctgttattgtccccttagaaggccagggtatatttcttctccctgtttattttcattatttttacttttattttttgagacagagtctcgctctgttgcccaggctggagtgcagtggtgtgatcccagctcactgcagactctgcctcctaggttcaagtgattctcctgcctcagcctcctgagtagcagggattacaggcacaccaccatgcctggctaatttttgtatttttagtagagatggggt

SEQ ID NO: 109763 - DNA, 2698 bp, Homo sapiens
ctggcactgtcattggcagcaattgctttatcaccaacagtgtcattggccccggctgccacattggtgagcacaggtggggaatcaagccaactatcctaggaacaggaacctgggggggccacgtctccagaaacacaagggatggctacacaagggacagtccctgggaataaggaactatagagcggctacctcaggaaaggaggaaacagggatttgaaaacagcgataccttaatttgtagcctgtgggcctctcattggatgactcttcacattccagggtaccctgtagtcacattcaggagcaagtagataattaacatgcagtaacaacatctatttagcacattacagtttacaaagggcttttatatacattgttacatttaatcttcataatttacaaataaacaggctcaacaagattttcttgcccaaggtcattggtaataatggtgggacctgaatctgggtattctgaatgtaagtccagtgttcttttgagtctaccataactgcctggttggcctcttggtatctcattttggttgcaggagtgtgatgcgtctaatagtactgcccctttccaagaacaacagtaaggctcagattctaggggctgagcgtggtggctcatgcttgtaatcctagcacactgggaagccatggtgggaggatcgcttgagcccaggagttcaagaccagcctgggcaacatagcgacaccccttctccacaaatgatacaaaaattagctgggcatgatggcgcgtgcctgtaatctcagctattcgggaggctgaggcaggaggattacctgagcccagaggtcgagggtgcagtgagtcatgatcatactactgcactccagcctgggtgatggaatgagaccgtgtctcaaaagaaaaaaaagacttggtttctaaaatgtaccagaagaggtggaattatttggttctgcttgtaggcgtggatatgattctaataaggttttttgagttcagagggtccccagaaatcctgaaggttctcgggttcttaagctctgtgtgtagtctataattgttgtaaacttggtgaagtatcttctcaggcctgggcttagggggtgagtgggtgtttctggtgacttgcgggatggggaatgagagctaggtgggagctgtgctggtgtcagtcagccctgtcctctatgaagggctctgctctgcggttggaaccctgagttacccagaggtcttcccatcctgagccaggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtgagacctgatctatactgtgcacaggccctgaattgcatggcagtcacactgagccagaaggggcattatttccacccataatcctgtctaaaaaagttgctctcattatcaggatgcacttttcctccacaccctaatggttctgtgttttttttccccttaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggtgtgagactcaacaggtgtggggcatctgtgtgtctcgctgcctcatagaagaaccagtgtttcctcctggagggattggtgcttccgccgggccctctctatagatcattgccttttccaggttacaatccagcagaagtaggagctgctggcaagggctacctctggaaagctgcaggcatgaacatggaggaagaggaggaactgcagcagaatctgtggggtgagctaggcctgatgcctgcccttctcctcctgaatcggaatattttgaaggataatgaatacttcagagtcacattacttattcactcctttattcaggcagacagggcaggtatattgctctctgtcaatgactctttttttctttttcctcacccattatggcttctcaggactcaagatcaacatggaagaagagagtgaaagtgaaagtgagcaaagtatggattctgaggagccggacagccggggaggctcccctcagatggatgacatcaaaggtgagtggcaggggagaaatgcgctggaccagtttattctctgcctggatcaactagccagaggcttacgttcctcagaaagggtttggtatcgagtcaagactagatgacttagagcattctgaatgatgttggcccatgaacttatccttgctttgatttcagtgttccagaatgaagttttaggaacactacagcggggcaaagaggagaacatttcttgtgacaatctcgtcctggaaatcaactctctcaagtaagagcagcccctccctgttctcctcggggtgatcccgggaaggtagaggctttctcgtaagtgttttgtctccaaataggaacctattccttcgacatcccaaatggaaagaccagtagtatttggagcaaggagagcattattaagttctagcctcagcatagactttctccttcctaaaccctccccttccatattgttccatccagattcctct

SEQ ID NO: 109764 - DNA, 2517 bp, Homo sapiens
tgcctctggaagctggttgggctctagagcagccttggctggttcagaggggtcagattgagttcaatactgactggcctttgagactccaggatttcataccatcctaggcccacaaaggtatattcagaatggacctggacattcagactctatggcagcaatttgacccaacacaagatcagcctctggggtgggaataggtattttgaggcagcctatagcatctgatcccctttcaccttccctaaggaatctctttttcccaaaccctgtcaacaactcccaagtccctctgacataattccacagaacctgtatcatctcccttttgtccacccatgtcatcagtatggatttgcttggatgtccaggtataggtgaatgcttaggaatatactgcagctcccttctttcttccatagctgctaaaggcctggagccctgtttttaggaactacataaagcgcgcagccgaccatttggaagcgttagcagccattgaggacttcttcctagagcatgaagctcttggtatttccatggccaaggtgaatatgacctcaagccccattcttctgcacttgctttcaaacgagggttggtgacccccttgggagacataaaatagaagctaatgtgaatccagtatggaccatccactcccaatatgcttattgctagaatagtacagcttggagccggactaataaggtagccatctggggggtggtctggaaatgtgcaaagctctccccagcaatagttccagaagttagacctgccccaggagcagagcgaacagctcactcttgtccgttttggaggaggctactcagtgcatagagggatctgagggcctggtagagtatcctgctggactttccaaggcccctgaggtcccctttattggccttttgcaggtactgatggctttctaccagctggagatcctggctgaggaaacaattctgagctggttcagccaaagagatacaactgacaagggccagcagttgcgcaagaatcaacaggtgcgtcaggctgtcctcctctcgccaagatggttatctcattcccaggtcctggcccctagactctagggtggttggtttctggggctctggttgttagagctgtttatctgccgaggggagcaggagagttatgtgcacctcccccagccgatctctcctctgcttctttacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgtatttggtttgtctccatccctgactaatcagccagtgaagtatgtgaccagaatcacatgatagcctttccttaacacctgggggagagggaggacgggtgtgccagccactaggtggtactgtggtaccttgctaattaacctttcccatggctcatgggtagtggagggcggaggttcttttccagcctctgtggaccaacttgtgatcctggggtggtgtgcctaagcccgtttccatagagtcccattttgaacacttttctgccagaggattatgttgccaaccatatgtaaagcccattagacatgccagttcctttcacatgccttttccagttgatctggtactcgttctgtcaggaagctgggccacgcttcatcagaaataaggaaatcagctcaaggtcacatgactcttgaggggtaaagctaaggacttgaccctcagaatccagaactctgtccttcagcgtattgtgtttcagtgaagggaaaattggccccacagacaaatataacccagagccagtaatggaggtcccaagaacacaggaaggccatgtgaagggtgctttcccttgagagtgtttactatgtgacaggcaagcagttttcacatattgtttcatttaatcctcacatgagccccatgaagtcttatccccattttcagataaggtgcctgaagctcacagagcttccctagctagtaactgacagagccaggtgtgatattggactcttgacctggagcttgttactttgctgtattgctttaaccttaaccaaaagagacatgcctttctgtcttttctttttgagttccttgtcttcatatagagtgagtcaacaattctggccgcgtgcagtggctcac

SEQ ID NO: 109765 - DNA, 1616 bp, Homo sapiens
cctggccaacatgatgaaacccccatctctactaaaaatagaaaaattagctgggcctggtggcaggtgcctgtaatcccagctactcaggaggctgaggaaggagaatcgcttgaatctgggaggtggaggttgcagtgagccgagatcgcgccattgcactccagcctgggggacaagagcgagacttcatctcaaaaaaaaaaccaaaaaacacaaaagtttagccgggcatggtggggggcacctgtaatcccagctactcaggaggctgaggaaggagaattgcttgaacccaggaggcggaggttgcagtgagccgagatcatgccattgcactccaacctgggtgacaagagcgaaactctcaaaaaatataataataaagccacatgacccagtgataaggaaaataggaggtgacaatgaatgagagatgccaacattttggaagatgaaaaacagaacagtcaacagtcacttaacagagtagaatgagttgggttctacctgctgagggagttaatggcaagaagtaagccaatgtgcccttctgaacccataaaaggttcagcacctcagaggagggtatggactgacgctgagaactaggggtggggtggaaggagattacacgatgatctgtataagaaaaagccccaccaagtcccaacctcatctgatccagccaagtgattacccctactcccttgcataaaatgggagattccgtctctggagaaatggtagggaggaagttagcaaagatagacttaaggtttcctaagcccaaaggtcacaagtttccagaccaactgtccatgagtgcccagcataatgaatgaaaaagcccatgaaatttcagaatgtccaggggaacttaaactatcagagcctctgcattcagcagcaggcatagtggggatagaggtgaggtattagattgaaaatgaagaattaagtgaaaatatatgagcggtgagactcaacatcagcacacactgacagaacctccagtatgaaaagaaacaactgcagggaaaaaaatgcctatgcatactgacactgacatttttggtttcttcaacaacaaaatgtcagctttccccccacatgatcaccctacagtgaagcctattcattaataataaagcttgtaaatagactgagcttccaatccactttttggtatctcactgttaaatatgaatagacagcaaaggaccattaaacatctgagtaaccttccaatatgaaagaccaaaacaaacaaatagaaaattgaaaccaaggaaacaataacaaagtagggagctttctgaaaacttcatggggaaaaagctacaataactattctcaaaactcaaagaaaagatattgtgtctatgaagtactttaaaaaggaagaattggagaagaaagagttcttagaaattaaaaataagtaaactaattccttctcttgagaattggaggattcgaggaccaaatagcagggtaacgtttcactgtatttccattcttacatacttcttgaatcttgaatcatgaatatattatctatccaaaaaaaaaaaaaaagtagtaaaggatcaatccataaggcccaaaatcat

SEQ ID NO: 109766 - DNA, 1602 bp, Homo sapiens
agccaagggtggtggtgtgtgcctgtagtcccagctactcgggagactgaggtgggaggatcacttgtgcccagttcgaggctgcagtgagctatgatcacaccactgcactccagccaggaagacagagcaagaccttgcctccaaaaaaaaaaaaaaaaggctgggtgtgatgtgactcacacctgtaatcccagcactttgggaggccaaggttggcagaggataacttaagcccaggagtttgataccagactggccaatgtggtgaaaccctgtgtctattaaaaatacaaaattaggcctttcctttcagtggagcgtggcggcaagatggctgtgcaaatttccaagaagaggatgtttgtcactgatgacatcttcaaagctgaactgaatgagtttcttactcaggagctggctgaagatggctactctggagttgagatgcaagttacaccaaccaggacagaaatcattatcttagccaccagaacacagaatattcctggtgagaagggctgacggattcgggaactgactgctatagttcagaagaggtttggctttccagagggcagtgtagagctttatgctgaaaaggttgccactagaggtctgtgtgccattgcccaggcagagtctctgcgttacaaactcctaggagggcttgctgtgtggagggcctgctatggtgtgctgcggttcatcatggagagtggggccaaaggctgcaaggtcatggcgtctgggaaactccgaggacagagggctaaatccatgaagtttgtggatggcctgacgatccacagtggagaccctattaactactacgttggcactgctgtgtgccacgtgttgctcagacagggtgtgctgggcatcaaggtgaagatcatgctgccctgggacccaactggtaagactggccctaagaagcccctgcctgaccacgtgagcatcgtggaacccaaagatgagatactgcccaccacccccatctcagaacagaagggtgggaagccagagccatctgccatgccccagccagtccctacagcataacagggtctccttagcagctgtattctggagtctggatgttgctctgtaaagacctttaataaaatctcatacaaagacaaaaaaatatatacaaaattagggctgggcatggtggctcacacctgtaatcccagcactttgggaggctgaggcgggcagatcacctgaggtcaggagtttgagacaatcctggccaacatggtggaaccctgtctctactaaaaatacaaaatattagctgggcatggtggtgcatgcctgtaatcccagctactcaggaggctgaggcaggagaatcgcctgagcccaggaggcagaggttgcagtgagccgagatagctccactgcactccagcctggatgatagggtgagactccttctcaaaaaaaaaaaaaaagaaaaaaaaagttagccgcatgtggtggtgtgcacctgtaatcccagctactcaggaggctgaggcacgagaatcacttgaacccaggaggtggagattgcagtgagctgagaccacaccactgcactccagcctgagt

SEQ ID NO: 109767 - DNA, 1050 bp, Homo sapiens
actgtccgcacctcacaccctcccctcactttccacccagctacccaccttcttgccctacttcccgagctcaggatatgcctggccccagtgcagcccctggcttgcctctctccctccttcacccctgcactgggcactgtgtaaacccaactgcttccatcccctgcagcaacccggctaaatggaactgcgaagggggaacggcggcgagaaccagggggttatgatagctcatccacccttatgagcagtgagctggagaccaccagcttctttgactcagatgaggatgactccaccagcaggtggggcttgagtttcatgggtattgtggggcaggtgaccctggaggagccctaaaccctgaggatgcggggcccctgggaggcttatgggctttgtgttggggacccaggccctgcagtgcctcccctcatgggggcagggctgggccagcctggtggggaacgactgtgggccccacaggttcagcagctccacagaacagagcagtgcctcacgcctgatgagaagacacaagcggcggcggcggaagcagaaggtttctcggattgagcgggtatggggtctgggaggctagggatgggtggaggcagattgtgagcccttcctacgcagggccaaggcttgttcttccttagatcccatccccctagtgcagtgttgagaaccttggggctgggggctgcaccggggactcaccttgaggaggagtcaggtgggagtgaattcctgccacctccacctgctgctcagggcctctgtctattccagtcctcgtccttcagcagcatcacggactccaccatgtcactcaacatcatcacggtcactctcaacatgggtgagtctgaggaaacagcactctcaagcacctgctatatgccagacactgggcagacttgagttcagagagcgtagaatatgttccctgccctcaaggagctctctttcgtaaacatcagctgatacataaactgatcattttagtatctcaccatcagggctatgacagagataagcaca

SEQ ID NO: 109768 - DNA, 1038 bp, Homo sapiens
cggctcattccagcaaccccacactgcaactcccccacagcgggcactccaaccctcactaaacagtgtttgcttctgaacttgtatgagcacccagggcgcctcagtttcctcttacaaaatgggactcacgatataaactttaccaggttcctgtgggtttaatgagaggatataagtgaagcaccattgcgatgtgtggtgtaaagtaagcattcagtaaacggcagccatttcgattatcatcacatgcacatcgtacactggccaagcacctgcatttacattatttaatcctttattcaaatagccttgtaaagtagatattaaaatccccattttttacagaaggggaaactgagtgtccaagaaatcagtaattttcccagcattgatcccataattactagatggtagagctagaatgcaaactcttgtttacctaactccaaagcccctttctgcctcaccattctgcctcccacccccaggcctagacgacttccacttgtccatccacagtgacatggctgccatcgtaaaagccatggcctcccctgaatcagggttggaggtccgtgaccgcatgtggctcaagattaccatccctaatgctttcatcggtgagagagccccatggtgggatgcagggtgggtggggagtgatggggcagggcaggccggagggcccaggacttgccttggacccttcctttgatctggagccagccccagcctcatagcttctgtgaggccagatgagtccaagtcagatgggcctccccatcaactggcagccttgtccccaggctcagatgtggtggactggctgtaccacaatgtggaaggcttcacggaccggagggaggcccgcaagtatgccagcaacctgctgaaagctggcttcatccgccataccgtcaacaagatcaccttctccgagcagtgctactacatcttcggtgacctctgcggcagtatgtgcctccctcatcttcttgccctgtctcctggctgggagtggggaggtagccaggg

SEQ ID NO: 109769 - DNA, 1596 bp, Homo sapiens
ttaagcctctgctataaattctcctggctctcctgggcttccatattttgggggctggggtgtcaaaagtgagatgaagttcttagctccaggttttggggtaaaccaaggtaggaacattttggcatttatttcaattaacaatacttccttggacgggtgcggtggctcacgtctgtaatcccagcactttgggaggctgagacaggtggatcacttgaggtcgggagttcgagaccagcctggccaacatagcaaaaccctgtctctactaaaaatacaaaaattagatgggtgttttggcacctgcctgtaatctcagctactcaggaggctgaggcacaagaatcgcttgaatccaggaagcaagcggaggttgcagtgagttgagatcgcactccagcctgggtgacagagtgagattctgtctcaaaagcaaactaacaaagaaaaacaatacttcctggggttttggtgtgcagagggctttgttggaagtgtgactcaatcttgcctgccttctgggagctctagaattgttcccaacccagtccatggcttctagccaccactacagggctgtttcatgtacttctctctctgactctgtcttgtccgactctcttgagaatttctcaacgattgctcatgcctgtcagtatcagtgcttccatcgttccatctttgattcacttctctttcctttctatttactcccaaaatggagtcattcatcctgatgtcctcaattgctgctgatatgctggtgattcccaaatacatagctccaacccccaacttcccccagactttagatctgtattggtattacctactggacatctctatggacagttccgtatagactcaactcatctgcccaaccaagtatgttcctcctgaattcctctcctggttacttcatcacaatctacataggctcaccagctagaaacatttatgagcttacattccttcttcccatatcttatcagcatatcatatccatttcactccaacactctgtcttgaatttggccctccctctcccctctctactttaattcattggagcatgggatttggagttaggtggttttgggtttgaattccagctctactatttttggttgtgtgatagagttatttaacctctctgagcctcagttccctcgtatgtaaaatgatgataataatacctacctcacagggttgttgtgaggatttaaattagatattgtacgaaaagtgcctagcacagtgcctggcacacagtagagtaggtgctcaataaatggtagctattattattattattttatcattattattatttactctaaattggtagcagtttagggtatttttggaagataaagcttttgcaaaggtagaagtgaagccttgagtgctggttcaaaaattagaagtgcctgtattcagtcacttaatgacttcaggccgtgactatgatgtgagagaggtcagatcttcatcctgccacatcgtggcttctggctggaggctgggaaggactgtaacatttgcaaccagatctgtcctttcttgcccttccttcctcccatgacaggcgta

SEQ ID NO: 109770 - DNA, 2858 bp, Homo sapiens
acaggaggttcagccaccaaacctgagtcaggttcctagccccttggaagatcacctgctggcctatttctgtgttctacttcagaccagccttcaggtctggatgtgaactggccttctgaggggcatagagatcctagcccaagagaccaaatactcaggaaagaaagttcagagtgtaccagagcctcggacctacacccaccttcaggccaggcccagcctggttttttcccaccctacgcccgctgccgtgccagcccgccagcctcaccatccagcagctcatatatgagcacaaaattgttcttgatgttttcctcgctgatcttgccaaagtaggcagccatcacgtcacacatcttatagaggaattcgaagaccatggcagcgttgacattctgcttggtgactgctgccagccaaatgttggaccgcttaacgtggaagaagctggtgcgagcaatgttggtgacggggctgcgcacctgctgccgggcatggataacattgacccgaaaggcatccactgcgttcctcctgagggaaaagagtgcatagggcctgctcagcacccaggtgaaccttaccccataaggatcaaccacagctgctaacagccccaccctcctttctgcagaagtctgacacacacactccaaagaaagccaatgcctaaaccactggagtggttcccttcttatgactccctgtggaggcatgggaagagtgcctgagctgggctagtgtctaaaggccacaagaaatagggaagtcaactattaaggctgatgtaaccttaataaagtgaggttcatcaggtttagagacagatattccttactcccagggctggccctaatttcccagctttatctagcttccctgtaagctcccaggtccaggacagaaagagacactgcttcttcagtcctcccgctagtgatcccaccagtggggagggccgactcctccagatgttagacaaagccagcatggcttcagaagtcacaaaggagggagaagtaccaaggggccatggaattgtgctacccattcttgcccaggatccaactccagagcaagttgagggaatgaaaaaggatgcaggaaaacgatgggggcaggcccccacccacctgtacctgggcagcagcttgagaggccgcttacctattgctacggcagccaatgagatgggatgagagaaatgacgccagcaagaagaggagagtgatagcaacgagagagagggttagacacacaacacaccgggagggcggcacacaccgtgaggcagaagcagacaagacaggcaaggcggcgtgtgacctggccttggcttgcccagtccatccaaggcaggagggggtctggggtggggggtgtagccagccaggttcagacaggccaggccttgccacagctgcagctctagctcatgccacaccaccagccaatggacaaacgcccgcaagggccaagccagcccatcagccagggagccaaatgaagagcactgccacaggcccattctgtgactttatctcaagctctctgaggaagaaaaacaggcagcaggaaccagaggagcctactctttagcgcctcggaggctaggataggtcccttcagtcgcaaagaacaagggcgtgcaagggggcgcagaatgagaaggcaggctgtggctctgtgtgaaggcccaggatatggagctgctctgggtctactgagagggtagcatggcttccctgccctcccacagtgacccagagagtgcctcacgcttccagccactccccagggaatgggccagaggaactgaagacagctgagtcagcagcctgacgactcctgagaaagggagcaggagaggattgggcagcctggaggggctttcaacagaatccagtgaaggcgtttgatatgggaagggcttctgagagcaaggcttagatggattagtgcctccagcgtggccactaaccccacccactggagacatttctcctcctcctcctcaaagaaggaattcaccagcctgggcaaaggcactgtaactagagaaacaggatgcaggaagggaaggagttcctaaagctgtgggaccatgccattccacaggtcccacctaggggctggcaggctggctgccgggccaataccaccagacctaatgggagccaggctacactagctgagcttccagggtgcagccaggggtcagggtggcccaagtcaagccaatggtgggaaaagacctaatcctgtatgctggggctggggggctggagtggtggggcacagctggctccgccaggggactcacccgatgtcatctcggtagactcgggagatgagcacctcccccttgtgattatagatgaataagcctccaatcatggcggcagatcagtctccgcggcccatcgctctgagaacagacctaggacaggcgggggcagggtaaaagaagacctcagaatcgctgccaacatcccctgtggagctgtgcaggtcactggagcttctttcctgactcaaccctttagtaagtgaccctgcagccctcccagacatgcccctcccctcagccaggctccagttcctgtttattccacactagatgggagaaagaaacagagagagattaggcccaggattctaaggccattttgaccctccctttcctggggctgagcatcagtaacccccgccccctctccccagcactgagctcaggaatgatccttttcggccccctcctgtgcagactctcgggctcccgccagtgactcactaaggcttgcctgcctgcctgcggctgcaggaatggcggtaggcattactccagttgg

SEQ ID NO: 109771 - DNA, 1038 bp, Homo sapiens
gagggcagggaagccatgctaccctctcagtagacccagagcagctccatatcctgggccttcacacagagccacagcctgccttctcattctgcgcccccttgcacgcccttgttctttgcgactgaagggacctatcctagcctccgaggcgctaaagagtaggctcctctggttcctgctgcctgtttttcttcctcagagagcttgagataaagtcacagaatgggcctgtggcagtgctcttcatttggctccctggctgatgggctggcttggcccttgcgggcgtttgtccattggctggtggtgtggcatgagctagagctgcagctgtggcaaggcctggcctgtctgaacctggctggctacaccccccaccccagaccccctcctgccttggatggactgggcaagccaaggccaggtcacacgccgccttgcctgtcttgtctgcttctgcctcacggtgtgtgccgccctcccggtgtgttgtgtgtctaaccctctctctcgttgctatcactctcctcttcttgctggcgtcatttctctcatcccatctcattggctgccgtagcaataggtaagcggcctctcaagctgctgcccaggtacaggtgggtgggggcctgcccccatcgttttcctgcatcctttttcattccctcaacttgctctggagttggatcctgggcaagaatgggtagcacaattccatggccccttggtacttctccctcctttgtgacttctgaagccatgctggctttgtctaacatctggaggagtcggccctccccactggtgggatcactagcgggaggactgaagaagcagtgtctctttctgtcctggacctgggagcttacagggaagctagataaagctgggaaattagggccagccctgggagtaaggaatatctgtctctaaacctgatgaacctcactttattaaggttacatcagccttaatagttgacttccctatttcttgtggcctttagacactagcccagctcaggcactcttccca

SEQ ID NO: 109772 - DNA, 1047 bp, Homo sapiens
ccaccatgcttggctcatttttactactttttgtagagctgggtctcgctatgttgcccaggctggtcttgaactcctgggctcaagtgattctcccaccttggcctcccgaagtgttgggattacaggcatgagccactgcacctggccttgatttctctatttgaaaaaaatcaaacatttgaattgttttcctgtaaagcacaaatcacagaataaatgctacaaagctagaagactttcttgcggatgatcccacatgggctttgggagctgtgccggtcagatgtgtaggcccaagtaggggctggaatgaagaagctctgtccaggggctgatggttcccttctttttgcagagattctagactttggctacccacagaattccgagacaggcgcgctgaaaaccttcatcacgcagcagggcatcaagagtcaggtacttgaattgtgcagactatagtcagggtggagtccaatctcccttcatctcagctggcccctgagccttgtctgagctgactcatgagccctcccatgacaggaagtgctggcctgagcctcctgccatgattgcaggccgattttgctctgtgtggtcctcccactgcaggagcagccaattcagcatctctattaccaggaatacagctcaagcagtttccttttgcactgaggggtgggggaggaggcctggtcttgaggcctggtattcctcaggaggagcgagcttgggccctctcctctaggatccaagcctcatagctttctcctccttttctgcctcccttgctgcttcatgtgggcacctcgttggccctgcggcctccagcatcaggtaagctcttccctcagcttccacccttgcagctttgctttgtttctccaggccctgccctttggggcttataggggaaaatggattacaggtggggactagaagggatggggaatgagggtggagtggggatagagacaggatgattaaagggacagaggagtgaggccattgctgtttgtttctgccctcatgtagacaaaagaa

SEQ ID NO: 109773 - DNA, 1044 bp, Homo sapiens
tttaattcatagatccattcttcccctttcaagcctcttagtagaaattactatttgtgatgaggcaaatcttttacttctctcggcttgtcctaacacagttctttcaaaaaacttagattgtttaaatgccaggtaagacacaaagtttacttacagacaggataatgggctgactttgctttgcgcatgttagacataattttctccaccttatttttaagttcataatattgagcaggataagtatgttctaaagcagttctttggttgctgtctcctgctgattaaaggaactgattcaaggtgtcacaggtagggctttcttctttagtcacctcttagaaggtcccacgccgccccagcttctttcaggaccccagccatacaaacacctgtagtagcgatgaagtagggcagggcaacgggacttcccagaggagagcggctgtaagaggaaggccacatttctaactagctctccttgcccaggtgccattcgcgccctctggcctcaaggtgcgctacttgaaggtgtttgaaccgaagctgaactacagcgaccatgatgtcatcaaatgggtgcgctacattggccgcagtggcatttatgaaactcgctgctagctgccactaggcagctagcccacctccccagccaccctcctccacaggtccaggtgccgctccctcccccaccacacatcagtgtctcctccctcctgctttgctgccttccctttgcaccagcccgagtctaggtctgggccaagcacattacaagtgggaccggtggagcagcccctgggctccctgggcaggggagttctgaggctcctgctctcccatccacctgtctgtcctggcctaatgccaggctctgagttctgtgaccaaagccaggtgggttccctttccttcccacccctgtggccacagctctggagtgggagggttggttgcccctcacctcagagctcccccaaaggccagtaatggatccccggcctcagtccctactctgctttgggatagtgtgagctt

SEQ ID NO: 109774 - DNA, 1173 bp, Homo sapiens
ttagaggacaatttggagaggtgaaacggggctataaacaatgttaggtttgtcattaaacttgctgtgcacctatttctagagcatctttggtctcctttctccactcctgcagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcaggtgaggactcccggctagggagtaactagcagccgctgtcgcttacagagcgcctgccgtcctggaacaatccataatttgcatgtacatcctagtaatcagcagagcttagaacttggcactctgggactcagaagcccttgttctttccacagtgcccattgccctttcttgttctttccacagtgcccatttccatagtgcccaaggtaatgagcactgtgcaaacccttcctgtattctcttcctcttccagccacaaggtagccaatggcctttccaacggtatagggtgcaggacatcctcctagactgcccctgcttaggccaattgctgtttctcctccctccagggcggagggctctgaagctgcagagctggcagaaatctatgccaaactggaggagattgaggctgacaaggcacctgccaggtatttaaagctccccctccctccttcagatttcctttcccttctgtggactgttccaactgagttcttcgatttcttctctactagggcatcagtcattctcgctgggcttggctttacccctaaaatgcagcagcagcccacccggtgagtgacccttgccattcttggctttgaaccctgttgtctcagccccttcctgccctgatgaacacccacccataatgtgactccatcattctttagggagttctcaggtggctggaggatgaggctggccctggcccgggccctctttgctaggtgagtctcctgggccagtgtatgaagccctatggaagattggtcttagctctt

SEQ ID NO: 109775 - DNA, 1723 bp, Homo sapiens
gtgacttcctcctctgctgggaagcagagtattccacactgttcttggagggctaatcttgactagcacatggcaaccactaatttactttctgtttctgcttctacgtatctgcttattctgggcatttcatataaatggaatcatacaatatgacctttgtgcctggtgtcttttacctggcgtcatgtgtgaggctcatccatattgtagcgtgcgtcagagcttcatttcttttcgtggctggataatattctgttgtgtggatatacagcattttgtttattgagtcatgaggggccatttgggttgtttccattttggttattatgaataatgttgctgtgaacattggtgtacaaatttttgtgtggacatatgttttcagcttgcttgggtgtatacctaggcgcagaattgctgggttacctggtaattccaaattaatgttttgaggaactgtcaaactgttttctaaagcaacaacatcattttacattcctaccaacaagggatgagagttccaatttctccatgtctttggcagcactgttattgacttttttttttttagttttagccatcctagtggctgtgaagtgatagctcattgtggttttgatttgcattgccttaataactaatgataatgtgcattgggagtttaattttgaagtgccctttctataagtgctggcaggaagcttaaaatcataaagcttagatgtttgcgacgtggaaacatatcacaatatagtaactggggataaaaagtcacaaaaagcctaattctattttttagcatacagtaaatgagaagaatggactctaaagtaatgatacctgagtggtaggagtacaagccctttctaagttttctctgaacatatattactcgtgtaggaagttatttttttaagtaataaatctagtctacctcatctcttctcccaggcctgagctgaagcctgtggacaaggaatcagaggtcgtaatgaagtaagtgctgggccagtggggctggtggggaattgcttgcttccagctgcccccacatcctcacccctacctcctgcaggttccctgatgggtttgagaagttctcgccgccaattctgcagctagatgaggtggatttctactacgatccgaagcacgtcatcttcagtcgcctctctgtgtctgctgatctcgagtctcgcatctgtgtggtaaggctgctgtttctctgtgctgcgagctgggactctcctgtctaagtgtgtggtgtggattggcccagatcctcaggctgtaaagggacgaggtctgtggaacaggagtgagggcccgggctaaggattttgcaggacttacactagccctgtcctctggccgcacagcgctgctcttcagggaggaagagcctagtgtatagtgttttaaaaatacttaaaaatacttaaagcagtgctttaccttattggtctcggttctgagttttctaaacctggagacattgaggagagagcatgggcttcagggtcagacttcggatcttgactatgccatttcctagcttggttaccaagcagcttcctaactcttaagatggcgctgacatctacctcacttggttcttgggaaaagtaagtccccagcacttagcaaatactcaagtattgctcaccttagtatatgcatttttctgtagagttagagttccttttttttttttttcgga

SEQ ID NO: 109776 - DNA, 1033 bp, Homo sapiens
gactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcagggtgagtgtgccttcaccctgaccactcctcccaggcctcggtgcctcttgtgtccccctgagcacctcctgccctcctgtctttcagggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgtta

SEQ ID NO: 109777 - DNA, 1385 bp, Homo sapiens
ggtactatcataagagatttacatatgttctaatattgaaagctcacaagagaccccgagacagggaggtacacttacatttactattctcattttacagatggaaaaattaagacttcatgaggttaagtaacttaccaaggtcacacagccagtaagttaggggttcaaacccacaagaccttatggccctaggtattactctctccatattccatatttggttgaggagcaggtccagagaggttaataaacttgcccaaaggcatgcatcaaggaatggcagagccagagggctatgtgacctaaaaactattgcccctctgttttgggatagtcccccccacacacactcctgcccttggccttgaccaccgcatacagatcgtttctaccctcttcacctccaacttcattggcatctgcttcagccgctccctccactaccagttctacgtctggtatttccacacactgccctacctcctgtgggccatgcctgcacgctggctcacacacctgctcaggtaccagctgggacaacctgggggagtgggaagggatagggagttcctgttgggggtttatgtctagggcatgaggagctgcaggtctgcaggccttgcaactggatgaaacgtggaacctgtttctcatctccaggttgttggtgctggggctcatcgagctctcctggaacacatacccttccacatcctgcagctctgctgccctgcacatatgccatgccgtcatcctgctgcagctctggctgggcccgcagcctttccccaagagcacccaacacagcaagaaagcccactgaagtccacccctttccctcaggacctgagtctaccctcaggacctggggttggttggactctgcccttccaaataaaccttgctaagtccaactctgtgcaacctacatggaggtgggggcagccgatgcctggtccaggctgtgagggacacgtatggagcagataaagaattcactcaagcagtcctaagaggcactttattgcataggatttggggactgtggctctctacccttccactgtgttgcagggagctcagaggatggaggggagtgtgagtggggtgggaggagagggagagagcacaggcaggcactttttgtgggggcaagagggctctagggagggagtaagaagcagtgggggacaggctggcaccagcctacactttcccagcaccaagaggccagccctgggcggcagtgacttgagtgtgttgggtggggcgccagcccaagcagcagggggcagccttcacacgttcgctgggctgtagcacagcaggtgtagctgcaggttttggtcccagtggcgcagtagcaggaagagccctcgggc

SEQ ID NO: 109778 - DNA, 1053 bp, Homo sapiens
gagcctttttgctttttttaattttaagttttgagatgggctcttgctgggttgcccaggctggtctcaaactcctgggctcaagcaatcctcctgccttggcctcccaaagcgctaggattttgggcatgagccaccctgcctggcttctgagagccttccttgctctgcccagttatgacttggtgaatccacaccttaaagcattgttatgacctgcctcctgagcttctttggccccaggcactggcctgggccggggggtggggaacgtggttttcctgctatttctagtgggaattggggaacctctgaggcctacatccccgtcccacacccctcaatgagtagcatgaaggctggtcattgggaatgagccttggcagctctgctgacatcacaccaatcctcaggtggtgctggggctgcccttcctgctggagaaccccagcggctacctgtcccgctcctttgaccttggccgccagtttctgttccactggacagtgaactggcgcttcctcccagaggcgctcttcctgcatcgagccttccacctggccctgttgactgcccacctcaccctgctcctgctgtttgccctctgcaggtggcacaggtgagaaaaggcagtagtgccatgggcagagttgggggaaggagtgaagggcctaagccttaggggctgcttgggggaagtgtcagttaagctcatggggtgagtctagagtttgactcacaaaaggggcttgataactgtctgaatggcttttctccaggacaggggaaagtatcttgtcgctgctgagggatccctccaaaaggaaggttccaccccagccccttacacccaaccatatcctttaaattgtgggaaggtaagtcttgccctctctaggtgctgacagagtcctggtcaggtatcccttgacagctggtgacctgggcgaggaaaggggaccccaatcatagaagtcctattctgcaccactgtgctgagcacttcacatattgaaggatatttgattcttaattctaaatacgagctactct

SEQ ID NO: 109779 - DNA, 1033 bp, Homo sapiens
tcctgttagccttgactaaatacagccgggactctgaaggagctggatctcgcgtcccaacgcaggcgtcctccaagagggatagacaggcgggaggaaagcggaccaggccaagcccatgcggcgccggtcctgccagctctacctggcggggccgcgccgggattacccacctagcacaaggatacggtcctcgggccgcagctccggctctaggagggcacggaaggaggagaagtccccgaaccaatcgtagggggcagaatcggctgcgccttggtagcgctgatcccagtactcgacttcgcggtacccgcagttccgctccggtaactccggaggcgccctacctgcccctggagaggccatgctctcaaccgccgggcagccagagccgccggcccttcagccaatacggaaggcaggatgcagaaggcggggcgctggtgtctccgcccaccacctgcagttgctcaacacaaacacgtggaacttccgtcctttactaagcgctcttcgaagaatcctccggctgggaaaactatcgtccagaccctgaatcctccggctgtactgccaagtcatttcctagggccgcactcaaggtgtcagactcacgtgggctcatcactgcgtcctctcatattttcaatatgaatgacttttatcaggaaatctgaaaattagtgaaaggttcatttttctcagcatccggaaggctcgaagggcaggcaggaggggcgcgaacaggggctttgccctcctggagagacagcatgaacacagatgttcccagcgcaggcgaaggagaatgctggcttcagcggttgtgggggaggtaggcaggaatgttgcttttctggacattcgttctaaattagcgcctgtgtacccagggctgggtataaactgaggagtaagacattgtccctgctcctatggagcgtggagtgcatcagaggagacaaatgcagaaaaattacattttagtggagtaaatgaagactggctactcggatcggcgcttagcctg

SEQ ID NO: 109780 - DNA, 1023 bp, Homo sapiens
cgcctgcgctgggaacatctgtgttcatgctgtctctccaggagggcaaagcccctgttcgcgcccctcctgcctgcccttcgagccttccggatgctgagaaaaatgaacctttcactaattttcagatttcctgataaaagtcattcatattgaaaatatgagaggacgcagtgatgagcccacgtgagtctgacaccttgagtgcggccctaggaaatgacttggcagtacagccggaggattcagggtctggacgatagttttcccagccggaggattcttcgaagagcgcttagtaaaggacggaagttccacgtgtttgtgttgagcaactgcaggtggtgggcggagacaccagcgccccgccttctgcatcctgccttccgtattggctgaagggccggcggctctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggtgggtaatcccggcgcggccccgccaggtagagctggcaggaccggcgccgcatgggcttggcctggtccgctttcctcccgcctgtctatccctcttggaggacgcctgcgttgggacgcgagatccagctccttcagagtcccggctgtatttagtcaaggctaacaggagtaagagattgttggtcccggggccctctggagaaagacagtccctcagagtttgagcgttgggggtacccaagaccctgtccggaccctcgggaggcaggcagccttggggaccggattgctcagaggaccgagatcaagtcctagcgctaattgacttgtaaaacttaggacaagtcatgaacccgttctgagctttagattcagttctagaaatgg

SEQ ID NO: 109781 - DNA, 1053 bp, Homo sapiens
gctgggatctagagaaagatgcaacacaaaaggttaagataggatgaaaactaagagtaggctgggtgcagtggctcacgcctgtggccccagcactttgggaggctgaggtgggcagattacctgaggtcaggagttcgagaccagcttggccaacatggcgaaacactgtctctactaaaaatacaaaaattagccatgcgtggtggcccgcgcctgtaatcccagccactggggaggctgaggcaggagaatcgcttgaacccgggaggcggaggttgcagtgagccgagatcacacacctgcacttcagcctgggcgacagagggagacgccatctcaaacaaacaacaacaaaaaaactaagagtaaagcagggttcaggagagtctcaaaagtaagcactaagctgaaggtgaggaggtagggagagaaggggtaaggtgagatcactggtttagctaaccatccccctcaggagctgggatgactgggattggtactcaaacctcttcctctgatgccagcagcaagtaagaggagaggtgagagacaggaggaatttgaaatacacagaatgaatattaagggatctaaaacttcttggtaagtagaagaagagatggcctttggcgattagtggagcccaggtgggccttcaggttgagtgggaagtggtttctgggaggagggttaagggaattggcacagagcagtgttgagtgtctgtttgcaggttttcgccctgttattcaacagatatttattgagcacctactctgtggcagacagctgcgcttgggtctgaaattacagtggtgaacaaagcaaacccagccctgctttcatggagcctcagggccagcaggggtgaggccacatgagtttgtactggacccgagcagggccagggccgccatggccctggggtcatcaggcctgggccacattctcactctgccatctgctagtttgtgatggaagtcaagccgtgtcatcttcccaagcttctgccctggggtgtgaaatgggactcatcttcacttcatgaag

SEQ ID NO: 109782 - DNA, 1048 bp, Homo sapiens
tcccagctacttgggaggctgaggcaggagaatcacttgaacccaggaggcggaggttgcagtgagccgagatcgcgccagtgcactccagcctgggcgacagagcaaaactctgtctcaaaaaaaaaaaaaaaaaaaaaagaaaagaaaagaaaaacaactggatgtaaattgatgaacaaatgaagtagtgctgctttgggcagtgggattataagagtcctttaaagttgtctatgtgtttatgtttaactatataactagaagaaatatttatttattaggatatgataatggatgtgcttaaagtattacctgtaaggatgtttatggtttttatggcaatgttgtttataatagcagaaaatgagaacaggttaaatgtccaactatagggtaaaggaaaaataaattgtggttaggatgggttgtgaggatccttaaatggctgatatatctttcagcaaaaaaagtaggttacaaaaaatatataccctatacaacataattccatattttatatgcatatcaggggagggaaaaactctagaagtgggtaatcaaaatgttaaaagaacttatctatgaatgagtgctttataactggtctgttcttcaattctcaattttccaaattttctgtgaatgtcctcttttcataatcagataaaaatcattgcactaggctgggcgtggtggttcacgcttgtaatcccagcactttgggaggctgaggcgggtggatcacgtggtcaggagttcaagaccaacctggccaagatggtgaaaccccagctctactaaaaatacaaaaattacccgggcatgatggcgggagcctgtaatcctagctacttgggaggctgaggcaggagaatcgcttgaactcgggaggcggaggttgcagtgagccgagattgcgccactgcactccatcctaggtaacacagccagactctgtctcaaaaaaaaaaaaaaatcattgcactatattaaattataatataatttgatgaacttattgtcaattaaaatgtgtacttaatta

SEQ ID NO: 109783 - DNA, 1049 bp, Homo sapiens
tagaaattggggctcaagcactgggaaagaggtgcttgtcggtttcttttagaggcagatggaggtaaccagcattgttaaaatgttggctctgtgacaggctgcaggccaaacagcagtgaaatatagtgctaacgagccaagatttggagtcaagcctaatcaaattctgtttctacctctaactttgtaaccttaacaaaatctctctaggccttggtttcattttctgtaaaatgggggtcctactagtgccttcctcatagggttgttgtgagataaatgaatacagtatgtaaaaaaacagcacccataacataaatggcctttaaatattgccaattatggtttactagatattttacagttgaggaaactgaggtttggagagatactaatgagtagccaaactggcgctattatcttctccaatggattctcttgctctctttctacttcccacctttcccacagtacgaaatttctgaagattctttcttccaaaacatgttgaatttgtacaacttctctgccaaggttatggctgaccagctccgcaagcctcccagccgagaccagtgagaatgacggggtggacatagacactaggggtggcaggagaggtgggggaaggttcctgggatgggggaaaagggtggcaagactggtcccagaccggcggccccatacccttgcaggaggtagggcagggctgttgggaggggagcagtgtcaggagagtcgggagcctcagcccctcactcttcctccgccaggtggagcatgaccccccagacagtgaatgcctactaccttccaactaagaatgagatcgtcttccccgctggcatcctgcaggcccccttctatgcccgcaaccaccccaagtgtgtctgaagcaggaggggctgggtgctggggcctgggcctgtggttgagctgggagcagggctggaggtgggattcagaagtacccccgccatgtcctcacttgctattcctcacccaccagggccctgaacttcggtggcatcggtgtggtcatgggc

SEQ ID NO: 109784 - DNA, 1096 bp, Homo sapiens
aggtcaatggggagaggctcaacggccgccagacgctgggggagaacattgctgacaacggggggctgaaggctgcctacaatgtgagtggcctgaccagccctccagcggctgaggcctgctggcctggggtgaaaggtgccgggtgggtgggggcaggcctggatgggcttgttgcccactgttctgtccccaggcttacaaagcatggctgagaaagcatggggaggagcagcaactgccagccgtggggctcaccaaccaccagctcttcttcgtgggatttgcccaggtatcaccctctcggaaggcctggggtctgcccctttgtcctgctccctcctgagtatgtcattaggagaactctggggcacgtgtcaaacgggctggtgaatggggctgaggctggggcatgaaaggtgggctgggaaggcccatgcccagagcctccggccagccagggcccacaaaggcagcctgaagaggcctgagcgggagaatgccttggtaggatttcgcatagttcaaagggcaaggttgtcgtgcttgcggggcacagggtggcgaagggggcaaacgttcatcctcacgctgttcctgtgagggagacatgcaggaaacgaaagctcgggacgcagagtggcctgtccagggctgcccaggaatagagtaagtggcagagcaaggacccaggcagagcctccgctgggcagccacagcaggcagcttctggggctccgctttttcccctcgtcatgtccatgctgggcaacccgatgtccagggcagttttggaaggaacttgggaggggctgcagcggtggtggtttgtgcccctgggatggctgtagctgactctaaggcccggctccacactagacaccatatgcccccatgtctgtcctggcccgcaggtgtggtgctcggtccgcacaccagagagctctcacgaggggctggtgaccgacccccacagccctgcccgcttccgcgtgctgggcactctctccaactcccgtgacttcctgcggcacttcggctgccctgtcggctcccccatgaacccagggcagctgtgtgaggtgtggtagacctg

SEQ ID NO: 109785 - DNA, 1475 bp, Homo sapiens
gtggcggagtaaaactcggtaactccgctcgcagaccgcccatctacagcagtgagcgaacccaaaccccacacggccaagtcccgcgggtttcaggaaactccgaagaggtcgggggccaggggcgactatggcgcgggggaggctgggaattgtagtctccacctgcctccgagggcggggtccgagggcggggctctcaggccgagggggtgggtgggtcgccgagcgccccggctcgccccggcgtttccggtcgcaggcgggctctggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcaggtcattgtcacctccgtttcctagagtggcattcaagtagagcctgattcagaacccaggctgatttctcaccagggcttcccattcccactcggtttccttgtccacctggcccctcctaaggaggcaggcttattcttcacctgccccgggtaagtgggaggaggacgtctttgggattccttctcttcatgagctgcttctcccaaccctccagtctgaagaggataaacagcttcaagatgaactggagatgctcgtggaacgactaggggtgagtcacgatgttaacatgattcggtgcatgtttggatctttcccacttgttttattcttttttgaggcaactgctatgtacggtggactgtattttagggtcagtgttatgatgatgttgggaggcaggagagttacaaagggtatttgtacagttttgcagctttctcttgtgggagaagcagagttcttacctcttaacttgggtcatttgtttttgtgccaggcagggtgcagggagttgaggaatcacagatgaatgaataagacacagcatttccttggaggagttgttaagttaaatatctctgtattatgacttgaaggggtgtgactcctttttgtctgagccctgtcgtctcttgatcaggagaaggatacatccctgtatcgaccagcgctggaggaattgcgaaggcagattcgttcttctacaacttccatgacttcagtgcccaagcc

SEQ ID NO: 109786 - DNA, 1055 bp, Homo sapiens
ggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccaggtgagtgaacatggtagggaagggtggcaggcatgccctcctcagcacctctctctcaattgcgcctcctctattttcccagagcatttgctcaagcatagcatcacgctgtagttaatcttttgatgtgtgtgagtttcttgaggacagagactttgtgtcttcttagtagttctaacatctagcacagtgcctggtgtatatagtagatatttattatttattttgggtaagtgaattcatggggaaaatgagtgcctgggactttctgaattctttgttacttttacttttgtagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtgtatgtagggaagaagctggcaaagagataagcttacgaataggacacttgcataaagagctgggacttgtagtttctggttagggcttgaggggttttcctgtgcccttagtggacagtgatgagcagatgtacgggctctctccacagggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggaggtgagactgcccttttttcatcaaggccttttcgtcataattctacctgccatttcacctccctgactctacctctgactagactctccttgattagaattgccattcagt

SEQ ID NO: 109787 - DNA, 1691 bp, Homo sapiens
cttgggggggtataggtagaggatactaagggactagctcagaaccagagaccagttgccatgctgtgtttctttcctgtcctacctgaaaccttctttccttacttttcctctccctcctgttgcagggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggtataattctgttcctgctttgtcttttgttttgctttgatcacttcttttgtcctcttggagtcataagttatctgacaagggatccaccatgcagttctttggagagctctttataataacaggatcctcaggatagggccattttaagactaatagattcttccctggtataggaatgttgagtgcagctgcatctcttgggatgattctgctgtgggatgtggatggtggcctcacccagattgacaagtacctgtactcctctgaggactacattaaggttggtctgcatacagcctgctcatggggacttccccgttccatattctagtgcctagcagtgcctctctttcactgatgaggtctgcccagtttttaactctagttaataagggtgctgcagtgaggcccatgttgcatcctttgcggtgaggaagatagagtatcctgagtgaagaatctgtttgctctttgtagtcaggagctcttcttgcctgtggcatagtgaactctggggtccggaatgagtgtgaccctgctctggcactgctctcagactatgttctccacaacagcaacaccatgagacttggttccatctttgggtaaggttcctcgcttgtctttctggtagtgctcagcctgtacactctggagaacaggaactgggcccttttcacccatattgccaagggctaccactgtgcctattgggtatctggctcttggtgaatgtttgttgaaatggtgaatgaatgaccgattctccttttgttcttttcttgctgcatcgttgggtatgtgttggggaccgcctttccatggcttttgcaggctaggcttggcttatgctggctcaaatcgtgaagatgtcctaacactgctgctgcctgtgatgggagattcaaagtccagcatggaggtgagtagaggctattgagcatttagagtaagtagggaaggtgctttgagtcttactttctgtgataaataatgaaaaagaagtaagtgtgtgcatgtgtgcatacatgtacatgcctgttggtgtgtattgaggggcgtcacctcagtgaaaccccttgatctgggattctaagcctctggtggttttaaggctaaagagttaacattttaggcctggcacggtggctcgtgcctataatcccagcactttgggaggctgcagtgggcggatcacttgagcccaggagttcgagaccaacctgggcaagattgtgaaaccccatttctaccaaaaaataaacagaaaaattagccgggtgtggtggtgctcgcctgtagtgccagctactagggaagctgaggtgggagaattgcttgaacccagaggtggaggttgcagtgagctgagatcgcgccactgcactccagtctgggttacagagtgagacc

SEQ ID NO: 109788 - DNA, 1029 bp, Homo sapiens
gaggctgaggcaggagaatcgctcgaacccaggaggtggaggttgcggtgagccaaaatcgcgacactgcactccagcctagcgatagagcgagactctgtctcaaaaaaaaaaaaaaaaaagcagtgcaggggataacctcaggatctgtgaccttggggctgtcacaagggttaaatgtcaatagtatgtaaaacagttggcctagtggctggcatatagtatatactcaatgaataatgactactattgttattttgatattatgaactaatgttattagggagaatatcttgcagtggactgtaggaataggctatcttgaatcaagacataaatattttaataacttactctgtgtaatactgattttcctacctctaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctgggtgaggggatgtttctatttgggcaaagagctgacagtaactggatacaacagggagggtttatgtgtcaggctgtgctggatggaggcaagtatcctctgaccccttgaatctgtcctgtagggaagggtgaggccatcgaggcaatcctggctgcactggaggttgtgtcagagccattccgcagttttgccaacacactggtggatgtgtgtgcatatgcaggtctgtgtctttatgagtctgtcttgtgcttccccagtgactcctcacttctttcttggtccttattttcaggttgtttctcctttctccttcattctgatctgctctagattctttagacttctcctgttttccaaagcttttccttggtaacttctcatttctgtccattctccctcaccaccctgacgcaggctctgggaatgtgctgaaggtgcagcagctgctccacatttgtagcgaacactttgactcca

SEQ ID NO: 109789 - DNA, 3648 bp, Homo sapiens
ctgggactacgggtgcgccaccacgcccggctaatttttgtatttttagtaaagacggggtttcaccatgttggccaggatggtctcgatctcttgacctcgtgatccgcccacctcggcctcccaaagtactgggattaaggtgtgagccaccgcgccccgcttattttttttttttttttgccgagactttgatttcagtttctcagccctcaaccagcacttcgccttgtacttagcatgcactcaataaatggttgcttaaaatatgaatgaactaaagaatcgcggaacagagagaaacacagaggggaatcggtctgggagtttcaaagttcgggaggggacacgggggcgggctgtggctgtcacgtgacggggcgggggcaaatcccatgtgctcggcggcgcagatcgcccggcgcggctccgccccctgcgccggtcacgtgggggcgccggctgcgcctgcggagaagcggtggccgccgagcgggatctgtgcggggagccggaaatggttgtggactacgtctgtgcggctgcgtggggctcggccgcgcggactgaaggagactgaaggtaaagccgccatgtccgggcccgacccggcccccccaccccctccccccgcatccgccgccatccgggccgggaccggccaccctgcgccgccgccccggcgccctggccccgcggcccgacccagggccccggcccgccagggtcccgatccccggcccacgtgtgcctggcccggccgggcctggctgctgggtgggggtggggagcgcagggccggactatgcgggccccgcgggctggtagggcgccgggttcgtcgccgcgaaatgccacctcggcctgacccgaggaggcccggcagcccacgggcgcaggcaccacggctcccggcccgccgccccctccccccttcgcggccaggccgccgggaagtgacacgttgttctttggcactggcccgcgctgcgcagggagggcgcaggggagggaggcggtggcggcgggcagggaggagcccccggccccgcccgccctccgggccgaccctcacttgcctgaaaccggctcctcgacggccgccgcccgcctggccttttagggcctgactcccgcccttcctggcctacactcctgggcggcggcaggcctagcttctggcccagtgcgggttccccggcggcaggcgtatcctgtgtgcccctgggccaggcccgaacccggtgtccccgggtggggggtggggacgccacggccgaagcagctagctccgttcgtgatccgggagcctggtgccagcgagacctggaatttccggtctggttggtctggggccccgcggagccaggttgataccctcacctcccaaccccaggccctcggatgcccagaacctgtaggccgcaccgtggacttgttcttaatcgagggggtgagtgaggggtctgtttcagtaggtcaggggttggttggaagtgatgcgggtttgacagcatgttggtggggacaggctgtatcttttctgcttcaccctcttggcatctctgggactccgtatgggacccagcccttgcatcaaccctttcaccgccccatttgccttaagcttgggtcccttcctcttcctgagcgccactctttcccaacaggtgctggggggaccctgatgtggcaccaaatgaaatgaacaaagctccacagtccacaggccccccacccgccccatcccccggactcccacaggtaattagggaggaattagcaggggtgggggtgggggagaccaggcagtctccagcctctggatcttcctacccccatctgtgtcagggcaaagtgcagccgcctgctgccaaattgagacagggcccctgggctgtccccgggggctgtcacggggagggggtatgtggattgttaaggctcttgccgcagatctgctccccttatttcaccagcttgggtttctgccccacctgggcttcccctcttgctgaactctggtctcccctcttcagccagcgtttcccccggggcagacagcgccggtggtgttcagtacgccacaagcgacacaaatgaacacgccttctcagccccgccaggtgaggggctgtggggaggggagtaggggacctgggtgggagcagtggaaagctttggccagtttaggtctaggatggaaactggaggccccatacctggccttaatcctctgtgttctttcatgcggctctgcgccttgccctgttgattactcacggtggctggtcccttggatagtatgttgtcaatgagggtggcattactgggatcctagtgcctctgagaattgggggcagtgctttgggccctgctgccagctcttgctttcctatttgctccttttaccggaggctgctattgctctattgctctctctgctttctctttggactgtggtgaggtaaacactccagctggtccttgcctttctctgttccccagcttcttccttactaagtgggaggattcttgtcctgtcttattgccttcattccctccccccgccatcaccttgggggtaattctcttctttcctatccccatgtgctctcagggaggattcaggtctctgcaggtaatatccctttcccaaccctggacagtcttctggtctcatccttaccctccaccctagtcaggggctagacacagggaatggggatcttcagggtagtgacttgtttggtgtccaggttctcagttggaggccgagtgatgcatgttaggggctacatcttgaagaacgcgcatctggggactgggatgctgttgcatgttatggttagctcctcattacatgctggtggagcagtgcatgctggggatatgttgcccgaaagggccttacttaggcatgatgcatctcggtgttaggaagcctctgcagaggggtagtttggtagaggtgacgtgtgtatgcatggcagtgagagagtaaatctctgcaggatgcaaagtgtacatctgaatttggaggtttggagggcatgtgtgtgtacaagaagccgcttagccatttggtcaagtggtcttggaaggattggtcgccatgttctgaagcccacagtacttctttccaggctatagagacattgtggagtggcaattttttgtccacttccttctctttacaatgccaactgctttcctccctcctgacagcacttctaccctagccgggcccagcccccgagcagtgcagcctcccgagtgcagagtgcagcccctgcccgccctggcccagctgcccatgtctaccctgctggatcccaagtaatgatgatcccttcccagatctcctacccagcctcccagggggcctactacatccctggacaggtgaggctgggggcttggagcctagaagccacagacccctatacctctcacttaactcaccctgaccctccagttccattgcttttccagaggtgggacttccttctggtcattgcccagagttggcttgtcttgtcttgacctatgttctttttggagtctgatatggaactcatagctccctcaactccttctctccctctcccccttccccaccaggggcgttccacatacgttgtcccg

SEQ ID NO: 109790 - DNA, 8197 bp, Homo sapiens
gggtgggaggtgtcaggcaggcattagtatatggttgggccctgacgctaccaccattcttctccgtcccccctcccccaagctggcgcctactatccagcccaaggggtgcagcagtttcccactggcgtggcccccaccccagttttgatgaaccagccaccccagattgctcccaagagggagcgtaagacggtgagtagcagtgaggggctccgggacatctgggaaggggagaatcaaggtcaggtgctgctgggacattgtgccggaaagagcagtgacttgaggaggaaggagctgagagtgggcagagaatggtgtctgtggagggctcaggttctttgtaagatgctaagatttcagcatagaagcaggtcatgggaagactgaagtgcctagcgaggaagttcctgcgagacctgggtgctggggggttggaagaactatgcttggttttgggtttctagtggcttgccttggaaatggtttgttttctgtggccccagcccccattcccccctgcccccccagtcctggaagctctcaaggcctccgcctctgctcagtcctcaagccctgggcgtggtgcccagaatagggtgccagagctggggaagccgctgagtcaccctggctccacctactggatctgggccctgcccccagagatcaggcacactagccacaagtgagccgattgggttctagatgggggtcctgggccccagggtgtgcagccactgacttggggactgctggtggggtagggatgagggagggaggggcattgtgatgtacagggctgctctgtgagatcaagggtctcttaagggtgggagctggggcagggactacgagagcagccagatgggctgaaagtggaactcaaggggtttctggcacctacctacctgcttcccgctggggggtggggagttggcccagagtcttaagattggggcagggtggagaggtgggctcttcctgcttcccactcatcttatagctttctttccccagatccgaattcgagatccaaaccaaggaggaaaggatatcacagaggagatcatgtctggggcccgcactgcctccacacccacccctccccaggtactgtctgcttttcgagtgataccctggctgggatgtctgttctgccctggactcccaagtccctggatcttttctttcaactaagggatttatttccctgctttcctggatttctaggcagagctaaagtagaaatggctctagtaaagaagggttgtgggactcttcagtgcaaacttggtaaccctttgtgtcctgcagacgggaggcggtctggagcctcaagctaatggggagacgccccaggttgctgtcattgtccggccaggtaagtaagccggtgggacggagcttttatggggaaagggaatgttaacagttaaatgctgaggtggtggagtgacttgaactgggtaccagagaatgatgacttagatttcaggttgtgggattttgagggtgaattgggttttggatgaaagtggaagtatagcttaggtggggagaagatgatgcggggttattaagttgggaatgcctgggctggaggatggggaggaacaacagcagttaagcacttgcctttagttgctcattcttccttcctatggtgcagatgaccggtcacagggagcaatcattgctgaccggccagggctgcctggcccagagcatagcccttcagaatcccagccttcgtcgccttctccgaccccatcaccatccccagtcttggaaccggggtctgagcctaatctcgcagtcctctctattcctggggacactatgacaactatacaaatgtctgtagaagaatcaacccccatctcccgtgaaactggggagccatatcgcctctctccagaacccactcctctcgccgaacccatactggaagtagaagtgacacttagcaaaccggttccagaatctgagttttcttccagtcctctccaggctcccacccctttggcatctcacacagtggaaattcatgagcctaatggcatggtcccatctgaagatctggaaccagaggtggagtcaagcccagagcttgctcctcccccagcttgcccctccgaatcccctgtgcccattgctccaactgcccaacctgaggaactgctcaacggagccccctcgccaccagctgtggacttaagcccagtcagtgagccagaggagcaggccaaggaggtgacagcatcaatggcgccccccaccatcccctctgctactccagctacggctccttcagctacttccccagctcaggaggaggaaatggaagaagaagaagaagaggaagaaggagaagcaggagaagcaggagaagctgagagtgagaaaggaggagaggaactgctccccccagagagtacccctattccagccaacttgtctcagaatttggaggcagcagcagccactcaaggtaaggtgtggttggacggtagaggtagggcgggctaggggatatcgttccttgccctccttgatgaccgcccatttttgacatgtttctgggtccctgcaatggaatctaagaactagattaaggacttttaagcctaaaaagggtgatgcaaaggggaaatactgttctttggctgctttctatttcccagggattaagggtactccttaaattattggcaaagatccatgcttttatttatttatttttaattagtggcagtatctgtgccaaagaggagacggaaaattaaggagctaaataagaaggaggctgttggagaccttctggatgccttcaaggaggtaagggagcagaaaatgggaggggagagggccaagttgaggtatggagcagtggtcattctgcaaccaaaactggatgttctgttgttctaggcgaacccggcagtaccagaggtggaaaatcagcctcctgcaggcagcaatccaggcccagagtctgagggcagtggtgtgcccccacgtcctgaggaagcagatgagacctgggactcaaaggaagacaaaattcacaatgctgagaacatccagcccggggaacagaagtatgaatataagtcaggtatgctgaagaaagggttgagaatggcttgagttttcttattagggccagaggaggcagtatgattgcttcattctgttttccttgcagatcagtggaagcctctaaacctagaggagaaaaaacgttacgaccgtgagttcctgcttggttttcagttcatctttgccagtatgcagaagccagagggattgccacatatcagtgacgtggtgctggacaaggttagtggcttcagttggggaggggacgataagtttgtgctggatggattggggaggagcctgaggtcctgaaagagtagtcaaccgctctagcctgcttctgagaccttttcctgtcctctttgcaggccaataaaacaccactgcggccactggatcccactagactacaaggcataaattgtggcccagacttcactccatcctttgccaaccttggccggacaacccttagcacccgtgggcccccaaggggtgggccaggtggggagctgccccgtgggccggtgagtggggctgggtaaagtggcaggtgggcaaggagtgggagtggatgattccgtgtctcagtgcccgcggggaggggtttgccctggaggcgtgtagtagtggtgtcacatattgtgctgactagttccatgtcccctcttgtcttcatcccttgcttagcaggctggcctgggaccccggcgctctcagcagggaccccgaaaagaaccacgcaagatcattgccacagtgttaatgaccgaagatataaaactgaacaaagcagagaaagcctggaaacccagcagcaagcggacggcggctgataaggatcgaggggaagaagatgctgatggcagcaaaacccaggtactggcaagtcctgcttttggtctctctccatttcttctccaggtctgccatctgtgccctctttgcttctttttgtccttatcactagcatctgtcatgcctaagtccccaccaccctctcctgtccctcccaacagcctgttctgagaccctcactggaactcttgtctcttctccctccaggacctattccgcagggtgcgctccatcctgaataaactgacaccccagatgttccagcagctgatgaagcaagtgacgcagctggccatcgacaccgaggaacgcctcaaaggggtcattgacctcatttttgagaaggccatttcagagcccaacttctctgtggcctatgccaacatgtgccgctgcctcatggcggttagtttccagtgggttctaaatctaatggtctggttgcccattcctattcccaagactccttgagtccagcttcttggttcccctccaacttgtgcctcttccagctggaaggaggcagagctggggccagagatcttcctgggtcaggtagttaaaggctcttggagggccttccctgcccaggactagtcttgagtgtgacattctctctgacctacagctgaaagtgcccactacggaaaagccaacagtgactgtgaacttccgaaagctgttgttgaatcgatgtcagaaggagtttgagaaagacaaagatgatgatgaggtttttgagaagaagcaaaaagagatggatgaagctgctacggtgagagaaaacccactatcgattccactcaccacttacctccttcccttacccagatgctactcagctgtagaatttggaatggaggtagtggtgtcttggggatttctctggctcaggacgttttttttcctttttgagacagtcttgctctgtcacccaggctggagtgcagtggtgtgatcttggctagcctccacctcctgagttcaagcgattctcctgcctcagcctcccaagtagctgggattacaggcatgtgccaccatacctggctaatttttttgtatttttaatagagacggggttttaccatgttggccaagctggtctcaaactcctcctgacctcaagtgatccgcctgcctcagcctcccaaattgatgggattacaggcatgagccactatgcccagccagccggcctcaggactgagtgcttattgctaggtttggatatccaggtagaaaagggttttagccgagtggctggttatctttttgacacaatccctgtcctgtgaatggcaggcagaggaacgaggacgcctgaaggaagagctggaagaggctcgggacatagcccggcggcgctctttagggaatatcaagtttattggagagttgttcaaactgaagatgttaacagaggcaataatgcatgactgtgtggtcaaactgcttaagaaccatgatgaagagtcccttgagtgcctttgtcgtctgctcaccaccattggcaaagacctggactttgaaaaagccaaggtagaggtccttgcatctggagggggatgggctgaagcatatgtggggctcactgagcccacaatgatggggcggaaggcctgaggaggggtggggcctgcagttataggtgggacatgagaagttcctggtctgatgcctttctccttcctagccccgaatggatcagtatttcaaccagatggaaaaaatcattaaagaaaagaagacgtcatcccgcatccgctttatgctgcaggacgtgctggatctgcgaggggtgtgtgtccccctcctccccactgccagcctgctgcctccagtttctgacactgccttgtcttgccttccctgacatcatcgtgactggccctctgtctccacagagcaattgggtgccacgccgaggggatcagggtcccaagaccattgaccagatccataaggaggctgagatggaagaacatcgagagcacatcaaagtgcagcagctcatggccaagggcagtgacaagcgtcggggcggtcctccaggccctcccatcagtgagttccaagctgggattgagaagggagcagtgaagggaccgggaggttatactttcctctgatgacttcctgttagtgccacgtgtctgggccactgagacaccatgatggaactgaggatctgaggaagggaggctgggggtggcccaaggggaaggggctgctaggatttattcattattccagtatgcccctctttttgtgtcaggccgtggacttccccttgtggatgatggtggctggaacacagttcccatcagcaaaggtagccgccccattgacacctcacgactcaccaagatcaccaaggtaggggtgtgtgtgggagtgggtgattcagctcaggtttagatcttagtcccttcacttttctaaagttgagaaggtgacagctgaatgtttcctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctacagctggtttcatgctactgtggcagaattgagtagttgcaatagagactggccctttattaaaaaagattttctgacccctggactgggccattcactacctgtttggttgcatatggtggtgctggccaagggactcagccgggttggacctatgattctactccccttttcttcttcagcctggctccatcgattctaacaaccagctctttgcacctggagggcgactgagctggggcaagggcagcagcggaggctcaggagccaagccctcagacgcaggtatggaggcagtgtcaggagctgggtggttacccgtcagagctcccttgaggacagagccttttctgttagggaggccttcagtacaaggtggttaggcaatgcgggcaatagaggaggtttgtgttgtggttccagggattgaactgctttacttttgggactgggaccaagtgtcctaaactggcaagtaggggataaaatgcaggaaaggagaaaaagattttaatacggattttctgcatccccagcatcagaagctgctcgcccagctactagtactttgaatcgcttctcagcccttcaacaagcggtacccacagaaagcacagataatagacgtgtggtgcagaggtgaggtttcctggacatctttgttattcacactgggggtaccgtgattgggttctggttgttgccataggttggaaatttcttcatacctgtcctggttggagcccttgggttagattggggcatactcattatgctaagaacaaggcccaacagttgctcagcatgttgtgtaattacatgagtgcctgggcagtgcaagtgagtgaaaatttgtctgtctgtcttccaggagtagcttgagccgagaacgaggcgagaaagctggagaccgaggagaccgcctagagcggagtgaacggggaggggaccgtggggaccggcttgatcgtgcgcggacacctgctaccaagcggagcttcagcaaggaagtggaggagcggagtagagaacggccctcccagcctgaggggctgcgcaaggcagctagcctcacggaggatcgggaccgtgggcgggatgccggtgagagtctgggagaggaatggagggaaaggcattggctgccttgggactagctggtccccagctttttgagagctccaaatcttgtttgctgggaagactgaaaagtccctctaatctgtgttctcttcccacagtgaagcgagaagctgccctacccccagtgagccccctgaaggcggctctctctgaggaggagttagagaagaaatccaaggctatcattgaggaatatctccatctcaatgacatgaaagtaggcagtgggagcggcgtgtgattgaggagtgggcagggagggatcatgctggcaggcataggggtccggggtctgggtcagacagtgactggtctc

SEQ ID NO: 109791 - DNA, 1124 bp, Homo sapiens
ctatctcctttttgggacccttggaaccttgcataagagtgtaggttccctggccgggtgtggtggcttatgcctgtaatccctgcactttgggaggccaaggtgggttggattccttagaggatcacgtgaggttgggagttctagaccagcctggccaacatggtgaaaccctgtctctactaataatacaaaaattagccaggcgtggtggcacagtaatcccagctactcggaggctgaggcaggagaactgcttgaacccgggaggtggaggttgcagtgagccgagatcgtgccattgcactccagcctgggtgacaaaagcaaaactgtctcaaaaaaaaaaccaaaaaacagtatgggttccttgaccatcctggtcagcataactttagggggttaagcggggtgaaaaccatctaaggacacagaggtggccttagcttgaaataattgtccccatgtctagaaaatgttcctgggggttccatagttgatgccctagccatgccacgttgccccagaaggagagtggggacctggcctagaatgtcttgactttgaattcccttggcaggttgtatgaaatcttggaattggctgaggacatggaaattgacatcccccacgtgtggctctacctagcggaactggtaacacccattctgcaggaaggtggggtgcccatgggggagctgttcaggtaagtccccctgggtggaattcaggggaggtaaagaccagaggaaaggtggtagggaaatggctgggttggataccctggtttggagggagatggagtagtggtgagagaactgtggaggctgtcagcattaggtttttctcttcttgtagggagattacaaagcctctgagaccgttgggcaaagctgcttccctgttgctggagatcctgggcctcctgtgcaaaagcatggtgagtgagggccaggagtccagagatgcctcccacggtgtggttttggctgtttgctgtggccctgaagcttcatggtccattggtggagtggagtgatggtgatgacaggattgtgttggtacctgggagaggaaatactgaggtgggccatctcccgcacaccagttcctatcatgagttc

SEQ ID NO: 109792 - DNA, 1038 bp, Homo sapiens
atgaataaaacacaagaaacaagttggtagagaaaaaggaagaaatgggccgggcgcagtggctcacgcctgtaatcccagcactttgagaggccgacgtgggtggatcacgaggtcaggagttcaagaccagcttggccaatatggtgaaaccccatctctactaaaaacacaaaaattagccgtgttgtggcaggtgcctgtaattccacctactcaggaggctgaggcaggagaatcacttgacccgggaggcggaggtagcagtgagccgagattgtgccactgcactccagcctgggaaacagagcaagactctgtctccaaaaaagaaaaaagaaatgacagcttgataaaaacaacagtaaagcgtgacataaaacagttgaaatagagtggagtatcttaagtactgtggggttgcaaaggaatatttgacaatatttgtgacaggaggctttcagggtgctgaagcggctttgtgaaagttaattggtaactagcgaatataaaggtaaagagatggggaaaggtaagttgaatgtggtacttagtggaagtgagaagttggggtgagtgtgtgcagtttcaagggttcagccatctggaacctggaggaatcacacttgggatttaaaggaattgttatgtcaacatcatttaattcttttaaatagacgtgtaccaggacaagttgttttttaacaacaaataagcatattgaactatttgtgtatttcatcaactccaaggtgccatagattataagacattctttatgcgctgttaagaaagaaaagactgggccgggcgtggtaatcccagcactttgggaggcagaggtgggtggatcacgtgaggtcaggagttggaaaccagcctggccaacatgatgaaaccctgtatctactaaaaatacaaaaaaattagctggacatggtggtgcgcacctgtagtcccagctacttgggaggctgaggcaggagaattgcttgaacccaggagggggaggttgcagtaagccaagattgtgccact

SEQ ID NO: 109793 - DNA, 2608 bp, Homo sapiens
ctcagactgctggttttatgaggattttttatttgtgttagggatggggtatatttgtgtcttaagattttctgggtttaggaaacaagcatacttgttagaagttgtcccttcctagaggcccttacatcatttttcctaccctagtgtcatagcactttggtggacaagttctcttttattttattttattattattatttttttgagacagagtctcgctgtgtcgcccaggctggagtgcagtggcgtgatctcagctcattgcaaccctcgccttgggttcaagcgattctcctgcctcagcctcccgagtagctgggattacaggcacccaccaccacgcctggctaatttttgtattttctgtagagacggggtttcaccatgttggtcaggctggtctccgactcctgacctcaggtgatccgcccacctcgacctttcagagtgctaggattacaggcgtgagccaccgcccgctcctgggacgagttcttatttatttgggtggttatttgactgacatctgtgccctgcaccagaccgtaggaatggaagggctttgcctattagtatttctatagcatccttaatgcctagcaagtacctagtaggctttcagtaaatatttgttggattaatgtggtagagctgttgggtccttggagagagagagctttggtaagctgggttggtcttgtgttttccagggtcctaaaaaggtggggacgctgtggcgagaagccgggcttagctggaaggaatttctacctgaaggccaggacattggtgcattcgtcgctgaacaggtttggggatggagttgggttaattctagcatttgaggctggccagtcttctttcttgtctcctgttggcaaccttacctcttaactgcgggccttttccattgcagaaggtggagtataccctgggagaggagtcggaagcccctggccagagggcactcccctccgaggagctgaacaggcagctggagaagctgctgaaggagggcagcagtaaccagcgggtgttcgactggatagaggtaggtttctcctggatatcgataaaggaaaggtagttcttagggtgggggtgggggcagcaagaatgaagactgaagggcccaattcagaatctggggatcatttgtttctcccatacaggccaacctgagtgagcagcagatagtatccaacacgttagttcgagccctcatgacggctgtctgctattctgcaattatttgtaagaggaaccagggagatggaggggcaagggtgggcctgacagacaagtggagggaggtgggtgtcagccttggcctcccagttctgaaccggggtaagggtatattgctccactcatccctgtcttcttgtagttgagactcccctccgagtggacgttgcagtgctgaaagcgcgagcgaagctgctgcagaaatacctgtgtgacgagcagaaggagctacaggcgctctacgccctccaggcccttgtagtgaccttagaacagcctcccagtaagagccaggccatggggacaggggtggggtggagggactgccagatagcagggcatgagacccttcatggaagggtcttaatccaagaaaggtaggtagtcattagagagcaaaatgccctctgggtttcattctttccttttacgtttgtgttgtgttgttcctacaagtggaaggagttagacacagccttgaagggtaattgcctgttttgtgcctagccatgtgtttgatgccaacagtgcagaggtgataaatgataggatcttcccagtaccgtgtgcccccacggcgtggcacagggctgaaatgctttgcttaccttgcctcatgtagtcctcacaaatgttgtttagggtggatggtattacccctattttccacatgaggagactgaggtctcagtgaacatgtctcaggttatgcattcagaacataggtatgtgtcagggcattggcatgctcacagagaggaagccgagcaatttcctgtgctggcctggagttagtactggcgtgagcaatgagcctgggaagacgggtgctctcggagggaggacacctggtctgaggggtaatgagtggtaattcactccacaacaactgggaaggggagggggagaatgtttgaagcgaaggcactatgtgtgttctttctacctatggtaggaagaacttgacacagggaaaagaactattaaagaaaggccagtgtgggagagcacagcaaccagtcctaagtgaggcaagatggggccgaagagagggatgtgggcctgaccacacagggccgggtgtaagccatggccagagtctggggctttagcctgggggcaagaaaacgcctttgtgggattttaagcaaggaataaaggaatttgattttagtttttagatcatcttggcaatagagggaagagtggtttggaatggggtgagagtggatgtggcagtgttagcaccagtggctcagccttgctggtgatggtggagaggagtaggcagatcaagagatacttaggaaatggagttggcagcttttggttacactggtctggggagggggccgtg

SEQ ID NO: 109794 - DNA, 1593 bp, Homo sapiens
gacacgaggaagtttccggcaaaggatatagcatccacaaaagtgtcaaggccagagaaggtgtgtatgtacaggaaatgtgtggggaaggaagggaaattgagatcaggagttgtcaggatctgtttggggggcagtgaatgttcaggttacatgtaggatatatataggactttatgtatgatatatataggacttttagcgatttcctgaattcaggagtaccaattctgaatatagttttctccattaaatacatcatgggcagagaggtttcaggctgccaaggtgaggccaagcaagtttgtaaggtttttctgatggccaagtgactcattgctgtgcagcagtctcagatcatgagattagcatcctgtcagaggcctagtcactctggaatggccacaaatgtcaggctggtgcatcagggccttgtttgaacagtggaacttgggagggttccctggggtgggctggggtggcggtggccagtcacctctaactgctgtcccgcctgcttgcagacctgctgcggatgttctttgacgcactgtatgacgaggacgtggtgaaggaggatgccttctacagttgggagagtagcaaggaccccgctgagcagcagggcaagggtgtggcccttaaatctgtcacagccttcttcaagtggctccgtgaagcagaggaggagtctgaccacaactgagggctggtggggccggggacctggagccccatggacacacagatggcccggctagccgcctggactgcaggggggcggcagcagcggcggtggcagtgggtgcctgtagtgtgatgtgtctgaactaataaagtggctgaagaggcaggatggcttggggctgcctgggcccccctccaggatgccgccaggtgtccctctcctccccctggggcacagagatatattatatataaagtcttgaaatttggtgtgtcttggggtggggaggggcaccaacgcctgcccctggggtccttttttttattttctgaaaatcactctcgggactgccgtcctcgctgctgggggcatatgccccagcccctgtaccacccctgctgttgcctgggcagggggaagggggggcacggtgcctgtaattattaaacatgaattcaattaagctcactgcctttctgctttatgccctgctccctctagagaaggtgtttataggtggggatccttcccagagctggtactgtagcgctgttccctgtaacctggcacccctcctgcctcttcccctgtccatgattgcagggatctgaggtttcctggaaggttgggccctcagatgggcttgataggtgccttcctggtccggagaaaagggagattagtgataggacatccttgctaggctctgctctcctaccagaatgattcaagcccctgtgtggggaaggcttttgggtttcgggttgtttatagctggagaatccctttatggcttgaaggtgtcatctgtaaaatgaaggggctggatgcatgaagggaggttttgcgaccccgtgtagtgtgactgggctggcttagtgagtgttcgccgcccctgccttcag

SEQ ID NO: 109795 - DNA, 1118 bp, Homo sapiens
caccaaccttgtcctgggcccctgtggcctgtcatttagagctgcccctcgtccatcaagtccaatcgcttttctccccacactgcagactcacactatcttctcactgctgggagtggaccatgcttatgtcaccagtattggcagactcattggaatcgttactctaaaggaggtgaggtgatggtggcctccaaagctgctccacttccaaaaagtcatggaggcttatgtccagctcacctggggaggaaggcggggaggagtctgacatctgggtccagacatctgtccctctcacctttccagctccggaaggccatcgagggctctgtcacagcacagggtgtgaaagtccggccgcccctcgccagcttccgagacagtgccaccagcagcagtgacacggagaccactgaggtgcatgcactctgggggccccactcccgtcatggcctcccccgggagggcagcccttccgacagcgacgacaaatgccaatgagcccctcgtgggtggcctaggatggtgctagccatgcccgtcagcccagaatgtgcatctttcattccttctgccttcggaaggcaggaggcagctacagctggaggctgcaccccagccccctccagacctggggtgccagcttctcccagttcatcctacctggaatctgacccactacccacctgcaacaagtcttccagaggcaggaagataggccctgccctggcaggatgggttggggtcacttgacccctgctccccctttgaggggaaaggggtggaactaagatgggtttataactggaacctccaatgaccagatgtatatagagatttacaaagatttttatattaatttaataaaacaaattcttaaatagaacaaaataaacacctaatgagccacttatatatagaatgcttgtgcccgttggctctcgttcttaccttgggccctcttacctgccaaagcctacaaggcccttaattctaaagccacccacccttcccacaaccataaaaacgtacagtccagtgaccttggaatgcaggatctgccagaggcctccactacgtgggcattaacaccctggctggggtggggccctgta

SEQ ID NO: 109796 - DNA, 1067 bp, Homo sapiens
cttcctgcctatgcaggtgaacacagaagactcagccttcccagcagcccggggggagacccacaagcccctaaagcctgcactcaagagggggcccagtgtcaccaggaacctcggagagagtcccacaggtaagcccatgtctcctgtgtccacagagcctcagccaagctactgagatccattagagtccctgcccagccctgttgctggggtacatcccagctggaagaggctgcccacatgggccagggctggaactgggatacctctccctgtgtcttccttacctttcctggtcctctccccaaaagatgacattgccccctggggccttatgtttgggaacacagggagcgcagagtcggcaggcatcgccctccggagcctcttctgtggcagtccaccccctgaggctgcttcggaggtgagtggctggagcctgtcctcctagcttgctttttccccagctccctctccaatgctgagaccacgtcattaaccctgcagtgcctgcctctattctccctgcccttcggccctccctgctgtcagctcaggtcctgtggcgtgccctttcccctgggctccaccacttcccctcacctcccctctccctataacctcaactcctcatctttctggtttggctctaacaaaactgaagaagttggaatcctgtgagaagcgcaagctgaagcgtgtccgaatctccctggcagtaagtatgcctgctcttctagcatctcggcggcaccgggcagggagggcagggtctaggctggataaactccagagcccctagctgccagcctccctccctctctactagagtgacgcggacctggaaggcgagatgagccctgaagaggtaaggtgccactggactctggaccctgtttcttcctggttgtgttcaatcatcatgttggctgctgtccccatgggagggaccacggggttggaaaaagggcaggccagctttcagggaggtgaggtcagctacaggcaccttctccctaaacctcatagtctcttcccctcagattctggagtgggaggagcag

SEQ ID NO: 109797 - DNA, 2032 bp, Homo sapiens
tgggactgacatccttcagagagagggcagccagctgaacctgctccctacgcacctctggtcaactttacaagtgaccccagcttcccccaacattgaccttcactctaagtcactgcagagagacaaagagaggcagaaacttctccaccccatcacacaatatgccctgatgggcttctgagggtggagggtggaataacaactcggagggccccaagggagggcttggaggatggactttctgctgctgctacccacctacagagtcaggggctgacagaaaggtctttgggtcagacccctgctcttagaataaccccagtccaccatcagccttggggctatcgtatcataaacagcaaaggagaccttctgtcaggactgagtgttttcatgaaagagccaaggctctgctctgacctcagccctgagatatgcgaggccacccagcccttggccacccacgactgatgtgaaacctacgactctagacgcctgctcttcccggctctggtgaccctgctcatctccacgctgaccttcccccctggctttggacagttcatggctggacaggtaaccacaggcagaacaggagttttgtgctttcccttggaaggcattcctccaaagccaacagccccagtgtgactgtgggaccccttgttccccgtgggatcccatggcctcttcccttcatcctgtcggtttcccagcctgaggcaccctgttcactctagctctcacagaaagagacgctggtcaccctgtttgacaatcggacgtgggtccgccagggcctggtggaggagctagaaccacccagcacctcacaggcctggaacccaccacgtgccaacgtcttcctcaccctggtcatcttcattctcatgaaggtgggctcctcacgtgtacactgctaacctttacatagcttgcccttctaagcacctgccacgcagtgctcactcctcgaagcctctccacagtgccatgggaaaggcactattatcacccccgtttgaaagatgggggagtcgaaacacaagtagctggcccaaagtcacacagctagagggcagagcgatgatctgaacccaagccatctgcttccagagtccttccccttgccatcacctgggaggcctgggggtcccagggtagctaggagggttacggggtggctgggagggttacgcccacctgatcagcgaggtagacttctcctgggtggcgctgtgggctgcctggggccaggtggagcctcttcgcctttgaaccaccccctgcctgcagttctggatgtctgcactggccaccaccatcccagttccctgtggggccttcatgcctgtctttgtcattggtgagttctcagctgcctgctcacccagcctgcaccttcctcagcctctggccacccccccagccaaccctctgcccaagagcgggtttttggtccagccctagcccgaaccctgaccccacagggctgtgccctacactgaatgacccgttggcccctccctcaccctctgaccctctctcttcctagtgccccctgccctccccctccactgcctctttctcttcccacccccctccctgaaggagcagcatttgggcgtctggtgggtgaaagcatggctgcctggttcccagatggaattcatacggacagcagcacctaccggattgtgcctgggggctacgctgtggtcggtgagtgcctcaggtcccatcggccttgggagacccccccacccacgccccagccacagggtccgagactctggtgccccctgctggcagaaaccaggcttccctcagatgcacaggtccaatcccaggactgtattgggcagccctgagggacccactcaggacctgccctggttgtggagggtcttctgggacctgggcaccctgaggagactgagtgtgactgtccccaggggcagctgcgctggcaggagcggtgacacacacagtgtccacggctgtgatcgtgttcgagctcacaggccag

SEQ ID NO: 109798 - DNA, 1022 bp, Homo sapiens
ggactaaatgacatcatgtttgtaatgtgcctgttgttataatgctggcatttagttaccagtaaccatttttttttttttttttgagacggagtcttgctctgtggcccaggctggagtgcagtggcgcgatctcagttcactgcaagctccgcctcccgggttcacgccattctcctacctcagcctcctgagtagctgggactacaggagcccactaccacgcccggctaatttttttgtatttttagtagagatggggtttcactgtgttagccaggatggtctcgatctcctgacctcgtgatctgcccgccttggcctcccaaagtgctggggttacaggcttgagccaccacgcccggctgaccagtaaccatttttaaatgggatcttttatattgttaattactgttaagaataactttgctgctattgctccatagggctgaccagtttgagtatgtaatgtatggaaaagtgtacaggattgagggagatgaaacttctactgaagcagcaacacgcctgtaagttacgtaatcttgtgaggattcttttcctcttccatgttctgagactttgagctatgctcctgcttcctctgttgagtccctctcctcaggcacctcagaccgaggtgggaactagaaagaaatagttctgggagcagtttccagtctgaaatgtagactgccctttgtcaggccctcctggcccagtggtccacatgagaaactgattatctcactgtgtaaagtgcaaaggagacttgcttccccaggaataaatgcagcattaagtgattagactgttaggctttgtgtgtgtgtgtgtgtgtgtgtgtgtgtgtgttttgctactctgtaaaaggctgtgtgtgtgtgtgtgtgtgtgtgtggctactctgtaacccaatccctagttccttggttttcctgtccagctattttttcttttctttaaagtcttattaaaacaatatgtgctttttgtaagtaatttgaaatgcagaagagtaa

SEQ ID NO: 109799 - DNA, 1118 bp, Homo sapiens
catttgaacattcccctgatttggggcatctaggtgttttccaccctcgataatataaagaacagtgccttgcacatatctgtgcattgatgtttgtcagaattttggttcctagtgacaaaacagtaggaagatgcctcttctgtttcttaggctgagatggaacagtgccttgcacatacctgtgcattgatctttgtcagaattttggttcctagtgacacaacagtaggaagatgcctcttctctttcttaggctgagattgagagctgctgagtggcagtgctccagaatcacgggatggggccttctgtttcagctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtttgtctgtggtgtattgtttctggcccacagccagctgatcacttgtcaatgtaggatctattccagccttttggtatctgggttcagggttatctcagtctcctggctgactgttctcaacatttatcctccagtgtggttttcagtctgggagagagttgtgcttttggctcctgagggtaccccaggcccagaagataccacccatttggcgcagaattttgaattggcaaggagccctgctcatgtccttccaacactttcagtctcttaggaagtcagttcatgctgacttgaatgagtcacttgcatagtctagaaatgttcattatttttatggaagctttgggtagaggcttttagctacaggcatgggagat

SEQ ID NO: 109800 - DNA, 1026 bp, Homo sapiens
acatggtgaaaccccatcggtactaaaaatacaaaaattagctaggtgcggtggcacacgcctgtaatcccagcactttgggaggccaagccaggcggatcatgaggtcaggaattctagaccagcctggccaacatggtgaaaccccatctctactaaaaataaaaaaatcagctgggcatggtggcaggcacctgtaatcccagctactcgggaggctgaggcaggagaatcacttgaacccaggaggcggaggttgcagtgagctgagattgcgccactgcactccagcccggatgacagagtgagactccgtctcaaaaaagaaaaagaaaaaacagagcctaacatgagacccctacaactggggagcggggtggcctggggtctagtttcacctgggaaatctggaaggtgacaggagggctcaccagctgctctggtggggctgctgccacctcactgggaccagcctgcaccctcagagttttttctggggtagggaggcaggagagtttcttctgaacagacgtaggtcctgtggcagagagagcctgcaaggactccctgtcttgagtctatgtagagggatcctagcgggagaaggttggaactgaatgcccatgggctgaggatggggtctcagatgaccacccgaaatgagattggacttgagacacatccatagataaaagaggattttgggagaaaggctgaggcggcactcagccggtaacttgagtggagggggtgtaaaatcactccatgaaaaagaggcaaaatttaacatctgcctgccaagacagtctgaagccaattctatggtaactggctcggggaggccaagtggaacgagagagaagacaaagccctctccattgtgtccactggaggttcccagctggccaggcacaagctgggggaagagagaaggatgtaaggtaaaaataagctcagagttttgatgaatacctcacattaaagttccaatttctggcttgagactgcgtttgcaactaaaagcaa

SEQ ID NO: 109801 - DNA, 1134 bp, Homo sapiens
tgacagatcgagtcccacgggtggacacatgcaaattcagactgacacaccgaggtctcgcccacactcgcacacactcacccacatgtgtgtgataggatcgcaggcgtgagaacccagtgtggggctttgttgttgattgccttgagggtgtgagccagggagcctgttctagttgccagatctgtgtctgggtctctgtgtcgtagtccaggagaggcgacactggtacacacacactcatacacttacggggctatgtgtcacctgtgtgtgtcgggccacaaggcccttgttgtgggtgtggtgggtgctggtgctgagtgtggagtgggagtgtggtttgggtcaggtgcacaggggctacctgaggaggctcacttctccctccccccttcccttcctttctgtctttcaaccctcatcacctactggaccctcaggagtccaggccctagcaggagcccaagcttccaagcctccaggccaagcagctggggggctgtccagaaggccgagtcctgatgtgctggggcggcccgggaagagggggcagcaggacctttcgttccccattcccggcctgcccacctcccctccactgtgaagtgggagctagggctactccctggctgtgaggccaggccagcatgggatgcctctgggaagcagcggtgcctacaagggtggtttcaccaattccttcacttttgcaatacctcagactctctggtctccagttcgtgcgtgggagaatgtgagggaacaaatgcaaggtgctgaccccagcgcagacattgcacctacccaccctctggctctccctcactgggagacaggataggaaccgcaccgacctcgcagagttcttctgagtactgaattcttaatgtgtgcaaagtgcttagcataggcattgttattcaaggattagctgttattattattgttaccctagggtctgctccttggggagcttcaggagtgaaacgagtgtgtgcccttatcctgctggagggaggttagagggaggaaagatgaaagggaaggttggtgcagggggctgggggtggggctgtctgccccacatctccctgcagctccagagagggaaggaatggggagagagctggc

SEQ ID NO: 109802 - DNA, 1044 bp, Homo sapiens
ctgccctcctgccccgctgcacactctgcgggcccagccctggtgctgacctttccttccacctctaagtccctagtctggaatttgggctgaagccttgctgcttctgtctttagttgttttgtgtttctgttttttgttttggcttgtttttttctgttgtttgtttgttttctgggtctcaatgacacttttgctcccagggtgctatggggcctggccctccaccagggcaggtggtaggccctcagctggtgcccctcccacaggccagggtgcccatgatgtcctcctcatgccctgctcaaggtcctcgacctgcaagcggaagagccttgcccagagcttctgaagccaaatctcttcagggagctaccctctaccaagggctcaggggccctggagacagtgccattgtgctggcagggaagtggcttgttacttgggcagcggctatacctggggaggccgcacccagccacacccagaatcatcttcatgcccctgctccaccccagcctcgtgacctgactgacagctcctgcccaagccaggacaacaggaagcagggctggggctgtttccctacacctctggctaaggctgccccagcacctctgcttcccttgcaagagtggcccatgtggctgccctgcctgagcgagaggcaccagagtgttgggggcaggatgaggggtaccaccctctcccagtaactcttcctctaccccactggaagacatcccataaacagaaccatgcttgcagggtgtgtgtgtgtgtgtgtgtgtgtgtgtgtgtgttgcgggtgcatggaggatgcacctctgaggctttacacaaatctaggtattgatacttacaccatgtcagggtgctcctttgcaggggctgtggcatatttcagtgtcattggacatctgtgactttgcagctgattgtagtttgtgtgactaaaagcatgtcgccaagtctatacagggaaactggtgtttgtgtttgcactttacaccgaagactgtgtgacttgcagctggtgatagc

SEQ ID NO: 109803 - DNA, 1036 bp, Homo sapiens
ggctgagcgatggccaagggccgatcccctccctccctccctctctcgctccccagaaattaaacagaaatgaagagcctccctgcctccctcgctccctccctccttcccgccgccgcctctccgccgtcccctccctccgctccctcctcccggagccagcgcagggcttgttttaaactgtggaggaatctggctggagggggagggggctgaatatttgggtttaaacagttccagatgggtttggcacaggctgagcagaaggaagtgagggagagggaggagggaggcggcgcgagggagcggctggagccccggcctgctccggcgggcggaccggcgggcggaccggcgggaggactggctgcgggggcagggcgcgcttgctctgccggctcccgggactgacactcgcgctgccggctggggacgaggccgcctggcaacctccctctgtccctgtctcctcgggcctccgcgtctctcggtctccctgtctttgtagtcagccgccggccatcccggctgtcggatccccgccagccggctccgcacatccctccggctccgtgccgcccaccgcccgccagctccagtcgctgccccgcccgcctccctccccgcctgtctctgtgggccccggcttctgagcatctcggcttccctcgagtaccccccaggccgaatgtctgtgtctgtctgtctgtctgtctgtctgccagaggccaggatcgctccccttacagccgggccctcaggggaccaggggctgcggcagcgggaggagcctccctccctgcagtgaatggctgctgcctgcagcccctttgcctgacatggcggggggctggggtcacagctgccttgtccacccacggggtcctccgccgtcctcggctcagacccagcctccgggaaaccactgaaggctgcaagcctgtggccgcggggtttgggcttttccccacttgggcacccagaggggatgatgtagaggcctccagaggtcctggggcaaccctgccccattcca

SEQ ID NO: 109804 - DNA, 2467 bp, Homo sapiens
gggaggcagatgacttgtctcaggcctgccctccaccctgccaccctacaggaagcagcgacacggctctgattcggagtacacggagaagctgcagcagtacagtgagtttgtccccgccgccctccccaagctctcccagccccctgcagggctctcagacacccttctccctgcctgggacttcattccttagagataaaccctgaatgccccctcccacttccagtcaagtggcatttcctgacccctatctcactccgggtaccctgggcccctactcactcctgctagccccagaaatgactgagacgtgacctctccccctaaaggcagttagtcctgtgggaaagacaagatgcaaacacacaggaaacaatttgagaacaattaagggttgagctgggtgctcctgttgtaaagggcactaagagtttagagaagaggaaggcttcctcgaggaggtggacttgagctgagccaggcgggatgagcagggtgttgggaggtgagggagagcattcctggccagaggagcctctggaaggtagtgggcggggtggggaaggagcccaactgtgggggcagcgagaagactggtttgacagctgctgggaagccaggctgggtagctgtggccagccctcggagggtcctgaaaggcaggcagaggagtctggacttgactccaccataggtaattggaaaggctctcaagctggggagtaatacaatgaaaggattgttttaggaagacagcggtatgcaggatagctcggtgggaaaagtccagaggcagagagcccagctgggaggctattggaatagtgtgagtgttgaaggcctggacaaggtcggggcagtgggaaccaggggaggcatgaatctgagagaggtctggatgtgatgagagatgagagagaaaaactaggagtagaatcctaggtgtctagcctttatggtcaccaggagttctcatgggagctggaggattagggcagcaacacagaggaatatggggctgggctcagcagggagcctgctggagctgtgcccatcgcagggagaggctggcttgacgttaccctctcacgcccacctcttctccctccagttgctcctggaatgaaggtttatattgacccttttacctacgaggaccctaatgaggctgttcgggagtttgccaaggagatcgacgtgtcctgcgtcaagatcgaggaggtgatcggagctggtgagtctcccggggcacagtagagatgagaagctgaggcgggctgggtacaggagtgagtcatagcttgtgccctgtgccctgcaggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccgggtaagagccagcccccaggccctctccctcccccagagagttggattgggctcaccatcccctcccacaagtcagacagcccctattcaagtccataagcatttactgaggtggcttggtgcagggaaatggcagggccttcatagccataagtatgggagttcacatcttgactgttccttactgcctgtgtgacctcaggcaagtgacttaacctctttgagtctcagctgcctggttgtagaatggcagtggtaagagctagtgggtcctcatggggattaactgggatgttgtctataagatacttgacacatagtagggcagctcacttaccctcagggcactctggacatggttgcaggagagacgaggtagagtctgagtactcggagagggaaggcaggtgggcaggccatgggctgatgggagcaatgggctcacctgagcctgcttgttgcctgcagctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctggtacaggaagccgctgggagggagactgggggcggggcctatcagccaggggctcgggcctggggggcagcccggagtcacagggtgaagggcctgtgcccccctcaccagggcgggaagatccccatccgctggactgccccagaggccatagcctatcggaagttcacttctgctagtgatgtctggagctacggaattgtcatgtggga

SEQ ID NO: 109805 - DNA, 1054 bp, Homo sapiens
tattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgattctcttgccccttcttattcctcctcccaaagcaagattccctgattcagagttcacagtccctggctgccaacccttcgcaactccctggaggcattgggaaaccagatctgggcccatccaggctcagtttcccctttgtgcttggccctcactgctttgaacacctaacgcacttcttggaagtgggtcagtggcaacggagagctaactaccccagagctccttccttctaaggcagagaccttcctggggtgggggcaggctcttgtgtctggatggtgttttactgagtcggttcccagcctttgtctttaagggagctgagggtagagggggttgatcagttcccagggtcacatgaccaaggacaaagggaaggagagccactggtgttcagaggctgaggcccggaagttcggctgctcctcactgaggcttcctatgcccaggcgct

SEQ ID NO: 109806 - DNA, 1085 bp, Homo sapiens
acaaaatgggggtgctttacaggaggatagggtgggaggaggtaggatcggtgagaggttccatggccgtgggttatcaggaatagctagctggggagccttctttaaataagcaggccccctccacttcttagattcttgttagaatgaataggaaggcttctggcctctgcaccatccaccctctaccatactctactttcccctactgaaaaaccccaaaacccaagcaaaacaagcatggatgttagcttgtggtgctaaaccttactccaaatgtctgcatttgggagacaattacatgttaattgtctgtgtatgtctatgtctgcctgtgtgggtttgaggtatatctaatataaatgtggatggagaatctgcatatgtttgtgtaagacgtgggtttgctcatggttaaatttaagcacagaataggtattgaatcctctggcaatagctggcctgttccatagaatatgcaataaagataaatggaaaaaaaattcgttgaactactgggctttatatggtcaaagaggcatttgtgagaaaattctttccagagctctaacagagtaatatgttgattttttctttatatttaatatatttgcttcgtatctggaccattgtcagcagatggatgttttctgtcttccagaatattgggacatgttggtgattcttagctgtatctcactattccattgacatttcaaccagtgtgacacaaaatgtcagttatgtatgtgaatgagaagtaagatcttttgaatttaatgaagtatgtttaactttggatctattgatagctttcatagagtttagatcgtatgttctcttgatccacagctgtaggtgtcatcggtacatagtggtaagatcaaactgttgtattcttaactgaatcttgaatgaatatttgacttatcttcacgctgtatgacattattaaatgtgttctgtgttttagcaaggaaatatagctttgcgttggatttttcactgttatgaatttcttaggtttactgtaatagcaattatacttttttagtcaaagatatttctgttgcaagtgacagaaa

SEQ ID NO: 109807 - DNA, 1022 bp, Homo sapiens
tgaggtcaggagtccaagaccagcctggccttatgatgaaaccccatctctactaaaaatacaaaaaagattagctgcttgtggtggcacgtgcctgtactcctagctccttgggggactgaggcagaattgcttgaacccgggaggtggaggttgcagtgagctgagatcacaccattgcactccagcctgggcatcacagcaagactctgtctcaaaaaaaaaaaaaaagtgttctggaaagggctgtcaggatagtgcagttagtgcatatatgtccttgatggtaactgaacgtgtagataggaaaggaaaccactctgtagtcttgacttgattattactgtggatttttgagttgatcattttggtggtaagtttgtcttttaattgatggtggttttaatcaactaaaacccctcacaattataagcagaaaggcatcattttgtgagcactattttttttctttatttagattgatgacaaggagtttgatattcctcaagttgatactcctccaacactggaaagcatactaaatgaggtaagtgaatattaatgattactgtcattttgtgtgtggcattcatcttaatactttttggattagttatcatacatgcacctagatgcgcactttccagtagggtagccactagtcgtgtgtgtcagtttaaaatttaaattaattataatcaaataaaaatttaattccttggctgcacaaggcacatttcaagtgctcaatagccacgtgtggctagtggctactatatggctaggggacagcatagataaagagtatttccgtcatcacagaaagttctcttggacagcagtagtctagattgtgagcttctcaagggcataaaccatctcttgttcatctttagggtctctgtgcccagaacaatgcctaatacttggcagactttaaaatatattttattaagtgaattgagatgcaaaatttatgtcacttttgaggtttgtattatgtgttgctaatggttaagttg

SEQ ID NO: 109808 - DNA, 1057 bp, Homo sapiens
tagtattctattaaatggattcttcctaatttacttaatcatttcctactataagacatttaagttgtttgtaaacatatagtactgtgatgaacatcttcgttactacatttctgtgtccatgattacttttttaggacagatgttcctaaaggtggaattgcttggattaggagatgaacattaaggacttttgatatgtatcatctaatggccccctagaaaagttctgtcagcctgctctcctatcaggtgttcagaatggtggtcttcctgtggggcataattaatgttagataaatagaattttgggaaagaaacttacgaggtcatttagttcagtccccttattttacatctgaggctgctgaggatcagagaggttaagtgagatgcacagagccaagttcagccaagttcattgaggaatgctgaatcctgtataagtgtatttccactattctaagcaattctgctatcctgagagaaaaggaggcaaattctaagataggaagaaaagaataaaagaactaaggtgaatgagaatagatgataatacatatatttgtcagcagattgcatgttgatttttggttcccatttaccagtactcacttctcctcacctctatctgctttaacatccctttcttgtcaatgttataagaatatgtggaatggcgtgaacccgggaggcggagcttgcagtgagccgagatcgcgccactgcactccagcctgggtgacagagcgagactccgtctcaaaaaaaaaaaaaaaaaaaaaaagaatatgtgactgcttatcatcaaactcaagtatagcttactgcaaacaatttaaaatgaatactttacaaataaaaactagcagaggaaaagagaacattgtcttttgatactgtctttttaatttccttgggcctggttcctggttttttttttttttagaccccagtagctttcttgtagatatgaggaaataatctttcattacagtctcatggaaaagaaagtatgtctaagtgaacattttgagaaagaatcataatattctgg

SEQ ID NO: 109809 - DNA, 1085 bp, Homo sapiens
aagtattttttagagtctttattctttaaaactgggcaggtgtaaatgtaaccaaaggatctcatttacttagtaatagcaagttacaaaaagttattgtaagaacccaaatagagaactttagggtttttaatcaatcatagtttgtatttttcttttatcgtgatgaaaggtggttttgctttttgaaagcctctgtttttttaaagatattggaccattattactctaaataaaggtaagtttgtaagtttagagtgatgagcactgaatctagtttaggttatttcaaaagctattaaatgtgtatattgtagtttttcaaaattgtataattttttcctccttaatacttgactgtttaaaaatgtacaagaaaataaattccttctctgtttagtttacagatgatccaactcttgcaatttgcaacgacagcggaggctctgtttttgaattgacatttaagtaagagactagtggacatttgttgacaaatgaaaagactagctctgttttaatgatttgaaattgaacatgaagaggactagaaagcccctgtaattgagagtagattatgactgtgtattacaattacctgggaaggcttatattaatagaacaaacagagttctgggcctggtcctcccgagttttatctcagtaggtctgagttgagattctagactcctactccccagaagattcttatatgctgtcaagcttgggaccactcttctggaatagctcactaattttggtttaggctcaaggcccagttgattttaatcataatgggcaggtgtaaacaggtttttaattatcttagaattgccatgtttgctctttaagagcaaagactgtctagatacatcaaagaacatttaggaagcagagttttttgaaaagtagaacataatattcattgaatattatgtctccataagttcttcaaggttaacaactatctttgtttcttgtgtttctcatagcttctaacaatgctaagtacaaagtaatttctgaaaaaaacatacttcttattcagttaatgtttattgagcatctcctatgtgtaggtattt

SEQ ID NO: 109810 - DNA, 1030 bp, Homo sapiens
ggaataggaattctgactggtgactggtcagacaaaggggcctggtttctctcatttttccgttttagagagtggatcatctcctgaaacaagattgtcttacagaagcgttggctcttgcgtggtctttccatgaaggaaaagcaaaagcagtagtgggtgagtaggcagaattccagtgtagtagacgtggttctcctggagtagagggaatggttagtactaaccactcataggacacttttagctgagtgtcgaagtgtttataaacaggatgctaattaaaccttatagactttcagttaagaaggttaatgtgacaaataatgtgacaaatagagggtatagaaattaaaatgtcgcttttaaaattattttgtaaggaaattactattggaatgaaagagaagtacattgatatgctatccggtccagtagatttgaggtgttcctattatggtgtattatccaacattttgatagctaagaattgttacaattatacctgttgtttcacatcttataaatatgaaaccagacatagtttcactcctaaagatgtggactaacttttgtttttttgttggattttccttctctgcaggattatcaggggatgccagtaagcgaaaggctattgttgcagaccgggtgagtattttaagagggtctttactagaatacagtgcagatttgcttttgtcatttgccagtatctttgggcatgagtagataaatggctacaatctagaagagagtgtattaaaaaacacacacacacacagacacacacttggggtcaggggttcaagactagcatgggcaacatagcaagaccccgtctctaaaaaaaaatagaaagattagccaggtatggtggtgtgcacctgtagtcctagctacttgggaggcgaggccagaggatcacttgagcctaggagtttgaggctacagtgagctatgattgcggcactgcactccagcctgggcaacagagtgagacctgtatctaaaaaaacagtcaggttat

SEQ ID NO: 109811 - DNA, 1056 bp, Homo sapiens
taggtcttcagtgggaaagcatggaaagttcttttgggctttttgatgctaatggcagctgaatttgcatttcctggtgctaaggatcagttttttcccaaataggaatctccctctgaagggggagctaaatatttgggagactctgcttaagtttagatgatatttctttctgtggctgctgattggatgttttcagtttaaaatcatctctattaccactttagtgggaaatcctttcacttgcttactagtttttaaaagaataaagcgtttaagaaccaaaggatactttatatcaaaattataatctcagataagccctttatataactggtatttattaaatgatttttttcggtgaggaatatgacaacagtgattgtttctcagtgagccttctaaacatttcatgtacagattaaaggttttcatatttaatcttaatggtaaatgactaattccattagcgaatggtgatgaatagcataagattcttattttttaaataatatcatttgagatgatgatgattgttttcctattaattttaatgcagaaacttttcagagtcattgctcctcctctgaatgcaggaaaaacactaacaggtatttattttctaagccttaattttttgctttcctgtatttaaggtattatttaaatgttacaaaattggccaattatatgtgtgcagtgtgaatgttggtaatcatgtacagtcatgtaacaccaccataatcaagctgcagaaggagccatagcttctcacactaaaaagtttcctccttcccctttgtacttgatcctttccccacagccctgctctgggcagtcactgatctactttctgtcactatacttcatgtaaatggaattatgtgctatgtaacctttggtgttttatttctttcactttacgtggatgaagcataatatttttgagagtcatccatgttgttttatgtatattaatattttgttcccttttaccactgaatgatagtccatggattgaatataccataagctgtttaatcattcaccacttca

SEQ ID NO: 109812 - DNA, 1104 bp, Homo sapiens
ttaattgtcatggaaattgtgaaagttatttttatgacagttaataaaatgtgtcttagttatttccaaataacagactgaatgatggctgaacatgtagtattttatccttctgttctcaaacctttgctcccaaattacctcttttcattagtgttatcgctctcttttttttgcttatggactttgccttccttcctttctcaaattcttatttgtgatttttttttaagtctcagaatactgtgcaatattaaatgccatagctttctacttgactcactaaaaataatgtcacgcaaggtgtataagacaaaacctaatgaggaatagttatcttatttgagaaattacttggattttattaacaagaatttaataacttgttttcttctacatgtgcaaataataattactttaaaaaatttatttctcccttttagacttttgaagattttaaaaatgacaagcaagctgtggaatatcaacagcgaattgtggatattttgttgaaagtaagtattcaaagaatacatgtctttatattgatatttatattaagatagttgagctgttttatagcaggttataaaataatcttgttaagtggtttcttggaatcatatcgtaaaattttattacggtgtctttgttctcaagagctgaattaagtactaattatttattttaaaaaatttttagtgtatgttggctttagactggggaccggaatagagggcactactgtgagaaaggcatatggtgataattgctatgttagtatgattacgtgtaataatagagactaacttcagagtgctttgagaaaacaattaatatggagaatcttcctgtgtctcatgccaacttcactttgttgctaaggcagtgccgtattctatcatggcactgagatgctggatgacacttaagaatgatttgaggcacacagaaatgatcatcccagtataaatctaattagattcaggagaaagctgtcttgagattgatgctgttgctaatgaagaatgcagggaaaggttctttgcttttccatctgcatgacttcaggcaggccagtttcctcttgtagttgaaagctta

SEQ ID NO: 109813 - DNA, 1021 bp, Homo sapiens
atccagaaaattagctggacatggtggtgggtgccttttgtcccagctgtacgggaggctgaggtgggatgatcacctgaacccaggaggttgaggccgcagtgagctgtgatcatgtcagtgcactccagcctgggtgacagagtgagaccctgtctcaaaaaaaaaaaaaaaaaaaggtctgtttgtggagtcttagacatttcttttaaagaaatgaagtatttactttattgcatagctttataaattgtgcaagaatcccacatagatcttacaaagtacctttacttttgatggcaagaaatatgcctctgaccaattgttttcagaattcttaaaatgaaaaattgccagaatgttatgttataactgagaagaaagtcatgtaaaataacacaaagtgatagtgaaaaaatagaaaatcagactgataaaaataaatatatttttaaatcatattttatattaatctttttcatctttaagagtcccccattttttacagataaagtgtgaatttgtcaaaaaataaaaaaacaaagaaaaactaaacaataacaatttttgcataggtttcccaagaatttagaaatattcatatttttgtagtatttgaaggtttatctcatttaaccctcactactacccaatgtggaaggcagagaagatattgctgtcctctttttttttttttttttccacataaggaaattgaattgctcagaggataagtaacttacagaaagtcacgtaagtgagtaaatggcaaaaacagaacccagattttatggcatgttgattgctaacatgttgcagtttgattggcatctcttctgtagttgttgatattcatgaacttttttggtggtggttgttaacttggacctcaaactcccaccctccctggatgaactatctcacagcaacccattgccacaggaggaccaggttaaggcaaggtgaaactgatcagtgcatccagagctcagcatccacagagcagttccaagcacctgcc

SEQ ID NO: 109814 - DNA, 1151 bp, Homo sapiens
gtatatatcttcttgtgtgcccatatgagggttctctgaataatatacttgcaaatggaattgtttagacaaccaagtagtgtagttctactgattgccaagttgatttccagattgtttctattctcatcagcagtgtctgatatttgctgtttttcacatccttgctgatacctagtatttttagtcttcttaatttttgccatggtgggtattagtgattactcatgacattaaacatctttccatatgtttgatgaccattggaattttcttttctctgaattatttattcatgtcatttgcccattttttctgttgagtttctgtgtttctcttattgagttcaagaagttttttctgatttcccagtctctaatcctttgctaattttatgtgttggaggtactttcttccaatttattatggcacatcatttaacttggcttttagtgacttctgttttagtttaccattctttaaggcttaagtgtgtgtgtgtgtgtgtgtgtgtgtgtgtgtgtgtgtgtgtcttatttcctttcctattttaatggaataaaggacattctcttttatatataaattttatagttcagcttcttacatttaggcttttaatccatctggagttaatttttgcaagctgatcaaaagaaggatttttatcttccacatgatggccagtggtccatgtggcattttattatccattcctcactgatttttaatgccatactgccatatactaaactcccaaatatacatgactctgtgggttccattctcttcctttggttgtctttccctatatccataccacatattttaattaatacagcttttcaatagatttattatttggaaaaagaatcctccctccttattctttttctttaaaatgctttggctatttttagtgtcctacatctcctagtattccacatgaatttggagatcacattctcaagtttctttaaaagatacaaactctctggaattttgatttatgaatacattgaatttatagactaattcagagagaactgacatctctgtagtgttgattcttctctttcaggaaaatgtatgccttttaaactgccttttctgctctttggtgaggttttatagcttttatataaggttcc

SEQ ID NO: 109815 - DNA, 1769 bp, Homo sapiens
aaccattgtggctttgtgatgttaattttcggtggagttaaatatacagaaaattatgcactgtttgttggttatctttttttttttttgacaggctttcgctctgttgcccaggatggagtgcagtggcacaatcttggctcactgcaacctccatcttccaggcttaagcagtccttctgcctcaccctcccaagtagctgggactacaggcgtatgccatcacattggctaatttctgtattttttgtagagatggggtttcacctgtcacccaggctggtctcgaactcttggctgaagtgatctgcacacctcagcctccaaaggtggtgagattgtagacataagccaccacgctaggctggttatctttttgtttatacttttgctataacaaaagtatggtttagttatgtttaaatgaggtatataactaacatcctaaaaattaatgtgccaaacaacagcaaatcagagcttctaattagtaggacattgaacatagccaatgtttccaaaccgaatttatacagttttaacccaaagcagtaaaagttgacaatttagtatcttgagtggttttgtcctcagcaaatacaaaattttcatcatattccttgatatttcaaaaaaaattattttaataaattgtggtggccaggcatggtggctcacacctgtaatcccagcactttaggaggccgaggcaggtggatcacctgaggtcaggagttcgagatcagcctggccaacatagtgaaccccgtctctactaaaaatacaaaaattagtcgggtgtggtggcacacacctgtagtcccagctacttgggaggctgaggcaggacaattgcttgaacctgggaggcggaggttgcaatgagcggagattgcaccactgcggtccagcctgggtgtcgcaacagagcaaaactccatctcaaaaaaaaaaaaaaaattaaattatgggtaaaatataccctaacataaaatttaccattttaactatttttgagtatacagttcagtagcattaagtatattcacgtaattatataatcattacccccatccacctccaaattttttaatctcccaaactgaaaatctgtacctataaagcaacagctcccctattcccctctcctcccagcccctggcaaataccgtcttactttcttttttcaccattctttttctgaatttgattactcaagtatctcatatgaatgaaattatatagtgtttgtcgttttgtgacttgcttatttaacttaccataaggttcataaatgttgtagcatgtgtcagaattttcttcctttttaaggctgaataaatgccattgtatgtatagaccacatttcatttattcattcatccttcaatggacacttgggccacttccactttttgtctattatgactaatgcctctatgagcatgaatgtacagtgtctcttcaagagctggctctcaattcttttgggtatataaccacaagtgggattgctggatcaagcattaattctgttaattttttgaggaatggccatactgttttccctagttgctgcttcattttacattcccaccaacagtacacaagggttccaatttctccacatcctttccgacatttatattctcttttttttaatagtagctatccatatgtgtgtgaggtagtatctaattatggatttgatttgcatttctctaatgattagtgatgattttcctgagtattttggctatttatctacc

SEQ ID NO: 109816 - DNA, 1074 bp, Homo sapiens
actgaatcccaggacctgagtttcttcacctgtaaaataacaataagaaaagtacctacctcgtagggtttttgagatcattaaatgagatgatccatgctaagtacctgtaacagtgactggcacatggttattacacgatcgataaagtgagccgctgcagcaggggagggagggttgtcgcatctgagaaaacgtaaaccagtgtttttcccctgtgctgtgaacggtcaccatgttgtttctttttaattgtggtatcgaagggcttgggtttttaaggttatttttcactgagcctttcagtctgtctctgtggcctcaagcactcgcctcccttagaactgctcattctagggtcatgactactactctaaatgaatctcctgcagagactttctgccacattttcccctcctctctctaggcagcttagcaacttgtctgcctgttgtagtatttcattacctaattcattattagctgggacctactgagagttttgaggcattggagaatgagggtctatgaagagtcaggttcaatctgagagcaaactgtgttgtggatgggaatttagaaaaggtatttcctggttgcagaggggaaggaggtgtgtggcttttcctttatctctgaagccaaactttgatttaggcaaaacttttaactattaaggacctccagtgtgaaacagcttaggtggtggcaaaagactggctgaggctataagagatacaaggaaagatttgaaagtgaggtggagggcaggcagggagaaaaggtggaaatatgcttctcagtccactcgtcctactccatctccaccttcattgccaccagtgtcaatacaaagtggcccgtgtctctcgcaaactaggtttgatcttctcatgtgttagtgtagaaagataattaggaaaggaagtgttagggttttgatttcaggatcttagtaattgtagagagtaagaaacgaacaagccgagctcaggcttctgtgactgtccgtgtcttcaagtatgatttggaaggcttcgtgtccagtatccctaggagtagtaccatccctgt

SEQ ID NO: 109817 - DNA, 1093 bp, Homo sapiens
ggggcagaatgaagggccaggccacaaaaaatattggctataataaatactaagttcatttgcttttggtttgtgatatgctattcagtgaaaaatgaaccttccagaaatttctaaattagaatatttagcattactttcaaaataatgaatgcccttgggaataaaataaacataattataattcaaaatataaagtcaaagaactgaactgtgcatgcaatttacctcaggccactcattttttttcagtagatttacctttctaattatattttgcttgcacaaatatttaaattactttgcattccctgagagcagtatacttcttgtgtcaaggaggacacacatttaacaaccataaaactatctgcaaaagcaaaaagctcattttccccccaaaggagctttttaagaatcaaagcgtacaactgatcaaatagttgagcaaggtacacacagtagcttagcagggcttatacatttattttattttctatatttgtttgggtttattttttctttttcattccctttgtgctctacaaccaagagaaagaaacatcttcaaggaattatatctgctatgtaattatacagtgctgcaaattgcaatgttagctgaagttaagggcagagaatgacagggtaactaatagagcatgatctaaacctcattaagtaatgggtatcttcctgaggaaagaatacagggttgtctcaaggctgagtctaagaattgactcctatcttgttataagagtttgagaatgtaataactctttgtttcttttttcaaccaaagagccaggatgagaatataaatctttgttagtgtttcattgaggcattgtgaaaaggcatattattgccaaacagcaaagaaggaaaacatcataaatattatgaatcaaaactttaatagtggaagttacttatttgtggtttgattggcctttgaaaaacaactgacagtattgattcatgtacctccaccctcaaaaaattttatttttcattttctggtcacagttggtttttgtgttagtcatgttgtatgatcacttccattattgagaaagtgatttcagct

SEQ ID NO: 109818 - DNA, 1064 bp, Homo sapiens
agaaatcattaggcgagtttgttgttatgtgaccatcatggtttacttacacaaacctagatggtatagcctattacacacctaggctatatggtatggcctcttgttcctaggctacaaacctgtgcagcatgttactgtactgaatactgtaggcatttgtaacacaatggaaagtatttatgtatctaaacacatctaacatagaaaaggtacagtaaatatatgatatcgtaatcatatgggaccaccatcatatatgtgttgttgacagaaatgttattatatggcatatgactgtacttggaatcccattgactctgttagaatagtagtggtactcttccaattttgtgaaatccaagccagaagaaatcattacagctagagaaatttttagtctatctgggagtagctcacattctccctgcttagttgacctcaaaatccttttataataatatccaggtttccatgtcccattttgtgtttgcttggttcccttaacctgggtaggctgattcactctctccttaccaaagtgattttatacacaggatacttatgtacagaaaccatttatgtacctcttaccctactccttactccagaaggagatctgaaagcctgttttcagagatacttccagaaaactgcccaaatactgcttttcaaagagagacctaccaaaaaaaaatcactgaactttctatccaatcaagaaaactcatttgtagttctctgaagcaataataagaaccaggaatggagggtttgtctccgatggcatccaccaacactgtaagtgcagtgaagactgtgggactgttgccaccaagatggatttgatggttgcttttcagaaggcaagatggtactggcaagaaagcaagcgatgtgtcactgtcttcttccttctgaccctggggtaggggatgctgatgtcccctacctcttacctcagaatatgcagatcaaattgcatatttacaactggtgaagaactgtcaaggcaaatttaggaacggtgcaaaccctcatcaaacttctatatctcctattgc

SEQ ID NO: 109819 - DNA, 1040 bp, Homo sapiens
cattttttagatgtaaaaatctaagatgttcttaaaataggctgaaaactccaaaaagttgacatgtaaatatattattgcactatttaaattttaagtttacatacccttaaaccttgtgttcccgatttctggaaagtgcccagaatcatgcccatttgtgtatactgttaccgtggtgccacccttagaatacataaaattatggtacaaagtcatgttttgagatcctgtagatttatgttaatattattgtcttacttaaaaatgcagtctaattttgctacctcagtctcctgttcagtgtcaatctgctgttcaatgtgatgtccactaaattttggacatctaaatgtctgtgtagtataacttttattcataatgagttggtatctcagtggtaccttaggtctgtacattgacattcttgaggtttttagttttgcagaacactgaaatctatggactctaaaatggacttcatttaaagaaacccacggaccattaatggacaaaaacatgagtcaatatgtattgtggcattcaaatcctagcactctgggagaggtaagtagttgactgtgttttatgtttggtgagatggtagaccaatcttaaatttgcctaggaaattataggattgtaattgaaaagtacagttcttaatctctttatgttttaatcaggaccttccaaagagaggtttgttttgtatatatgaagcaattgttcttattttcctgtaaagttgataagaaatttaagattggcaagctatatttatattgttcctggaaggctactgctctgctttctttttttaggggggagcttcctttcaacactttacatccgggtagaaataatttaatctgtggatcccgtgtagaaatgaggcctcaaatagtcatttaaattatcttgcatccaagtttcgctgtgtaatagtatatgtatcaaatctactgattagttttatcttgtgcctcaggtttaagcaagaaaagaggccaaaaaatgtcttcgtttctttattctgc

SEQ ID NO: 109820 - DNA, 1017 bp, Homo sapiens
ttttgaaccataatacttccacatcagtttatttccctaccccacaaagtgaacatcattttatgctatctcttccaacaagcattttggctatgctttcagagatcaaaagctctttaagacaatttgatatcatggatagagatcaaagacatacaataaattatcatcaaatcagtgtatctgactacagccccagggagattctgtaagaactttaaattctgttgcaattttcagtgaagggtattaatcaaagagataagccaatgaacatattcagccattttgtctactgtaccttttcaaaaaaatttttttccttttctttgtttttgattttctccttttgttctttcagcatggtatctagtaatctgattaattactgacccaaaagtagtttttaatttcccttaaaaaaattattagacttgtagtagaatttttttgtgttttgttttgttttcaagcatcaagtaccacgtttttgaagaccatggcctatcatcattatgcattcaagatttgagtttgaataacctcatcaagacttagatcttcttcagaagcttcaagtctcatctgcattaaagctctccattgaaccctctcacaaaagtacaagcttaaaggggctaaaatccattaatacattccattttatatcccttcctctgacttctcttcaatttccttggcctctagggtccttcatattgcttacgttcctttagactagagccaaggagacagtgctttccaaaaaaaaaaaaaaaaaaaatgtgttctgtggccataagttttcattgatagagaagcataaatttggtgaatttagaattaggtcttttatcatatcctataaaaagttgagttaacaggctgggcacggtggctcatgcctgtaatcccagcactttgggaggccaaggcagctggatgccccaaggtcaggcatttgagaccagcctggccaacatggcgaaaccccatctctactaaaaatacaaaaat

SEQ ID NO: 109821 - DNA, 1027 bp, Homo sapiens
cttcattctttttactttttgttgaattatcaagcaggagctggataattcttaatgggtttgctgattttgtcttctgtttgatcaagtttgctgttgaatctgcttagtgtaatttttaattcagttttatattcttcagctctataatttccatttggtgcaccaccccctcccccgccaccccgagatgcagtcttactctgtcgcccagagctgtagtgcaatggtgtgatctcggctccctgcaacctccgcctcccaggttaaagcaattctcctgcctctgctgcccaagtagctgggattacaggcgcatgccaccacacccagctaatttttgtatttttagtagagatggggtttcaccatgttggccaggctggtcttgaactcctgaccttgtgatctgcccgcctcggcctcccaaagtgctgggattacaggcatgagccaccacacccagcctttaaaatagtttttatctctttgttggtattttcattttgttcatgtatcattttcctgacttcctttatttgtctatctgtcctcttgtagtgcattgagtttctttaagacaactattttgagttctttgtctggtgattcatagactttcatttctttggggtctttttttttttttttttttttttgagacttactttgttcccttggtcgggcccttatttctttgtattcttgattattttttgctgggatttgcacatttttaaaaaacagccacgctcccagtcttctggactggcttcatacagggaggaagagatgttaagactctctttagcccagctatagagtcttagggcctctcaaacctttaatggggttgtatctcctctgaactgtgcctgtaatttcccaattacagaagtttgctggtttcttttttaggcacttgctccctctggtgtctttccatggtactgctggttttctggtgttcctacaagctgcctaggtctcttttgttctcagcagttcccaggcatgcaaaagttgc

SEQ ID NO: 109822 - DNA, 1644 bp, Homo sapiens
tgaaaagacaagaacatgcttttcctgtggcagcagccgggctgagaggagcgtggctgtctcctctctccgccatggcgtgtgctcgcccaatgatatcggtgtactccgaaaagggggagtcatctggcaaaaatgtcacttagcctgctgtattcaaggctcctattcgaccagatattgtgaactttgttcacaccaacttgcgcaaaaacaacagacagccctacgctgccagtgaattagcaggtcatcagaccagtgctgagtcttggggtactggcagagctatggctcgaattcccagagttcgaggtggtgggactcaccgctctggccagggtgcttttggaaacatgtgtcgtggaggccgaaggtttgcaccaaccaaaacctggcgccgttggcatcgtagagtgaacacaacccaaaaacgatatgccatctgttctgccctggctgcctcagccctaccagcactggtcatgtctaaaggtcatcgtattgaggaagttcctgaacttcctttggtatttgaagataaagttgaaggctacaagaagaccaaggaagctgttttgctccttaagaaacttaaagcctggaatgatatcgaaaaggtctatgcctctcagcgaatgagagctggcaaaggcaaaatgagaaaccgtcgccgtatccagcgcaggggcctgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtatggcacttggcgtaaagccgcttccctcaagagtaactacaatcttcccatgcacaagttgattaatacagatcttagcagaatcttgaaaagcccagagatccaaagagccctttgagcaccacgcaagaagattcatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcagcactaccagccaaatcagatgaaaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagaaaagaaacctactacagaggaaaagaagcctgctgcataaactcttaaatttgattattccataaaggtcaaatcattttggacagcttcttttgaataaagacctgattatacaggcagtgaggaaaaaaagaaaagaaaagaaaagaaaagaacatatatcagtgttttgattatttccaagttctaaggtccagatgaattacatgtgaaggcatcaaaactcttgcatttaggattacaaaaacaacctttggtaaataattatcttcaggaactatgagcaagacagttgttcatggaaaagtagaagataaagaaatacc

SEQ ID NO: 109823 - DNA, 2149 bp, Homo sapiens
tcagcctcctgagtagctaggattacaggcacatgccaccacacccggctaatttttgtgtttttagtagagacggggtttcaccatgttggccaggctgatctcgaactcctgacctcaggtgatccacctcggcctcccaaagtgctgggattacaagcataagccaccattcctggccctattttaaaattgtcttatagtagcatgtattatttgtgtaaatatctcaagttcttttgttgaacaagacaggcatatatgggaagtgaggaaaggagggaaaataatagaaaagaaggaaagaagggaaagagttaatatgtataagggtcaagagtcaagcaaaaaaaaaccgtagtcactgttcctggtgacattctgaattattattttcttaattttgctgctgcttgtaacaggtgctttgtccttttcttcttccaggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgc

SEQ ID NO: 109824 - DNA, 1063 bp, Homo sapiens
caattatatgacctgcagcgagctacttagtctgaacgggctactcgtccagataaggggctgggactagagcagtgtttcttgaagtatgggccttggaccacctttatcagagtggtaaagtgctaacatcctataaaatcagtgtttgctactttctccatactggaagaaaaccaccctccttaagcctaaggcaaggatctcttctcttaaacctcccttagatcctagagggaaagacgattcagggcttctaggtcaaacagagcaaatctgtggttgagcagctgctattcataggagatacctgagagaaatggagatcttaaatagaagcaagatctaccacggccaattttggtcatattggctttcagacaaagtgcctcaggccctcagctagtgggggtttgctgcttctaattacctaggtggcatgaggcttggcaagattctggagaccaggcttcctgtcctctgtctcacaagctgtgtgaccctgaggggtctgggatcttcatctcctgtatacttcctctcctatagaagagaaatggactatcagagtgttccaaaccaatcggaatctcagggtgggagtggagaaggggcttttaaaatacaggttcctgggcactaccccagaaccaagtacccagaatttctggggtggagcccaaggatgtggttttttaacaatgtcaccagctgattgttctgcagccagcctgttcagccagccagacttttggaatccagtggatttgatgacatctttgagacagtacagaatgtgaatagtacttcttttaaaaaactgtttgtcaacaatggcacttctctctttactttggctgttgggtactcagaaccaaatttggggcccacttttggcaaacaggtgaaccttatgcatttttttactaactgtactccctgatgtcttgtattcttctgcacgcattttgcttttcctatttaaaattttatttatttatttatttatttttgagacagagtctagctctatcgcctgggctgaagtgcagtggtaagatct

SEQ ID NO: 109825 - DNA, 1174 bp, Homo sapiens
gttggtggtgtcctactttcctgataaagtggccctgctgcagagaaaggtaaggggaggggtcacatctgagagctgggaccccagacagtcgctacgtgcatggccttgagagaagcgagtggcagggatttcccacagtactcttccacgctgtttcaggaggtcctaggggttcttttgatgtcttcaggagacatagacctgggatcaaatcccagctccatcattaccagctctgtgactttgggcaagttcttgacttctctgatcctcagcatgtctattttaaaatgaggaaaacagtctttccctggagggttgttggaagaattgggaacagattatgtaaagtgtctagaacagtgcctggcaccagcaggttttcaacacctggagaccctttctgcttcttaacagctttcttctctttggctacaggtggaggagaacagaaacagcttgttttttttcttattgtttttgagacttttccccatgacaccaaactggttcttgaacctctcggccccaattctgaacattcccatcgtgcagttcttcttctcagttcttatcggtaagatgctagtggggtaggtttgagtcttcagagctgtcacgctgggggtctgccctgggttattggccacgtgagcatgtgcctgcttctgagaacacaggctcacaaagtgtgacttcaagccttatgatctaaagaaatgattcctgatttcagatctgctcaggcttcaacatgaaaacccataaaaatacttttggactaaataaagattgtccattgcatggctgtatgcactaggcactgggattagaagagatggtctgtgtaaagtatacaaattggcccatagtaagtactcagtaaatgctagcaggaagagcagggttggaatgagggtgtgtgtccatgagttttgagtggggacagaagaaaggagcagagcaagggacttcctgtctggtttttggcccctgttttgattaagttctgccttaggaattgctggcatcagtgtggttccttcctgccttttgacaattgcacaacctgcagcaagctacttaccctcaatggaccacctggctaggaatagagcagtgtttctcaaagtgtgggctttgggccaccttcatcagattgttagggtca

SEQ ID NO: 109826 - DNA, 1535 bp, Homo sapiens
tcaccgtgcctggccaccgtaagtgttttctatattaaaaacaattgctaaataattttgtatcttaaggatataatattatttactagaccattgcatttttataaattcatttacaaggatattttgtcttattttcccaggcctcagctgtgtcggtatgatcttgtcctgatggaaaacgttgaaacagtcttccaacctattctttgcccagagttgcagttgtaactgttgccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgttagccttttggaacaaggctgtcacctattttgccaacacgtgaattcaaaacatgaaccggtttgcttttggagaatctgaagactccagtttgaggaatcctttgcttccctggaggtagatgctgtctgcaaatctagaatgacagcaggagtccagtcaagaggtcctgtcaggccaaggccagaaagaagggaggacaatccctggggccagatgcccagtgtgaggggaggcatgatctgtcccatggctgtggccactgcagga

SEQ ID NO: 109827 - DNA, 1034 bp, Homo sapiens
tctgcctgcctcggcctcccaaagtgctgggattacaggtgtgagccactgcgcccaggctgctcttttctctttaatgtgccctttggtgcttttttcctggggaccgcccgtttatccccaccccttgaacctcatacacgtgtacgttccctactgttgagctctgcatgacacatgcccctgatggagtctggatgccattctcaggggcacagccagggtaaccgtctccactgtgggaacaagctgcagagccatggaaaggagtcctggccaagtgggacgggagtgtgagcgctcacccacctgagggtgccctgcagcctgggagccaccctcatccagaaggatcaaaggcccggctgcaggtgactcatggtgtggggctgccaagtgactctgttttccttccaggcctcgaccctgcaggccctttattcaacgggaaacctcaccaagacagattagatcccagtgatgcgcagtttgttgatgtcatccattccgacactgatggtaacgctcctttccttgtgggtcagtgacaccgccaggctcctaaagagtgtcccctggggagagataatcatgtaggagcagatcaggttcctctagattctaacttttttttccaggcagggttccaaatccaccgaaatattgaagggaagctggtttaatgtaggcacccaggaccttgtgctagagcgtggatgattatcccacggtctcttcatatttttatttttttaattttttttgagacagagtctcgctctgtcgcccaggctggagtgcagtggcgcaatctcgactcactgcaagctctgcctcccaggttctcgccatcctcccgcctcagcctcccgagtatctgggattataggcacacgccgccacgcctggctaattttttgtatttttagtagagacggggtttcaccgtgttagccaggatggtctctatctcctgaccttgtgatccgcccgcctcggcctcccaaagtgctgggattacaggcgtgagccac

SEQ ID NO: 109828 - DNA, 1584 bp, Homo sapiens
gtttcaccatgttggccaggatggtcttgatctcctgacctcgtgatccacctgccttggccttccaaagtgctgggattacaggcgtgagccactgcgcccggctaattttgtatttttagtaaagacggggtttctccatgttggtcaggctggcctcgaactcccgacctcaggtgatctgcccgcctcggcctcccacggggctgggattacaagcgtgggccactgggcccagcagacagactattttgaatcctgctctgctctctccccagctgcctgatctggggcagatgacttcagcttagggcctcagtttcctcatctgcataatcaaaagaatagtatttactttgcatggatgttgtgacttttaaatgagataatagatgtaaggtgcttagaattacttctccaaagtcaacagccaggaaatttctacaaatgttaattccttggccccttacaatttacaatgatggacctcttgaaattccaggcagaaggagcttctcttgatgacatttacatgatcggagtaagtctaggagcccacatatctgggtttgttggagagatgtacgatggatggctggggagaattacaggtaagtgcctgtgaatgggcatgggttggtagcctgggcagggtgttcactgggggagtattatgtaggccaatccaactccttgggttcaaagccagctccaattacctaacctctctgagtgtgggtcattgcatgcaaaaggaagatcaaaataatattgacctcaggctattatgtaataaaacataagtaaagcattttgtaaattgtgtatactatagaaaagatgagtagtgactttatttctattatggctggaaaaacagctatgtcccattcaaatctgtgtgccgcaaacagttagtcctcttccttttatttaatccaggagaccctgaactataaacctaatacgcttcagtccccaggcacagctggagtctcataagaaaacgagatgggaattttgatggctggggcttattctctaaatatcagctttcgggccaacactgaatgaaaaccttcagaaatgcagtaggtcagatcccaaacaaagactcctttgctggaatctcctgcctagggcttagtagctttccacagcggctctctctttcagagtctcaaagcctctcccatttctcctttcccagaatccatcctcatacctagatggctattttaaatctatggaaactgaaaaggtagaagtggatggaaaaaggggagaggtaaatgattaaaactacatttaggaggtaaacttttagggccacaagtttttaattttatttttaatttaaattttattttattttattatttatttatttttgagaaagagtctcactctgtcacccaggctggagtgcagtggtgcaatctcgggtcactgcaacctccacctcccgggttcaagcgattctcctgcctcagcctcctcaggagctgggattacaggcatgcgccaccactcttggctaatttttgtatttttagtagagacattgtttcgccatgttggcca

SEQ ID NO: 109829 - DNA, 1015 bp, Homo sapiens
cagctggggagagagcagagcaggattcaaaatagtctgtctgctgggcccagtggcccacgcttgtaatcccagccccgtgggaggccgaggcgggcagatcacctgaggtcgggagttcgaggccagcctgaccaacatggagaaaccccgtctttactaaaaatacaaaattagccgggcgcagtggctcacgcctgtaatcccagcactttggaaggccaaggcaggtggatcacgaggtcaggagatcaagaccatcctggccaacatggtgaaaccccgtctctactaaaaatacaaaaattagctgggcatggtggcgtgtacctgtagtcccagctactcggggggctgaggcaagagaatcgcttgaacccggtaggcaaaggttgcggtgagctgaaatcacaccactgcactccagcctggtgacagaacgagattccgtctcaaaaaaaaaaaaagaagttgaggaagctctaggcatttaaaccaagaaatcctagacagaacctctcctacctgtaagacacctttattgtgagctagaaaaaaatgccccttcctcaagacactttgtcatcatctggtggaaatttatcataataaatatataaatctataatgtcacaatgacaagggtgctccctcagatgggtgccctgtgcagtgcacagcctaacaaacatacctatggacattttgcacagcccctcatcccaccttccctggggcttattcacatttgcaaaatgttgcaatataggcctcctgctcactgtagctatctcttggctttaagccctcagataatgggccagtttcaacttagctctgaatcatctaagagaattctcttaccaacatctggtcaataaattccttcaagaccatggctacttttctggtcttactagaggcatgggtatatattaaagttgtagctcctcgattccaatcaacaacaactacgttcatgtcttcaacagagagcaaaccctttactaagtca

SEQ ID NO: 109830 - DNA, 1161 bp, Homo sapiens
tttttttttttttttttttttttttgaggcggagtctcgctctgtcgcccaggctggagtgcaatggcgcgatctcggctcactgcaacctccgccttccaggttcacgcctttctcctgcctcagcctcccgagtagctgggactacaggcgcccgccaccacgcccagctaattttttgtatttttagtagagacggggtttcaccgtggtctcgatctcctgacctcaggatccgcccgtctcggtctcccagagtgctgggattacaggcgtgagccaccgcgcccggccctcgcccgactaattttttgtattttttagtagagacggggtttcaccgtgttagccaggatggtctggatctcctgacctcgtgatccacccgcctcggcctcccaaaatgctgggactacagacgtgagccaccgggcccggccgttaatttcattttttaaattaagcctcaatatcaagaaaagtggaagaagtgttcatttgtgggagcttgagagaacaagatgtctaatacattagtctgagaatgcaggttattgatgagattggttgttggctaaattgcatcgtgtgttccagagatacatggttttgccttatttttctctcctatctttccgttgggttgatataaggatcatttgagaacgtggtgtaaagtgcctaaactgatgcttaatgtatataagggtagtatttgtctgtcctactctggggccttttgcagagtctggtgcatgataagcacttggtccctatttatggaataagggaaagctaatttcctctcccttgtcctctccttgatgtgaatccctgctagtcagtggaacatggtttggcgatcaaaaccttgatctttactatactttaggtgttcacatccttaatccaaaacaacacttctcagtgtaaaccaattttcagtcaaaatgaagcccggcagggcttgttggaatgtataaagttatgagctgaatggaatcctgggatctcattctattcattttttttttttgcatgtgtgaatataattgatcataagggttcagagagatgatgagtaatatactatgaccctttagcattcttgacatctgggtcctgaaactttcctcaattccaaagttctttattaccatc

SEQ ID NO: 109831 - DNA, 1723 bp, Homo sapiens
ccgcacccaacccaagaaagtctctttcctatccctttcttatcttttctagaggtaactactgttaccagggacttgtctaatccttgcaggtaaataagcctaggtgtagactgtgcattttaaaattctaaatcattctacaaagaaaagatacttcttatttatttattttttgagatggagtctcgctctgtcacccaggctggagtgtagtggtgcaatctcgactcactgcaacctccacctcccgggttcacaccattctcctgcctcagcctcctgagtagctgggactacaggcgcccgccatcatgcccggctaattttttgtatttttagtagagacggggtttcaccatgttagccaggatagtctcagtctcctgacttcgtgatccacctgcctcagcctcccaaagtgctgggattacaggcgtgagcccccgcgcctggccctacttatttttaaggaggaaatgttgtaaatgtttcaaactgaggtgactctagttcagatggctgagggaacccatcttttctatttttttttttcgagacagggtctcattctgtcacccaggctgggatgcagtggcataatcatggctcactgcagcctccacctccctgggcccaggtgatccttccatctcagcctcccaagtagttggttgggcctacaggcacgttatcacacctagctgatttttgtattttttttgtagaaacagggtcttgccacattgtccaggctgaaaataggcagcagtggcattttgaaagaatactcctgtctttaagaaccggtaatatttctttttttttttttttttttttttgagacaggatcttgctctgtcttgatcttgtcatcaacaatttttttttttaattttgtaagaggcaagggtatcactgtgttgcccaggcttcagtgcagtggcacgatcgtagctcactgcagtctcaaactcctgggctcacacaatcctcctgcctcagtctcctgagtagctgggactataggcccataccaccacacctggcaaattattttgtatgtggatactgagtctccatatgttgcccaggctgatcttggaactcctgcccttccaaagtgccgggattatggatatgagccactgtgcccagccaagtcttttacttcagtatatctgaatggataaagaaaataaaagtagattaaaggaaaaaggcatagtaaaatgctataataatatattcctctttctcaaaaatgattataaatttgggtctacctccagatgtggtaattgagtgtggacatatttgtgttaatatttcgtttaaattcagtgagtacttattgagcatgtctcagtgctaaccaatgtgttaggttttacagaaaatacaaaaattagtaagacagggtctcctttttttttttttttgagatggagtcttgctctgttgctcaggctggagtgcaatggcacattctcggcccactgcaacctccgcctcccaggttcaagtgattcccctgcctcagcttcccaagtagctgggactacaggtgcccaccaccacacccggctaatttttgtatttttagtagagacagggtttcgccatgttggccaggctggtctcaagctcctgacctcaagtgatccacctgccttggcctcccaaagtgctggaattacaggcgtgagccaccgtgcccggc

SEQ ID NO: 109832 - DNA, 1216 bp, Homo sapiens
ttgttgcaacctccacctcccaggttcaagtgattctcctgcctcagcctcccgagtagctgggattacaggcgcccaccactatgcccggctaatttttgtgtttttaatagagacagggtttcaccatgttggccagactggtctcgaattcctgacctcaagtgatcgcccgcctcggcttcccaaagtgttggtattacaggcgtgagccacctcacccggctgtgttttcatttctttataaggcaggtgatgttggctttacatatacagtagtaatttaaaattatcttttttttttaagccaaaaaaggaagtcagttttaaagaaaaatataaatagcttgtacttggatgtggttaaaaaaaaaaaacacacacaaacgttggtattacagaaggtttctgacttaattatttaggacaatcatctgttttatggattctatgttaaggatcacttattgcatcattcccattaaatatgtagtatgattttctgaatggcaaattgtagaagggaatctaaaccaaagggtaagcggtgggtagcagagtttgtaaaggcctgtaaagtgctgcccaagagaacttcctgcagtgataactgttgagcactcgaaatgtggctagttcaactgaggaactgaattttaaactttatttgattctaataaaactttaagttaggtaaccatatctggctactagctactgtgttggacagtacaactccattggttgcttttgagagaaaaaaaagcaaagcaagggtaaaagaaaagaaagaagacctcagaatttcaggctcatgatctttttttttttttttttgggacagagtctcgctgtgtcacccaggctggagtgcagtggcacaatctcggttcactgcaacctccacctcccaggttcaagcgattctcctgcctcagtctcctgagtagctgggattacaggtgtgcaccaccatgcccagctaatttttatattttagtagagacggagtttcaccatattggccaggctggtctcgaactcctgacctcaagtgatccaccctccttggcctcccaaagtgcagctaatttttgtattttagtagagacagggtttcaccgtgttggccaggctggtcttgaactcctgacctcaagtgatccacccaccttggcctcccaaagtgctgggattacaggtgtgagccaccgta

SEQ ID NO: 109833 - DNA, 1050 bp, Homo sapiens
gaagcccaggtattcctagggcaggtttcttgtgtaaagaggtccataatcggttatctgcaacccctgggagccagatgtgtttaggaattcagaatttttcatattttaggtatgttaccggccaaacatacggctggtttgaatttgaataatttactccaattgattagattacagagagttataatctttgagttcttcatggcctcttaacagtcccatcaagcaaaacaagcaaagcctgccagtgaattctgttattacctatctgagatcaaaaacaaactaagccctattgctttcctttaacgtctacaaaatttgtgctagactcctgtgctattaatagaaattgaaaaacaagatgttgatttagctctatgatgtaggttgctcacagattttttttctttccttatgcagactgtttgcaagtgatttttcattttacaattacaaatgcattttttaaataggtaataaatctcctaatggaataagtgactatccaaagatcagagtgacagttacccgagatcagccacgcagagtcctgccttcctttgggtaagtgttaaattctttctgtaaatggaaacttagcatttattaggtgctcactcttgctaggcagtctcacttttgttgtattatgtagtcctgctaagcgctctgaggttagtaacttgctgaatgtcatgcagccagtgagagacttgaacttaggggtgtgttatattttcttttcttgtcttttttttttttttttttttgcgatggagttttgctctgtttcccaggctggagtgcattggtgcgatcttggctcactgtgacctctgccttccaggttcaagcaattctcctgcctcagcctcctgagtagctgggattacaggcacccccacaccatgcccggctaatttttgtatttttagtagatatggggtttcgctatgttggccaggctggtctcgaactcctgacctcaggtaatccacccaccttggcctcccaaagtgctgggattacaggcatgagccaccg

SEQ ID NO: 109834 - DNA, 1061 bp, Homo sapiens
taattttcatacactggtcatatccatcagttgtaaaatgttattattaatagttttcttactttcctttgtagaatttttattgcttggacattagaccttctagattgatctaattttcccatacattctctccttttgttgttcttgctttttttttttttttttttgagatggggtcttgctctgtcacccaggcagtttggtggcacagtcttggctcactgcagcctccgcctcctgggttcaagcaattttcccacctcagcctcttgagtagctgggcttacaggggcgtgccaccatgcccagctattttttgcatttttagtagacacaaggtttcaccatgttggccaggccagtctcaaactcctgacctcaggtaatccacccacctcagcctctcaaagtgctgggattacaggcgtgagccactgcgtgcggccttcttgctctttttaaaaacattttttactaattcttttttgactgtcagtttttaagttagaaaagttctccccctgcctattcccagtgttttttttctttctctaagcatcttgttcttataaggatgcaaaatctttccttatctctctaaagctgtttattattttaaaatatgttttgagtgctcccttctggtttatgccgtctccctccatgtttgtttattttggtctgatctttgaagttagagtctttattcaagtacttggtactccttggctatccacttatatttaggaatgagaaactaaaaactagcgccctctggaattgaataaatggctgattgtagggctaggaaagaaagtataaagtgagtctgaacatcttgtgccagaaagtaaaggagtgttcaaaaactgggcatgccaccctgacagaggaggagatttcaaaggggctttcactggccagatgggataatttaaacatcaaaatgaataaagacagggactcagatgctaataaataaatatatagtgtcgaggagggaaagatctttatagtagaatgccaactagtaagtgtggaaggaatgataaaattag

SEQ ID NO: 109835 - DNA, 1149 bp, Homo sapiens
taatttagcattcagcagatatttattgagggccttttggcttagaccctgtactaagataacagtggtgaaaggatgtaatctcttttcatggaatttaaagtttagtgtggaatatagacattaaacaaataatcataccagtaatgaatttcagtggttccaggtgactaaaggaaaaatgcagtatcagaaggggtatatgcaataggagagctaaatctagagttggggttggaaatgggcatgaagaggaaggcagagactctctttgtgtggcagctctagtttagaaacagacattccatagtggaatgctgcggtgccctgtgctctagggatagatctaacttttgcataattgtacttgtctgacttgccaggagtaagcttgacctaaagcaacttaatcacaggatggtctgggagcttagattccagcaatttaagcagcttggtgatactttttttctttttttttctgttgctcagttttactttgaactcagaaggctgtaatagaagaccaggtggccgtcgccatagcaaaggtaatccagagagttctttaatgtggaaacctcaggaacaggctgtaacagagatgatttctgaagagagtggcaagggtctgaggcgtccccattgtactgtggaggaggtaagccttttcagcttgatttctttaaaaaaaattttacagctcttcccaaggatgctgcctagagacactcagaatggttcaacgtttgacataccattgtaggttttcctacaatacagcctccaacaaaatgaggctgtcttaaacccagatgcaccaaaaatctgcatgcagcatgtgcccaggcagactttgaggggttcatgctatgagacctaaagttcttatgagattgtccagatcacattagcaaggcctatagcggccacgtgtgctcagtgagtctgtgacaggatcaagcatgttgcttatcgaggagcagaaaatcgttgtgaaagtattgaaggcacagacacagagtcagacagctaaatttaaaaatgaaacttttttcagaaataaaaattaaaagactaaaaagaatttttaatgaatatttttgggagcaaataatatatctactatgttatatatttcttttttcc

SEQ ID NO: 109836 - DNA, 1737 bp, Homo sapiens
tctcctgcctcagcctcccaagtagctgggattacaggcatgtgccaccacgcctggctaattttttgtatttttagtagagatgagttttcaccacgttggccagtctggtctcaaactcccgacctcaggtgatccacctacctcagcctcccaaagtgctgggattacaggcatgagccactgagcctggccaagattagattctttttgggtacctgaattagtctaacttgcttttttaaaaaaatttaccaagtttttttttatatatagagatgggatctcgctatgttgtccaggctagtttcaaactcgtgggctcaagcgatcctccagcgtcagcctcccagagtgctgggattacaggcgtgagccaccgcgtccagtcataacttgtttctttttataaactttagtaactgtgactaaggaagggaagtaaatggtgtgcatctctgctttttccttcacctttcagaacactcagcatgatgaagagtcaatctttttactttccttttgaggttttcttttattccaggaaaatttagaattattcctgtacctggcactcccgaggaccatctgctatttcacttgccaacagttttctgagccacttgtttaatttagttcatcaaagaaatatttattggggtcccaggtactgtgctagttgtactgtgctagcaattcaagattaaatgaaatgtggtttctgccctctacgagcttatacataaatagttgctatttgataaggaggcagagagtaatggaccatatccctgaaaggggttttaagatgaggtgttaaatatttcagtctcttagatgagaaatcagaaatgggactgagccagtatctacaggggaatatgcagaagatatactctagaaatattggtaggtagtattagcaaggacgttatctgttgattaagtgtgatctaaagtagatagaagggtctgagtcccagatttcagttttgggaatcactatgtgtcacttacaaagataaccctatgtttatggggaagatgatgactccagtcttggacattgtttaaactccctgtgaaacccacaagaaaacctctcctggaagctcgtggatatatgtgatggaaattttgaggagacacatttctgaatctttaacctgttggtgttatttaaatcaagggagctgatgagattattcagggaaggaatgtagtgcaagaagagatacgggcaaaccatcagtatgatgtaggcagaaggaataatctccagtggagacagagaaaaaagaatcagaagagcttattgtctaggaaagcaaggcaggtcagcagggtgaaatgctgaagagagatcaagtaacataaggactggaaaagtgtctattaaatgtagccatagaggttactggtgatgttggtgaggccaattcattttggaaactgtatattctcgttatgcaagcagatgatttctgctgagtttttttgtagttaacctaattctgttcaacccagttctgtcaaaaacctagatgccatcagaatttagcagataacatgaataaagtgggctggagagcagtggcccatctaaatgggatagccctacatatagattgtggattcagttgatcaaaggaggctagattatttttaaaaaatgtataaagttagtaattaattcaaagaaatattaaaaacatagtgctggcaaataaaacacac

SEQ ID NO: 109837 - DNA, 1961 bp, Homo sapiens
gctacttgggaggctgaggcaggagaaccacttgaacctgagaggtagagatttcagtgaggccatgatcacaccactgcactccagcctgggcgacagtgcgagactccgtctcaaaaaacaaaaagttcttgcttttaatgtattgtttcaggatccatttaaatacatagcttaaaaagttttttatcttttaatctgagttttatcacactgagatttttcagttagtgcatcactggggattcagaacctctgattttacaaacagagaaactggaggttaggtgacctggctgaaatattattagaatcatgattagactccttttatcctagtcccacatagttgcttcctttctgttgtaatttgatataatagtgtaatcaatcacccctatttggagaagcttgctggacagagataatgcatattaatggtagactttgcttttgtatctgatctccctcactttttgtgtttctaagttctcaaagaagtcagatggacacattaaagaccaaaggctggggggaagagcaaaatcacggagtcaaaacaactcagtttgttccaaaacaatgtgagttcccagatttagccttgtcttaatatattgaccttagttcatgctacagtgttcatatgaggtagaaaattgacattcaagtgtagatggtgtaccaaaatactgtcaaatctcacagcattgggccgggcgcggtggcttacgcctgcaatcccagcactttgggaggccaaggcagatggatcacctgaggtcaggagttcaagaccagcctggcgaacatggtaaaaccccatctctactaaaaatacaaaaattagccaggcatggtggcacttgcctgtaatcccagctactcaggaggctgaggaagtagaattgcctgaacctgggaggtggaggttgcagtgagccaagatcacgccactgcactccagcctgggtgacagtgagactctgtctcaaaaaaaaaaaaaaaacctcacagcattgactggggcttatctaggaatttagtagaaaagctgtttcagggtgaagtagattcataacatggctctggattattattcctaagctgctagatagtagcaactattttgtgagctgaaattttattatattccttatataacaatttccttatacttctccacttactgtccactaaatgacagcttaccagataagcagatatcactcagtttatagtaaagattatatttaaacagcaaagatatgtatgcatttttttaggcaacttagtatatagggaggctagtgtctttggaattcactgtagcatttcaatgtagaggaatgtcttgatgttgtggaaactctgtaagctgaaattctaactatattattcatcgatgaaggaaacatttaatcttttctttaccatcctcacagatagacttgttgaaacaaggggacctctatgttcattgagaagtgaaaagaggtacgtacattcagttcattctacactttcttttaatatatattttcttactttataagctgtatttatgagtaagcagttctgaggaattgtgaactctcttgagttctggtagttggtcagcatatagggtagataggtagctagctgttgtgtcagatgcccaccctagcctggtgggttgaggggggtgccccttatctcccaggcgtcaggggttgggagaaacacatgcttcttagatgggagtttggttggagtggggatgtctagtgtcagtgtctttaggataggaacagtaaaggcagctctgcatgctttaggattttgggatgatggtttatagcagagtttgtaaactatggcccatgggccaaatctggtctacttgcctatttttgtatagtaaatttctattggaacatgcgaattcatttacatactgtctggctgcttttaaatta

SEQ ID NO: 109838 - DNA, 1126 bp, Homo sapiens
cattcaaattaagtggtacattaatgttttgtgcattttctgtaatatcaaatgacttttttcaaggataaactagaaccaagttgagttactataaagatagtagggatttattctgagtgatgggattgtgggtcatattttttgctgtttaaaactttcataatatcttttaaacatactaattttaattgtgataggagaactgaaaatacttttcttgctacttccagggaaggtggtgagtgttctgtttgatggttcataactgagggtcctgtgaggcctaggtctggagctttttttgctcccccttgcagggacagacagatagggtaaatctactcacttgggggatttgctaattctcttttctttcacattagtggcagttttatatttcatgtgtaatctgtgtttatatttgcaagtatcaaacatgtcagtagaatttagataattttttgatcagaggaggggataccaactggagcctgacctatcagaagaagtgtcggcccgactccgcctgggcagtggaagcaatggcttactcaggaggaaagtgtcaataattgagacaaaggaaaagaattgctcaggcaaagagagggacagaagaacggacgatctccttgaacttacagaggtattgttctttgtattgatcctaaaaagaggcatgtctttaaataacctcagttattctaacttgaatgttttgttttgaggactttctccaggctaggggtgaatatatgaaaacatgtcaggtccatggtctgttgattcactttgactacattgatctttagtgaggcatgatcattagtggcctaagggatcagattgatattcagcaaatggggagtcgacacagtcatctcatatcttggaatacaacagattctttgtaaattctaaccttcaaatatgttgagttatatagtatgggtttggcattaagaataagttcattgcattttttttttgaaagttattatagtttactaaaatgccccctttgttgattattgcatttgaaaatagtaaaaacttacagaacataaagaatgaaggtagttaaaattcttattttaaagatgtgcccacatcttggcttcct

SEQ ID NO: 109839 - DNA, 1096 bp, Homo sapiens
tattattattaaattattgtttccacaagctaataagtgaaccaggatttgttgtaagtattacttacaacaattaagtaaggctgctttgtagttataagttaaaatattttcagggctggtgcagtggctcatgcctataatctcagcactttgggaggccaaggcaggtattgcttgagcccaggagtttgcaaccaacttgggcaatataatgaggccccatctctatcactaaaaataagaaaaaaatgttttcctactgtagtttagtaggtctttgatagtatatttttctcaagagtcaggtgttgccgagatgaaaaacttttttcagtctcggagttttcaataactgataatgaatggttctatattaaaatagcaacttctgaactttctaattcaggacatggaaaaggaaatcagtaatgccctaggccatggcccacaggatgaaatcctaagtagtgctttcaaattgcgaattactcgaggagatattcagacattaaagaactatcactggctcaatgatgaagtaagttgtattccctcccccttttggctatcattaagtttatttatttattatctataatcaaagtgactcctacccagttataatgggttggtaatgcaactcttagttataattaaaacaaaaacattttaaatcttaaaaagatggttagttctgattttctgcctttgattagcgatgtttcccttttctgcgtctgtattttattgcatccaccacttcatttactggtcttcaataaaccctgggtacagctgataaacgggaggaagcagcaagtgatactgtattttaggtgaattcttatagtagctatttttttgtttttgttttttggttttgtttttgagacagagttttgctcttgttgtccaggctggagtgcaatggcgcaatcttggctcagcgcaacctccacctcctgggttcaagcaattctcctacctcagcctcccaagtagctgggattacaggcatgcgccaccatgcccggctaattttgtatttttagtagagacagggtttctccatgttggtcaggttggtctcaaa

SEQ ID NO: 109840 - DNA, 1106 bp, Homo sapiens
ctccatctttccaaatatataaataaataaaattaggcaagcatggtggaccatgcctgtagtcctagtcactcaggaggctgaggcaggaggatcacctgagtccaggacttccaggctgcaatgagctatgatcacaccagttcactccagcctgggcaacagagcgagacctggtctgtaattttaaaaaatagtaaaataaaataaacataaaattttttaaagaataaataaataaaaagaactaaaagggttgggtgaaggatgggacattaaaaaaaaaactaaaaagagactctgcagagtatgcttataatatatactattggcctctatacacagggcagaaaaaggcagcattatttttaaaaaatggcctttatccaagtccaacaattaaccattaaccctctctactcaccaccaggctccaatgtaccttccgatgaataggcaccagaataatttcttgttcaaagagatttacccctttggtccatcgtttcactgcttggtaacccccagactttaatttaggatagaagaaagtactgaatacatgaagtgctggatagccttgctttttatttctttccaccagaagattcatgtaaaaattaatgacctacaaaataccaagggagcaaaagctggaacatggcaaacatattatcaaaactaaatttctacctgaataaggatgaattcgaaggtaaggtactaaagaagaggataaaaagactgtctatagtagaagacagggaaaaaagtgatcagtgcaaaatgggacacatgaaaatgaaatgaaactgtacttttaaggcatgtgagtaacacttaacagccagaagaaggaatccaggaagaaagtctgtgcaataatggaaagatctacataactgtatcacaccaaaaatacgcagaaatattaacagtaagtgaattttactacatataaattagacttcaattttaaaatattaacttgaaggacatacaccaaaataatattttatttatctctgagtggtgatactttttttttgagacggagtcttgccctgtcgcccaggctggagtccactggcgtgatctcggctcac

SEQ ID NO: 109841 - DNA, 1711 bp, Homo sapiens
ccatctcatagttagggtttccaatcaaatgcagagccatggagaattaaacagaagaacagaacagaaaggaaaagcagtattcacaagttacatcttagacctgtggcttcagttctcacaaggcctgtttttcccttgctatgatctatgttttataccacatagagtaagaataattgtgttttttgtatatgactgtgtgtttaggtaatacctgatttaatatttacctttataatattgtttacagcaatatttagaaaaagtccaaggaatttgtatttaatgatgttttaccctttcctctcttcttttttctttgtaattttaggagattcctcaacagctgaatgggagtgattgtggaatgtttacttgtaaatatgcagattatatttctagggacaaacctatcacatttactcaggtgagtgaagaccctcttcatccatttacttgttactaagcaagataaggcacttggccagtgcctggcacacattcagctctcaatagtagtagctggccaggcgtggtggctcacacctgtaatcccagcactttgggaggccgaggcgggtggaccacctgaggtcaggagttcaagaccagcctggccaacatggtgaaaccccatctctactaaaaatacaaaaattagccaggcgtggtggtgcatgcctataatcccagctactcaggagactgaggcaggagaatcacttgaacccaggaggtggaggttgcagtgagccgaggtcgcaccagtgcactccagcctgggtgacagagcgagactctgtctcaaaaataaataaataaaataaatagtagtagctgggctcatgcctgtaatcccagcactttgggaggccgaggcaggtggatcacctgaggtcaggagttcgagaccagcctgaccaacatggagaaaccatgtctctactaaaaatacaaaaaattagccacgtggtggtgcatgcctgtaatcccagctactagggaggcaggctgaggcaggagaattgcttgaacccgggaggtggaggttgtggtgagccgagatcgtgccattgcacttcagccgcctggggcaacaggagagaaaccctgtctcaaaaaaaaaaaaaaaaaaaaaaaatagtagtagctgtgctattcttattgctgtaaatcttggttttagccctactcctgccagaatcagggttattttatctgctctcaggtttatcctagtctttggtgacacaatgggcacaatttgcaaatctctgaactgtggcattcattggttcctgtgtattattatttctagccaaagaaagaggtatgtcagtgtttaatagcaagggaaaaatcggcctgtgagaactgaagccacaggtctaagatgtaacttgtgaatactgcttttcctttctgttctgctcttttgtgtttgttttgttttgttttgtttttgagatggagtctcgctttgttgcccaggctggagtgcagtggcacgatctcagctcactacaacctctgccttctgggttcaagcaatactcctgcctcagcctccccagtagctgggactacaggcatgcgccaccatgcccagctaatttttgtatttttagcagagatggggtttcaccgtgttggccaggctggtctcgaactcctgacctcgtgatccacctgcctcagcctcccaaag

SEQ ID NO: 109842 - DNA, 1036 bp, Homo sapiens
tccacctgccttggccttccaaagtgctgggattacaggcatgtgccaccacgcccggtgacatcactagtttatagtaagggacatccaactatttataatgatacatcaggagtgcctcaataatgtgaacttctttttttgtttgagacggagtttcgttcttgttgcccaggctggagtgcaatggcgcaatctcagctcactgcaacctccgcctcccgggttcaagcaagtcttccgcttcagcctcccaagtaaccgtgattacaggaatgcgccaccacccctggctaattttgtatttttagtagagacggggtttctccatgttggtcaggctggtttcgaactcctggcctcaggtgatatgcccaccttggcctcccaaagtgctgggattacaggcgtgagccaccgcgcctggccaagaatgtgaacttccgtatacactagaaggactagttgtactacgggtaattttggagttgctttttgtgttgctgctttgcaaattgcccatgtagtgattctcagttaaagcagaatcatttattaagcaaaacatctcattgtttcatgttgccaaatagcaaagcagttggctgttctctgaacctaataagatgagattttaaagggagaagttgctgtttgaacagaattggcaatgtacaacgcctggtagagcagaaagaaacttgtagattttgttgttttttatttaaataaatacgtttttctcataaaaaaacagaatatgttcattttagaatgttttgaaaattcatataagtagaaaagttgcctattgtgccaccacgtggatatttgcaggactgtgaagttgtactatactgtataattctacatcctgctttggttttccttaacatataaaaatgcttatggtaggccgcctgtggtggcttttgcctataaataatctcagcactttgggatgctgaggcgggcggatcacctgcagttaggaggtcaagaccagcctggccaacatggtgaaaccctgtctcta

SEQ ID NO: 109843 - DNA, 1469 bp, Homo sapiens
ctatgaatgtgggaaatgcaggatttattctgtgaattgtttgtttctgtgtgtttgttcagcgtattcattcactcactcgtttgcaaacataatgggcagtggtcatttactgctgctcttttacagttagctctaaattacttgtttgaactatttatttctgaaaggaatgttactcaagctgccactccctgctgaagagcaggagggaactctcactgggggcggaaggaagtggagctggagcagtaactgccaacatgaagctggagggtttgggattttttttgtttttgtttttttgaggctcaaaaaatgctgggagaaatgaaaatgctgtgggatagggctcctgttgcctttcagaggaagtctgacactacagcgttggcacagtgccgtgaacagtggaactgtgcccaagggactctgattatccaagcatcttccgaagagtgttgtggtcaccttaaagagacttccccttctggaaatgtggtgacttggcttagtcttcaaactggattcatggatttgaagtaactgtaaaccctaaatcttcattttcatcccagatctggttgagtataaacctcagaattgtaggggctggcctgagctgtttatttcaaaagatactattcaatttaaagctatttttcctcagagtttttgttttctatatattaagtctaaattaagttttctactcattaagactaacatctccccactccatccccactgaaatttgtggaagaaaatttagtacttggctctgaggttgccagttatacaataatctattttgcatatgaaagtttgtatttaacttttttgttcattaaaaaccttactgatatggttataacttcagacagtttagagttggtcagaacatattttgcaagatctagtgcctagtgttgcttttctgatgtaataaaaggtggtctggcagaacctaaaaaagtatatgctgaaatgatttctaaccctctccctacttaaacctcccagacttgttctggttcataaaagcaagaggtaaaactggaaaaattgtgcacgtgttacctatgaatctacacgcctgccatttgcagtgctccggctgctggtcccagaggtatactggttacagctattgcagccagttccctgagacttgtaaaactcctggtttaggacatggggcctgtggtgtggatggaaaatgctgggcctactggatggtcagccagaggccatgtggtgggtgatgactgaagcgggagcaggttgtaccacacctctcccccccccctcccactccccctccctccctctcccctccccctccctccctcccccctccctccctcccccccctccccctccctccccctccctctctccctaacacccaccctccccctttcccccaccctccccccttctcccctttccccaccctccctcccccc

SEQ ID NO: 109844 - DNA, 1555 bp, Homo sapiens
cataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaagtctttgggaggtctcacggtgtagagaggagctttgaggccacccgcacaaaattcacccagagggaaatctcgtcggaaggacactcacggcagttctggatcacctgtgtatgtcaacagaagggataccgtctccttgaagaggaaactctgtcactcctcatgcctgtctagctcatacacccatttctctttgcttcacaggttttaaactggttttttgcatactgctatataattctctgtctctctctgtttatctctcccctccctcccctccccttcttctccatctccattcttttgaatttcctcatccctccatctcaatcccgtatctacgcacccccccccccccaggcaaagcagtgctctgagtatcacatcacacaaaaggaacaaaagcgaaacacacaaaccagcctcaacttacacttggttactcaaaagaacaagagtcaatggtacttgtcctagcgttttggaagaggaaaacaggaacccaccaaaccaaccaatcaaccaaacaaagaaaaaattccacaatgaaagaatgtattttgtctttttgcattttggtgtataagccatcaatattcagcaaaatgattcctttctttaaaaaaaaaaaatgtggaggaaagtagaaatttaccaaggttgttggcccagggcgttaaattcacagatttttttaacgagaaaaacacacagaagaagctacctcaggtgtttttacctcagcaccttgctcttgtgtttcccttagagattttgtaaagctgatagttggagcatttttttatttttttaataaaaatgagttggaaaaaaaataagatatcaactgccagcctggagaaggtgacagtccaagtgtgcaacagctgttctgaattgtcttccgctagccaagaacctatatggccttcttttggacaaaccttgaaaatgtttatttaaaaaaaaaaaagatgacaaagaaaaacagagagagagaatattggagatgtcctgaattttaatagggtacgcgccattagggctttttgcgctaaaggatgaacatgtactggtttatgtggacaagccattataccaccagactgcaatgccagtttcctctactgcaaacagtgttctgtgacaaaaaaaaaaaaaaaaaaaagaaaaaaaaagaaaaaacagaaatatatccagctaacaagatcctggtgtcttggtgttttattttactaggcattgcctcatcccaggtgtcagctgagtcctagctctgagggacctgggcagaca

SEQ ID NO: 109845 - DNA, 1033 bp, Homo sapiens
tcttgactccatggtcagtgaaggcctccactccctgaaaacagagaggctgtcttctgccccctttatacccacatgtagcagccattaaaattggaaaggggggattcccaccgagagagatgctaacccacttggcagaccaccaccttccctggatttcactcaggcctgtgccctgcactctcttctgactctcagccctcctgacagatgcctccagtccctaactccccctccacaggctctatcttctggctgtttcccaaacatggctctaggggagctagtttagcagtaggagggtgggcaaggaggagattgttttttgaaagatcatctgcattttctactggaaggtgcaggaacaaacacagtgtagtttgaaaagtgccagagcgttaactttgaagcttgttggaatgagccaggtggtctgtagacccaggtatgttctggaatgtgacttactgacctgggtggggagatgaccactgagaagttccagtagagcctagtgcaggcttgctggcaaagtagcagtgttgggtggcaggaacttggcggggaggcgggggtctcttgagtcctgagtgtgtatgtgtatatatgtatatgtgtgttatttgctgtttttgtaaagcttttttttttttttttttgagacagagtttcgctcttgtcacccaggctggagtgcagtggtgccatctgtgctcactgcaacctccacctccctggttcaggtgattctccttcctcggcctcctgagtagctgggactgcaggcgcccgccaccatgcccagctaattttttatatttttagtatagacggggtttcaccattttggtcaggtcaggctggtctcgaactcccgacctcaggtgatccgcccgcctcggcctcccaaagtgctgggattacaggcgtgagccaccacacccagctgttgtaaagctctttacatagaaactcttaaacggaattcaaaaccaagttctagatgtaatgagtcagctttatacgaaag

SEQ ID NO: 109846 - DNA, 2033 bp, Homo sapiens
tttagctgaagttttttttaataaagcagggcatgcagaaacaaatatgtaacaaagatctctctaacaaaaatgcctgctcagcccagggtttgagtcgtgttacaagagaacctgaactcacagaaactgagagaaggaagctgggcgcagtggctcacacctgtaatcccagcactttggaaggccaaggtgggcggatcacttgaggtcacttgagctcttctttggaggactttgagaccagcctggccaacatggtgaaaccccatctcactaaaaatgcaaaaattagctgggtgtggtggcagatacctgtagtcctagctacttgggaggctgtggcaggagactcgcttgaacccaggaggtagaggttgtagtgagctgagatcgcgccactgcactccagcctgggcaagaaagtgagaggagatttggagcttggtgggcccagcccctatgtttcacagatgagggaatggaggcacagcgaggggaggaattttcagagccaggactagaaccaacgtgcctccatttctgctctgctgctgttttacttatgacccacttgccgtggaggaagcggtcttgaccacacatactctaactcaattgtcacttccagctgactacccttgtgagctgagaattagaaccagagatacctttgctgcaagctcgactccaatttaacaccttggtggacctgcccttccttccctttgggccctaggtgggttggcagagcctacacatccctcttcctagagcttttgactccctggttatttcctaaaacttggctcaatgagaggaggcccatcacagctggtgctcaggacagggacaggcagtaactactggcctgtgtctgactgtccctgggtggccaaaaacccaaatttgatactgggcattacagtcatgacttcctaagaccagggtggaggcagcatggcatcagacagaaccaggggtaacggcagaagcaagacctggaacctcctgctggtatgcttgccgtccacttagacaagaaagaggggctggggaatgcagccgagcatcagcgttttcctctcctgtgaaccacagattgcccctgcggaaggcccagacgtcagcgaaaggatggtcatcatcaccgggccaccggaagcccagttcaaggttagtgccaagggacacctcagccctgcaggctctgggcacagagcagccacctcagaggcacattcaaggctcttctttggaggcccagcctccatttccctccctgctgctgcccaccaagctcaggctcaccctgtcatccctggctgttcttctgcatgtttgccctctgctgggaagccctctttcccttccctctcatggaaaagtagatcatctgttggtgcccagttcgagtggcccctgctctggcacctctgatcccttagccctggttttgaggatggatgtctccggctcatttagtcatgtctacccttcaagctatggaggactaacacaggtgtaaggggaagtagcatggtttgttggaaggttttttggtgaggtgtgttttgctttgttttgtttttgcctttttttcttccctaggaaaattataactcgagctttctaaaagtgagaaacacatatttatttatttataaaagtacaatccttatcattaaaaatatttaaaatttagctgagaagaggaaattcacacatgtggaaccactcaaaagcaatagcctcagccaggggcagcaggtggtggtatgctcctgtagctctagctactggggaggcagaggcaggaggatcccttgagcccaggagtttgagaacaggctgggcaatagagcaagacctcatctctaacgaaaaggaaaagataacaaaaaacagtaacccttcaactcagtattggacaacatgtggaatatccatttaacagaatgttattcagccacagaaaggaatgaagtactgatgcatggtgcaacatgggtgaccatcacacgaagtaaaag

SEQ ID NO: 109847 - DNA, 1026 bp, Homo sapiens
aggagaaagcctggttggaatgatgtcttctttcttgtctcgccctcccagtatccagagcaggagattgtgaatctcttcatcccaacccaggctgtgggcgccatcatcgggaagaagggggcacacatcaaacagctggcgagattcgccggagcctctatcaaggtgaggctgctcctgacggccctgtggcccttctaccacctcctctcatcccacggcccttgttccctctcagtcccaggcagcgccacaccatgcagagacagagtcccacagagatctagaacatttgccccatgactattcccgtccgctctcatctttccttttcttattcctttactgttcagctaaccactgaattagaaaaaaatagtagcagacaacccaacccagtcctttttgttttatcattgttgtcctcaagaagataaagaaaggttgaggattttcccaagctaagggaagggactgcggtgaagtgataacttagcaggtaccagtatgcggtgctttaatgagtctccacttcacaggccctgaactaccagaaaataatgtggataaaaaactctttgaaaagcaatgataaaatcataaacaaaagctgagggtctaacccgatatgcaacccagcctgagcatagcaactcaggaaggacggtccttgacttatggaaaggctgcgaatgcagacgtggctgcagctccaggcccacatcctgcctccttgagcacagtgtggagaatcatcagagaagctgaaaggggaggattatttgcccctggtcctgctccaagaccagctatcagctctgactcacgggcagaatgctgagcacgtcccaagcctcatgaaacattttcggaaacagagtttttgttgttacgcaaaataatttgctaccatgggacaacccagaattccaaatgagaagtctcatgacttggagagaaagaatgcttacactttctccccaggaagagctggaatttctcccacagcaagtgtgctagagg

SEQ ID NO: 109848 - DNA, 1556 bp, Homo sapiens
ctgggcgaaagagtgaaatgccgtctcaaaaataaagaaataaaataaaagcagctactttctaaatttctattttcttaatagctctactttttttctgtccatatctgccctcctgttccctgctcctctctctccacattcattttctttctctcctctctcagtcactctctctcttttttttttcttatggagacagggccttgctctgtcgcccaggcatagcaccagtgcagtggtgcaatcatagctcactgcagcctcaaattcctaggctcaagtgatcctcccacttcagcctcctgagtaactgggaccagagtgcacactaccacacccagctaattttttatttttattttttatacagatgggatctctctgtgtcacccaggctagtctcaagttcctgaacccaagtgatcctcccatttcagattcccaaagctcagtctcctttgacatttctcccttctcaggattctttccattccttctagaattctctgatggagctgactgatctatctgcccaggaacacatttgcttgttctgaataactcttgggtattgtccagcacactctgttctttttcatctacgactcatcattctccagaaaacggaaggcactggccccgcctctccacccgagggcaggttaagagtgtatgggtgcaagtgccagtgggtgtatgtgtgtatgtgtgtgttcacacccatggtatgttcctaggacgcctcaggcatgactcagcttagaaatgatgaacatttagcccagagagctactgcaaccaggggacatcttgccaagcattccgtggtctgagtgggagaagtggagcagagatctgagacacagagggacaggcgtgtagacacgacagtggagccagctgatgccacagagagcctgtgtcgcatgttgggaatctggcctccctgaggccagtgacagtccctgagagcacccgcccactgactctttctctcatgctgcagacccactccggatacttctccagcctgtacccccatcaccagtttggcccgttcccgcatcatcactctgtaagtgccccctcagttcagccgcacctgccacttctcctggggctaggcccacttggcccttggtggccagtgaatgttcacaatgcagatcttgtctcctgtggttctggtttgtcctgggagtgacacacctcaaagcctgagcacgccaaactccccagcacccgagtgctcttgaggttctgcagaggcctaggccgttgctgttgcacctgtggatgctcgcacacctcacaggtcgcaggaactgctgcagatgggcaagcagaaggccagatgagcacgtgctgttggcactgaatagcagagtttccaaagatctttgaacaaagtctagcaaatgagaatgtcatttgcacagaccccacttgcaaggacccctggcagccttgcccaagagcctctgccttttgtcacagggtcccaggagggatggttcaccccatcttcctggagccagtcaccgtgcagctgg

SEQ ID NO: 109849 - DNA, 1034 bp, Homo sapiens
tttttttttttgagatggagtcttgctctgtcgccaggctggagtgcagtggcgcgatcttgtctcactgcaacctccacctcctgggttcgagctattctcgtgcctcagcatcccaagtagctgggattacaggcatgcatcaccacacccagctaattttagtagagaaggggtttcaccatgttggccaggatggtctccatctcctgacctcgtgatctgcctgcctcggccttccaaagtgctgggattataggcaggagccactacgcccagccccctgagtcatttctaaatctcttcataccacctctttagttatatcatttccccttaaactgaaggaggggactgacactgagccttgtgtgttgagtagcctgaagatgcagtatgagggattgtggcagctgtcagtcacatggctgcgccaagcagtaagaatagcttgggagtttcacatctctgtatttttgctgtcagatctgagaatggcccaatgaggtacaaccaagtggcattgaggcacatcatcatttcttgggagagaggctgtacatacagccccacagaagataacctcaaacgttaggctaccctcttagtataggtaatataagtggggagagaaaaagggcataataaattagaccaattctaaaatcggtaatctaggccgggcatgatggctcacgcctgtaatcccagcactttgggaggctgaagcaggtggatctcctgaggtcaggagttcaagactgacctagccagcatggtgaaaccccgtctctactaaaactacaagaattagccaggtgtggtggtgcacgcctgtaatcccagctacttgggaggctgaggcaaggagaatcacttgaaccctggaggcggaggttacggtgagctgagatcgtggcactgcactccagcctgggcaacagagtgagactttgtctcaaaataaataaataaataaataaattggtaatctcaaatataggagtcagcatgctacaacctgagggccaaat

SEQ ID NO: 109850 - DNA, 1062 bp, Homo sapiens
caagatatgtagacatgcccaagtgtggcagagaagccttgaaggaacaccatggtcaggttaagatgtggcacccacctctgatacagggtaggaagagcctgggcagagctgattaggagacgctggtgccattaagacaagagagggaggttgacccaggcgtgcgggcctctctggtctcctcccttcatcttttttctccatttctattcccagcaacaagccaatctgatcccagggttgaacctcagcgcacttggcatcttttcaacaggactgtccgtgctatctccaccagcagggccccgcggagctccccccgctgccccctaccaccccttcactgtaagtagctcagcttgtggaggtttgcttatgcgctgggcacctccaggcagcagcatgcctctgctgtgtggaatcagaacggaagctttcatttaaaggccatgctcgagtagagatgaatccaatgtaggttgaactcaacatttcttaggacttcttcctaatgggcaacttaatattaaaccaatcctctaaacacgtgttcttaaatatagtatgtcataactagcaaagaaagaaactcatagcaaattcatcaactagaagctaatttattatagaaaagaacttgttagctcaaataagaacatttcatgagtgatggtaatttattaaaatatatagggtacctggatgattcttgaagagagatatatatctacatacatacatgtgcagtttctacctatgtttacaagtcaaatgtattgtcttattaataggcaatttttaaaagaaaatattacatacattgtttatgtctaaacacttagcacaatgcctggtatttagtaagttctcaataagtatttgttcacaacagaagaagaaatgtgaattttgtgagtgttttacttattgctttcattcacaagcattattcaagatcagtacattaccaaattgggggctcaggatacttgacagctttttttcattcctaatttttctctacgcagactgcttatttttaaaagcaaactttccccc

SEQ ID NO: 109851 - DNA, 1082 bp, Homo sapiens
ggcattcaaaaaacaaacaaacaaacaaaaacctttaaaataattggccatcagcaaaagtccagctcagctcagaggagtaaatttttttcactttttaattagatttttttggatgtatacaaaagtgaatggatgctccaataagtcctcatatacccataatccaccttttgcagttatcaactcaccacctgttttgtttcctctaaaccctcatccacatccactttccatacctgttggatgaccttgaagcaaatctcagacctgataatatttcttagagaaataaatgtcgacaaagcactctttagattaaacccaggtccctcactgcagcactttctgttgtaccctctatactccaggcagtaatctgtccccatctcaccccgacccccaccttagcagcccacgtcacatgacaattatgaggtgtgatgagaagagctagagcaggagactgcagtggtgtcttctccccatgtttggatatatttgtggaagtatcatctgacaatctcattttcttcctgtgggttcttgacatcttgtggtaaacatctctttctgtgaacacctggaaaagctacagaagggcctgagtgattcatacatcttcacctgagcttaccacttaggttcattcatgtctgtgccaaagtcacgcactggtaggtgaataacaaaattactacatcttatagacaaaatgaggtaaagatgaaggatacgagcactgctattccaaaagttctaaaaaaaagaaaaaggcaagttacagtgtgaatgtagacaaagattagaaaatgttaggaaattgcttcatgttcagggagacaaagatggaagcaggttggacacagcctggaatgggtgaccacgttcctctgcctctgaagagctgtgtggctaaacccacccccagtctgtgtgaccatccccatgtagaaatgtaagataagcaagcaagcaagatgatcacaaagccgacaactaaatagtaaagagacaaagttgtaaaccatcccgaacctggctaatggagtttacgtatgtgggaatttacatcatgtgaa

SEQ ID NO: 109852 - DNA, 1020 bp, Homo sapiens
gctgatctttagagttctcacagaggtgttctggtctatctcttgttaatttgaggtgtgtgtgagggggaaagagacctgtggcttcctagtctgccatcttgctaacgtcactctcccttgtacctttttttaagagcaaggagaacattcttcacccaatagagttcttgtaataccctcattggccagatcagcctcatggatccacttccaaccagctactacgagggagtagaattaccatggtttggcttatgttaatcaaaattcatgaactggggtcggtgagggacctgacctctcccaaatcccatcatcacttggtacctgaacaaaatgacttccatttataagaaaaaagcaaggtaatggtttttgggagacaaccgttatacgtatctgaagtgttaacttgctgcttgtctcttttagagccgaagagattcctctgaaaatcttggcacacaatggcttggttggaagactgattggaaaagaaggcagaaatttgaagaaaattgaacatgaaacagggaccaagataacaatctcatcgtaagccacttactcagattactcatgcccaataatggaacacctgagcatttcgatacgtctagttcattcatctacttttccctaaaatgggaatataatcataagtgatgcaattatctccatcatcttttaaaaaaatacataaatacttaccaggtagacatttttcactatggatgtgatctaaatcactggtaagatttgaaataagatggcagggattctccaccacagtgtgttgggagggaattgagtcttctctctctccgccaaaacttgtttgtgatttttttattttttgggcattttatttttcccgttgaaaacaaaatttctcttttcttctcatgggtcagtttgcaggatttgagcatatacaacccggaaagaaccatcactgtgaagggcacagttgaggcctgtgccagtgctgagatagagattatgaagaagctgcgt

SEQ ID NO: 109853 - DNA, 1033 bp, Homo sapiens
ggcgcatgcctgtaatcccagctactcgggaggctgaggcaagagaatcacttgaacttgggaggcagaggttgcagtgagctgagatcgcgccattgcactccagcctggtcaataagggcgaaactctgtctcgaaaaaaataaaaaaaaagaaaaaggtaatagttcatttagtgttaactttaccttgtacacatttgtaagtggagatacaccaacaactcaactccacagcccttatctagctgctgcttgggtggacctctctacatgatattactctattgcttttattaaattcaaaaggtgctgctttgtaataaatttacaagtcctagacattaacctagtaaaattgggttaatgctactaaaaatatgtgaaaaggatagtgtatttcgtgtgtcattttaagaatataatagtggtatatcatttatcccctatcaaattgataaatatctttaaataacagcgctctgtgcatttgaagattcaaggacacaaatgctctctcctaaactgctatgggatcataaatgttgaaaccattccaggggcccactgggcaatagttaacaattctactaggaatttgtcctgtgtgcaaagttgtagttgcaaagatgccaatggtgacagtgtgtgtaactgtaaaaggttggatacaacagatatctaactataaaggatcagttgcaaaaactatggtaaatcaatagaatgttaaacagtcattaaaaattatactgatactgcagttgagtcatgtgtaaattatactgaaaggtacttagtgacattgaaaaatgttttagaatattaactgtttttttaaaggttagaacatagtatgtacaatattaacccatttttataagcaataatatgtttatatttaagaaagacagtaaagatagtggattaggattttatttgcacttacatatttctgaattttcaataatatgtatgatgattaaaatgagaaaaaaatgagtcataattttatactgatatttataagagtt

SEQ ID NO: 109854 - DNA, 1049 bp, Homo sapiens
tatttgaattccattgagttctgtgtttttaaatgttttctaaaaagatgcagatctttgagctggatatgtgccacctttgacatacccatggagctccacggcatctgagccacctttgacatattggtagagctccagggtgttcctgccatctttgacatgtcagtggagctccaggacattcacaccgggatatttgtggattgtgtagagacttgaaaaatgttgagccttggcatcaaaaccaagatgggagctgtgtcttgacatgatcgggaatagagggcaccatacctgtgacactgtgtctcctagactctgctttgccaaacacttgggaccacttttacctagagcttcctccatgcactgtgaagaggcagcacaagcctataccaaaacatcaattttgtgtgtgtaacattaggagggaatccacctcagtgagagcagcagccgagagaattgtctgagagtggttactcaatagcacctggtttgggttcttttctccaatccccatcctctttccagtgcccattcattacttcagggatggttaattttgagcttagctgttaatggacatgagatcaagtctcttaaaaaacaatgaggccaggcatggtggctcatgcctgtaatcccagcattttgggcaaggccggaggattgcttgagcccaggagtttgagaccaacctggacaacatagggagacccagtctctacaaaaaaacaatttaaaaattagctgggaatggtggcttgcacctgtagttccagctacttgggaggctgaggcaggaggatcacttgagcccaggatggtaaggctgcagtaagctgtgattgcaccactaccatccagcctgggcaacagagcaagaccctgcctctcaaaacaacaacagccggatgtggtggcacatgcttataatcccagctacttgggagggtgaggattacttgaagccaggagtttgagaccagcctgggcaaaataatgagacccccatctttaaaagaacaacaaaaacaagttcc

SEQ ID NO: 109855 - DNA, 1020 bp, Homo sapiens
ctgtctcaggagcagtgctgcaaatgcccagaagatacttttcttcctgccaacctcttttttatcttctaaagcatgaaatactatgatttttaaaaggaaaacagtggtacctaaagctgatatcttatctagctctttaagagtcccagaaaagtagattccaaactcctgatgtgacaggcaataatacatgataaagattatttttgccttgacctagaaaacagaatgtaaattcagtcatttactgactgcgaacccttgaaaaagtcaaataacctcactgactcagtatgcacaagtgtcaaattgagagagaaatttctacccttcctctgtcactggatagttgtgttacccaaagagaacctgtataaggcatttgtagacagcagagtcatacgtaagctgaagggattgttcaagttcacttaggaaaaattgcaaacaacccattttcttgtatatgatctattctgctagtttaattaatagttttaaagcagtaattattcagatattattcagtttatgctgctgcctgcccatgcccaaaggtgaagggaaagagctcagaaagaagacatgatttataaggattctatttcttagttcttatttccttcgacatggaaagaagactccccctgcttttttttttgaggcggagtctcactctgtcgcccaggctggagtgcaggagcatgatctctactccctgcaacctccacctcccgggttcaagcaattcttgtgcctcagcctccctagtagctgggattataggtgagcgccaccatgcctggctaatttttgtagttttagtagagacagggtttcaccgtgttggccaggctggcatcaaactcccggcctcaagtgatccacccaccttggcctcccagagtgctgggatcacaggtgtgagccaccgtgcccggcagaaaagaagacattctaatgattgggtgttgtaggcaagatggtcttgcagacatgaacctgtaaaagttacta

SEQ ID NO: 109856 - DNA, 1094 bp, Homo sapiens
agtctgtggaaacagtgactctatgataccatttcctagctgctattacattataaaggtactgtgcagaaataggcatttaaagatattaggttcacttttagcaaaaaaaaaaaaaaaaaaaaaaatctaaaactacgagctaggaaaaggcaaggagttggattgagtaaccaactctaattttattgttttattgaaattaagttctcagaattgctgagatcaatattgtcctatttttgttctgttcactactgtaccccaacacctaacataagtgcttagcctataatgggtccttagtaaacatttattgaatgaatttggaaaagcttttagtttaatcttagagatcatcccattctccagaatccaggtgaaatgtctgttaacctccagtcgaaaaatttgggtagagggggtttggattgttcattccacctgaccctcagttaggtgagatggtgctctcttgtgtgaaatgggagatactctttgatttacatggaaagagggaggagttcctctttgagggaggagcaagtgatttggccaaccctctcctgtgtttcctgctctcttggtagatttagggctatattatagatgaatttaattttccttcatcaccatgacgatcatgaataagatcaacatctgttataactggtgggaatagtttcttcttttcagaagtaaactgctgtcactttaacactcataaactggaaatgaaagaaattggcttgtttgaagaccagtgtctttagtaagcacgtgttcctcttacagtcgaaagacagaatgtgggatggagtgggccaggaaaaagaagccagcgcccagcagcaagtgcccctggggagcttgctgattgctgcgcacatgctgtgctccagacactgcttgggctgaagaggaaggaaaaaacagacacaggtagtaggggaggaaggaaagggacagattcaagtgctgtttggagaaccaaagagaacaattttttggaaactaattgacaagatgctgaaaggatggcacagttggtgtttgggcatgtgaccctcttggcctttacaaagatggttttg

SEQ ID NO: 109857 - DNA, 1043 bp, Homo sapiens
agtgcagtatacagaaaagaacaagagctctggaatgaggcatgtcagggctggaatcctggctccatcatagactagctgcatggccttgggtaaaagatttatcctttctaagtctctgtttagtctgtgtaaaatgggctgccagtatctcatgaggggattctaaatattgagagggcatatgatagacattcagtaaatgcctcttgccttccctgtgccaactttgtttatcctccactccatctaatttataatattcaaacagtgtcatgattgcatttttagttttattaagaaattgaatttttaggaaaaaagtaaatataggaagaggaaggattatgatgctactgcttctccagggatttcaagtaaagtctttttcacaaaaccattactcttcctcttcactgtttctggggccccctgaggtgttctcatccacagcactacctttttgttcacctgttcaacctgtgagtaatccaattactgttctgtctttgaggccaagagcctcagtccaagccagccatgttcatgctgtgtctgccccaagtgaggaggctaaggctggtgcatagcccgctctgtgaggcccctccccacagcctctggatctgcccagactaaccttccggagggctctgcgtctcccttgctgttcttaacgatctccattgctcctgtgatttctttttctttttcttttactttttttttttttttttgagacggagtctctctctgtcgcccaggctggagttcagtggcatgatctcagctcactgcaacctctgcctcccaggttcaagcgattctcctgcctcagcctcctgagtagctgggattacaggtgcctgccaccacacccagctagttttgtatttttagtagagatggggtttcacgatgttggccaggctggtttcaaactcctgacctccggtgatccacccgccttggcctcccaaagtgctgggattacaggcgtgagccaccgtgctcggcctcctgtaatttcttctgttgtttcc

SEQ ID NO: 109858 - DNA, 1108 bp, Homo sapiens
gtaattggcaaagagtattttaatagccttttcagataattatggatattcttctttgatactacaacaaaatttgacaagcagtagtttcttaaaggttagttgccatgtagtatctgaaagcatatgaacgttaatattctgttacattaaaattttttactaatgcagggttttgtagcattatacattagtcatttggaaaatattgagtcactgggttattcagatcttccggatgttgatgttgcaccatacaataccaaaaaattacattcatcactatcatgacgagtattgggaagctgcaagctcataatagtaaataaaagtattccaaaattctagttcttaagaggtcaaattttatcattggcaacaaatactgtgagttgttttatttgcagtgacaggcggactttattcatttcaagaaaaatgtgtgagagctacccagatctgaatggtcatcactgtctgtctgttctgtcaagtacaaatgacatacccaggaagaaagtggccatttcagctcccaattcaaatgatcacacagttgcctttcctgagacatcttacttcaggatgcagcaatagtgttttctgcatactttccattttgtcacaccaaatattttaaaagatctgcattccagggtcaaaatttttgtggaaaaaaaaaaagcagtaatctttactgctttgtcaaggacagttttaagtgaagctggctttccctcctccactaagagtacacaacagtgagcgtacgacttggtgcagtgtggagccactgccttcatgcagcctcaggcactggcagttttacccgccattgcttttgcaccatgagtgaaaatactaacacgataaacaaggcaaataacatcttggtatgattaggaaaatgggttttacctaataacccctgaaagggtcttgaggattccaagggtgtgcaggtcacgctttgagaactcgtggcgtagtggttaagagcatgactcggggttttgattgcctgcgtttgaatcctgctcctgctgcttatgagctgtgagcctttgggaggttattggaccttttcgtgactgtgtactctctgtaa

SEQ ID NO: 109859 - DNA, 1028 bp, Homo sapiens
aggtgagtgaattatttagtccttacccagtttttaatttttcttcatgtctttcctgttccattcatagagagacttgctaaacttttcattttcctaaactactgtttgtttgtttttaatgtgcttgttgcatttactttatttttggctctaatttatttatttattattattattattattgaggcggagtttcgctcttgttgcccaggctggagtgcaatggtgcaatcttggctcaccacaacctccgcctcccgggttcaagcgattctccttcctcaccctcctgagtagctgggattacaggcatgcgccaccacacccagctagttttgtatttttagtagacatggggtttctccatgttggtcaggctggtctcgaactcccgacctcaggtgatccgcctgcctcggcctcccaaagtgttgggattacaggcgtgagccaccgcgcccagtctggctctgatttattatctgttaaattttaaacacatagggctttctttgtctgcctttgctaacataggacttctggtgcttagcatctagtaaatgctcagtaaatgatgatgagtgggtactgacagtcttaaccattcctcagtttccttctccctttgactgtggagcaccctcttttccttgggatcaagcttcctgaaatatacggaaatggattgagaaaatatggcttatcaatcactttacattttctcaggttcctctttagtaaaataagaatgagaatagatgatttccaagattcttactttgtagggacaagggaatcagatgattgtgttctttggcagagcctagtctgtgaaatgtcttatgactatcagctttattgtatcctcccctagttcctagatgaatagggtggggaagcaggagaatgcagtatagtggaaggaagggaagtggggtgatgaacaacaggataagagaacattgtggtgggcaggttgggggagggattaacaggacagtagcaacattccagaaagaagctgt

SEQ ID NO: 109860 - DNA, 1073 bp, Homo sapiens
gggatgttccccacagaaaggtaagcattctctgacctttgttcacactacataatagataagccaggacagtgattctcagtgtggtcctctcactgtcaatggggaccttgttagaaatgcaaattctaaggccccaccccagattcacccagaaatactggaagtggttcctgcaacttgcttgttaacaagtcttccagggacttcttaagtgtgctaaagttcaaaacaactgagctaggagatagtccttacctacaaagagcttctattcttgcagtaagtccgcgtgggtgataaatgcccagatatcattgtatttttggtgtacttttaatttttgttaaagatgtgtgtttgcctgatttttctcaggcacaggctcatttctttctgggccaacctaattcatgctcttggcttggtgtcaaggacgttttttaacacactgcaactttgttaattgaaatagtgcctttcaatgagagatcatatcctggctaattccaagtctgattgcaggtcctatttaactttttacactgggtagtaaaacaagttttttctcaaaattacccagcggaagaagttatgtccagaaaagagaagcttatattagtgctgctgcacctgggaggaaatgtcatgggagttaccagagagattcagggatagatttggggatagactgacacagtgtgaggactagaggccagttcctactcagaagagcaattagctcattcatgaattgtttatacttcttgtatcaactttaattgcttgtttgaacttggactttagcattcattataattgttactgtctaatcaacaattgattgtgtattttaattcctctaagtgagttgaatcttcaagtgatgaccccaacttctcagtttttttctgcctctagacatttatctttaaggccaggagcctgataaataaactagtagacaattatcctttacaacagagccttgacatgtatatgtgtaggttaaattactgttctcagtaaaatcaagccagaaaagagagaatttttttttcttttttttcttt

SEQ ID NO: 109861 - DNA, 1024 bp, Homo sapiens
ttttttgtagagatggggtttcaacatgttgcccagggtggtctcgaactcctgagctcaagtgatccatctgtctcagcctcccaaagtgctgggattacaggtgtgagccactgcacctggcatcagactcttttaaacaaccagatcttgcatgcactaactgagtgagaactcacttatcaccaaggggatggtgccaagcaatttgtgagggatccacccccatgatccaatacctcccaccaggccccacctccaacattgggaatcacatttcaacatgagctttggaggggacacacatccaagccatatcagatcctgaaatgcagatcttgggagaaggatgctgctattgttttattaaatgtaaatggaaatcagaagggggaggtgggtttgaagagattttaaatttgagatactgggacatcaagaggaaatgtctacttagccgcaggaagtgatggctgtggcctgctggtctctttggattgcgcagttgccttatcttcgtgtgacacagaggcagactcggccaccccaggtatgacttgttttgggaagtgataaataatatttcacagggatatatgagttgattttttccctgtatgtcatatatcatcttttctgcatctttccctgtaacgttggttctcccaagatgaaagaccacatgctttgaggtgagaaacgagaagcagaagacacagacttggaggggctgagtagagggggcagaaggtttccttacaggcagagagcaccccgttccgcaagtacagttcccaggagttatatcacctctaacaccagagaaagcagtggaggccacaattgtatgtgtttctagaggtgaatgcttggtattggaaaggtaattctgacactcacagtagttggttttatgagaatcctttgagaagcacagcgtaaaatggaaagatttgaacttgatctcacacaaggtctttgattctttaacaatattaactaattaaaatgtatcttgtaaggc

SEQ ID NO: 109862 - DNA, 1001 bp, Homo sapiens
acttttgctaggatagagatacggctagaaccatggagtatcgtgagtgttggaagaacacattaagattttattctgtagtctcctgagtttcttttatttatttatttagagacaggatctcactctgttgcctagactggagttcagtggtgtgatcatagattagtaaacttcaaactcctgggctcaccttcccacctcagtctctagactagctaagactacagatgctcaccaccatgcctggctaatttttgttttaattttgtagagatggagttttgctgtgtttcccaaactggtctcaaactcctggactcaagcaatcttcccacctcagccttctaaagtgtcggattacaggcatgagccaccacgcccggccacctcctgagtttctgatcagcagagaaagattatcaaaacacgtggccatagatggaatggattgatgtgtatgggaggccagttaagagcttatagatatgtttaggtgttgggtaataagagcctgaactaggatattggttgaggaagccaaaaaaaaagaggcagatgggagaaatattgtgcagagagaagaaacatgatttgttgagttagtgactggatattgaagcctggcaaaggtaagaggaataatcaaagatcattcagtgatcctgtgttactctgtttttgtattgctataaaagaacacccgagactgggtaatttataaggaaatgaggtttaattggctcacggttctgcaggccatacaggaagtgtggtgctagcatctgcctggcttctggtgaggcttcaggaagcttccaatgatggcagaaggtgaagggagagcaggcgtgtcatatggcaagagcatgagcaagagtgagaagggggaggtcccagactcccttaaacaaccagatcttgcataaaccatatgagaactcactcttcagtaagggtatggcactaagccattcatgaaggatccacctccatgatct

SEQ ID NO: 109863 - DNA, 1782 bp, Homo sapiens
gtctaaatagttttattgctattcactggacctggtagtagcttcctctttgatagtagaattaaatatgcttagtggccgtgtatagcaccttgggctttatttaggtgaaagcatcccgagaaggatgagtttgctacccagccatcgggttcttagaacctccacattttctcccatcttcatgtgtgcctttggttttggaaaagggatggggcagtcagatacttcttttatgggaaaagttgcatttggagacattcccatacccatgcccacaaactctcctccgtaaacctgcctcattcccttctttggcatgttccgtatttagctttacagctttgctgccttgtggacaagaattttccccccaaaatcttgttaccattataatatcttcatccctattagaaaaccagaatcagagtgtcttccttgcacccaagtcccatagaatttctttcagccaatgaaagtcaaagataagtttgacatcagtcactggagatgaagatgtggggtgaagctgctgcagtggtgtgctttggagcagcctggtctacactcccttggtcctcgagcacttctgcgtgcctttcatgtattaatagatggacctttctcaattctcctcttttccctctaggtgcaggtggagtgtagagtgtgatgtaggtacactggcatctagaaatggagagcatagaggtgggggtggcactgaaggagggcagtgtgggatcaaggggggaaggagtggtctgagattaaggaggggaggtggtgtgtttgcctttctaggcgcacctgctacttggtgtgagacaggtgaggctgtgagctgtctttggaggaggagagtacttcttagtatatgaatgtttgtatgagctttaactcaggtttactgattgaaagaaactatatttaattttgctttgtatgtatcccttttatttgggctttactaaatatagctggatgggagggacggagggggaaacagtgtgtagagcagaagttaaaacacgccagagctttggcagctttgggacagaaaaataaaactttaaacttgctttctattttgaggccatcacaagatgttttgtgcttacattcattcctaagtcataaacgggtaggaggggctgggaattaagtaaattatctcttgaaaaatactaatttgaaattgagataaaattagcaaagggaagaagggggaagaaagtaaaacactggacccagcctgtttgcaagcaaaataataaacacctcgtgggggtagaagaggcgtgccagtgtccttccagattttggcctctgctcctacacagagccccattgtctcagagctgggggcaaggctgagtgctgtgagaactgacttgacaaataaagcctgtcaggggattttgacacaggtcaaccccttcttgaagctgtgatctcagaggcaacacgatttcttactcacaggcagtagctgtcatactatgagctgttttatcgtaatataattatcacatacaagatgtggtaattgcctatttttaggaatctccccactgggaatcatggtgaagatgatctctagaaaagctctctgcggtcctgtgaaacaacctcccttctcaagacaagactccccttcctgataacctgttgctgctctgcagattggtctcttcacctccatcaagggcttcttgtctgtttcactgaatattaggaatgcttctccctaggcttcagccttgggctttcccctcaggt

SEQ ID NO: 109864 - DNA, 1282 bp, Homo sapiens
aaatttagcaagatctcagaaccagtacatatgttttaaatggttatgggaaatatgccttctatttgaagtgagctgtgcttgattcatattttttaaacaatatatatattctgcccaattctaaaaaaaaatatttcaagtagctaattcacttcttagtcatactatgaactcccaggaccttatcccacaaatgcagccctggttagaactattcaaagagcctttgatgcttcaaacccactaaccccattttgcacatttccccaaagcaaacgcactcatgcatacacacacacacacacacacaaacacaaacaacttatgacccaacttttgggaacaatgttaaagcaaacaaacaaaattcttagaaagttgtgaggtgcttaaaatagtttgatttttaaatgattgaggagcttttcccataagacttggtgcttgctgctataaataaaggcatgcatatatgtccagagttgtatctctctagtcacaatgcttaaaccgacttcaagaagtcagttgtattattttaatattattatttaatatccaggatccactgtaaccttttaaccctgttaacgccaaacctttaaaaagagtttaacttcacaaagcctataagtcagattgagaatatttcacatgaaaagcttccaggtgtcacttacctttagaaatggaatttttcagcctattattcgggacagacaactagattcttcctttcctcccagctcctcaaacactgttgacattctcactatgacatttctaatggattatcattgctgaagctgggagatggatacatagtatttgtctgcttttgtatttgttgagttttttccacaataaaaacagacaatttttttaaaaatgcagaatagctggaattcatccttaatctactttatgttgaggatagggtagtagtatttttttgcagccttatttccttgggttgttcaaggcaaggtattggaaaagttaaaaaactcaaataactagatttgagagccccaaagtgtacatattatttgaattctaatgtttctcctgagaatttccaacctgaagctgccaaaaaactgccttaaaatgtggataggtattatatttaaatatgacagtgtggcaaatgtggtgtaattgaaatgatagaggacttggaatcacaagatgtgagccaaggtctagctttgccacttactggttagatagtccgtagacatatcatgcaacctttctgagctggtttcttcggcta

SEQ ID NO: 109865 - DNA, 1091 bp, Homo sapiens
tttcaaataaagtcttatagtaacttgagatatttttgaaaggtaacactcttttttgaatattctgctactaaattattaattttctgagttttctattaaggcaaacatcaagtttccttgtggctggtgactaattcagatgcatactgtttctattcatagctccccaatcttaggtagaattgagcagatttaacatgaatagcttcctctagtttcacacggaaaaaacaattttaggaaggaaaggtaggaacatgataatacagaaatcagcgaagtaaagggtgattggctggtggctggggttggaagaaagtgaaatttttcttgttattctctttgtgatggaagatttctttccatagattagtataatttacgtgggctgtttgaagagattaccttcttagtggttcccttaaagctctttgttatgtatatcctgaagcccagtcacttcttcccacttgtttttgagtgtttgatctagacaatgtaaaggcacttttaagataaaaattattgtatttgggggactttgggagactcacttcccaatcattttgtttagaagcaaaaatgattaaacagtactttatgtcagatctgcctgtttaagggatttgagcacacctggtagcaaagaggtttaacctagtttctcagatgaaaactagaggtggaggaaggacgaggaagcagtccagggtgagctgaggagctggttacctttagcctacttctgggatgatgcacattgtcgtctaggtcagtcagcctcctcagcccatgcattaagattcctggttgcagctgggcacagtggctcacacctgtaatctcagcactttgggaagctgaggtgggcaggtaacctgagttcaggagttcaagactggcctggccaacatggtgaaacctcatctctactagaaatacaaaaattagccagatgtggtggcggacgcctgtaatcccagctacttgggaggctgaggcaggagaatcactcgaacctgggtgttggaggttgcagtgagccaggattgtgccactgcattacagcctgggtgacaaagtgagat

SEQ ID NO: 109866 - DNA, 1051 bp, Homo sapiens
tttgtttgtttgtttgtttctttctttctttctttcttttttttttttttttttaaaagaaacgaggtcttggcatcttgtccaggctggactcgaactcccaggctcaagctattctcctacctcagccttctgaatagctgggactgtaggcatgcaccactacacccagctaattaaaacaaaaacatttattatctcacatgtttcctgaggatcaggacaatgtcagcactttagctggattgttctgactcatcatctttcaggagatggcagtcaagctgccatctgtggctacagtcatccgatggctcagctggggctggaaggttggctactaagcttactcatgtggttgttggctggaggccttagttcttcacagcatgacaatagtcttcccccagagtgaataaaacaagaaagccaaggagagtgacatcaccttttcttttatgatgcagtcactgagtctgccttattttgttcattaaacatgagacatgaagtccagcccatactctatgggaaaggattactcaataagttgaataccaggagatgagaatcttcgggagccatcttggtttttaataattaggaaaagtcaacaaattgaaacgatacttaatttggggcatatactgaaaagtaataatccccttacatttataattaacctcttttggagtaaaactggaatttcttataacagtagtaataattactgattactgaattcttttatgatccttactgaattttcacaacattttgtagaatgaggaaggaagatactgttatccccatttcataaattagagaactaaggcctaaattgttctcagtgctttaggtggggtcacatttttagcattcaacctcaggttttttttctttttcttcacctttctttcccctgaagagtgattcaattacttcaccttttataaaatacagtttaattgttccctttctgtattatctcagaaacctgatttttttcagtgcctaattgaaaattttaaaacactgcccttctagtatc

SEQ ID NO: 109867 - DNA, 4545 bp, Homo sapiens
aaaatggttcaccttattaacagaacattttaaacctctttgacacgtgaaaaagtcagtgaaagcactttttgatacaatacttaagtatcttatgcatttgttacttttatctcatgcattttgttacttttttggtttagtaacataggacttaagatacagttaaaccaccaatgaaatgagatatataagaggttttcttctagatagacgccatgctttttgacaagaacataattttatataatttatgagataaaataattactttcctcagtcaagaacctctaatagagctttaaaaattaccaggaaagacatttttattactatatcttttctttctctttgaaaaatgaaacaaaaaatcgagtggtgattctttggacaggttaacctcataccaattcattaaatagagggtgtttttgaaaaagctcatgtgaggataggctatatagtatttttggattacatggagaccttttactttggtccctactgatccttgtgatttttaacaatgcatacttcgaaatttcagtggatgtttttctttatcattgtatgaataaggttttgaagtacaatgttttgtgcccctttatttaagagagtcagaggtagatgataaaagcagtttaacactgaaaaaatgcagttgagcctcttaaattattaagaaagaaggaagggaggagggaaagggagggaggagaggagaaaggaggagaccatagaagtgtaggtgactaaaccatgtgtacatcttctgcattttctttctatacttccagagcacgtggcaaagactggtcctcactgatagtgtgtggaagatagtaagtgattccaacggtgacagcaggactgggagtctcacacaacatattcttttctttgacacttaaaaactctgagtatgtggttgccctgccccaaaaaaggttttgcatttctttctctaaggcctcacaccggccacttcctctctcattctccttctcctttgcatttccttggggatggctggaaagggctggcagtgtggtgcctggtgtgtaggcctgcctgcagccccattgccccctggttggccgagggttggggaagctggggaggcatgtgtgtgcttgctcaatgtgttggaatgtatgggttctgtggcatacacttacttggaatgtgcagcagacacatgagcttcgatggttgtaggggtctaacgttgtaggcttttgtaagtggttgaaaatttgggttacttttttcccctgaagtgcagttgtatttattctttggaaagggaaaacatctttattttttgtttttcaaccattgacggatagaaaataatgttgtggatacataaataatctggcctgtctcctggatccagctgtactactgtttacccctttcttttcgagctgatagtgatgtcttcaagtcatggacactgaatttgtaaactaagccttgtaaaactccctgagttgtgccaccactaaagatgatgaaatcaaggatctgagaaaccaaattttaagctcagatattgaaaaatgtggaattgattctcccttttaaggaatagagaacaagatactagttgcttaatatttaaaatttttggctgtttattattttttaaaatgtttatatatttttcttcttaaaatatttgagatgacaaaggtactggttactcaattatttgaattaaagaagacagagatttagatttgtaaagtaggtaagtcgaaaaggcattttaagagttacaaagggcccaggaacaggtgattggttctaatataattatttctacatcacgagagtgttgccagggaagagttagctctttgttcactgatttgcatattaatggtatgttgtgtctatttcaataatggtttcaagaaaatgatttagatattgaaattgatcagtggctttagttcacaagtatcgattgtggtcacggtgttaatacctgccttataaatttctaggccaacattgtatcttttattctctatggcagtttttattaaacactgttccatagagccttaggattccaaggagatgccaaatttatgggaaggacgaatggatgtacgtacatgggaatcctggcttcttacccactgcccaatacgaagacaactgcatttgttgctgttttatatacagaattggagttgagtctaagatttggtttagaaaaggggtttgctgctttaaaacacagtttgtaagcacccaccctacagtgtgtaaagtgtgtaattctgagtcttcagttcattccttgatttgacccaaagccctttcttgaggaaagtttagaccctgcccttgttactcctacatctgctttccatggaatagccctctatttcctgtcactttcattttggtaacaagtatctgctttgccagctgcatgccagactactaaatctatggatttttctatagtcaacaacatagaatgcgtgcccttcaggaactttccagggagctccttggccagtgattgcgctctggctcttggcagagccattagagtcaactgcctttgaagagtgatgggcatggtgacacgggacccattcattcatcgaaaacaagtttttgcttcaggaggtggaagcagggttggcttgctaatccttcttgaggcagagcagccctcctcttatctgttgtgtaaggtggggctccacgaacacaggagtgatcttcaaaacattttcagttggttagaacgaacaaatgtgctaggtcacaagccatgatactttaatacacaccccctcagtatcagtcctacatacatgatttttgttcaaaaacaggatattactttaaaacagtaaaaatactgttttctcagtgatttcttcccctatggccaaggactcttggaaagtcctgaaagtccttggaatttagctacgtgttgttaaagatcccctgagaggttctgatgcccaggcagggagagggggagagagagagagagagagagagagagagagagagagagagagagagacaccctactctgagcaccgtcccctgccatgtgctccatcactgtagcctcccacagactggccttcagagacccatggtttcgtattttgcacacaacttttgtagtaagatttttgtaagagatcaccgtatgtttacaggggtagatgatgtaagtggtggcaagggtgttctggatagtgcaggagggacagctattagttagctccagccaactgctgccatttggaaatgtagggccagtgttcccaaatctgatttttcaagaggaggtggaagtcagagttcttatgttaaatatctgaagttttaaatattggcaacaattcaaaattttttatggacactgaaggtcaaaaaaagacagctgtgggttgaatctggcccacgggttgccagtttgcagtctctgccacatgaaaatctgtatcttctataaaacattgttgaagacactgtcctttatgtttagtatcccttacacataggcttgtctatgagtgagagggaaaagtccttttcttgataggcaggattaactcgtatggatcttatctaatgatgatagctgtttggaaactcaaaatcaaattaggtcttagttgcagtagccatttttcatcagttattattttacctattaataaaataataattattttttccattataaagtaccctacatttttatctttatgtgatgatcttattgtgtttctgttatatcaaaccatctgaaattcttttgtaaatgtagaatatgtatatatatgctgaatatgtgactgtcctataagtttatgtagtatttcataatacatgtttatgaaaaaaataagcctctattttcatataattggaggagcaggtttccacatcaatctaaattataccctctccaattaaacactaagccaactatagataatgttttaagccactttctaagaaaatttgattctcatatgtccagaaaacatgttgtaaagtaaaaacttgagtagttctgttttttttgtttgttttttagtttttgttttttgttgtttttttttttgagacagagtctcgctgttgcctaggctggagtgcagtggcacgatcttggctcactgcaacctccgcctcctgggttcaagcaattctcctgcctcagcctcctgagtaactgggcttacaggtgtccgccaccacgcttggctaatttttgtatttttagtagagatggggtttcgccatgttggccaggctgatcttgaactcctgacctcaggtgatctgcctgccttggccccctaaagtgctgggattacaggcatgagccattgcacctggccattctgcctgttaaatgtctgatataaggcaaatggttttaaaagcacacagtgtgccataggaaaatatagtggtgaaaagtggtgcttttaaatagtttgaaaagtgttttggttactgctgcacttttctgta

SEQ ID NO: 109868 - DNA, 1027 bp, Homo sapiens
ctgttccagcctctttgacacattatttcatttattccaaataataattttgtgaaaaataggacaattgatactatctctttttttggatgaggaaactcagccccagacaagcttaataatttgtttaggccacatgactgttaattaagtagtagggctagaacccaggtcttttgaggtccctgagtctcgctccactgtacttcctccccatttaacgttttacattaaagaagtcagctgaatgtgttgtaaagttcgaagaatgctgttcgagggtggtagaaatatatgaaaatacatttgtgaattgaacctttgcaatgatgctacatcagtctgagtgatctgtactttgctatagtttttagaaaaaaatagttagaaatagaggtaattttaaaggtagcattgcacgtcttcccatctctgtgcttgcccacagacagaagtggggaatatacctaagcaggttgtggggttgttgttgttgttatgttgcttttttcggcagttgtgttcctgacataacaagacaaacatttctttcaacatctgagccacacagattagacagcgaactgtcacccgggtcaagactatgtgccatgtggtgaatgaaagtctagctcaaggaatctcctgggtgggttcttcacggggttcagacagcctgttgcaaaggtcagggctgtgttgtggtttacgtgtttccctggtaggaactgccaggtctttcccagaggtggtatctttctctacgtcactttctgtactgaataaggccttgggcctctcatactgtcttgactatggggtgagtgttaatagggatagtatccataaagttctgagttctttattaattttataatcgcacaaaaaaatatgctaaataatgaagcatgtgaagtacagttcatttcccctcaactgtaaacttttcctgcatttatcttcgtttcctttaactcttatggactgtttatggtgctggtgggagggagagaggaattatcaagga

SEQ ID NO: 109869 - DNA, 2317 bp, Homo sapiens
gtttgcttgctttttttcaattcaccaaatacataaaaattttaaattgtaatataacaatttataaaactgtttaatggctaaacacctaaacattaattccaaaaggtgatttgtgatatgtagtgcagctgtcaaatggtgcttttcatgtgtttccttatacttatggccaggtataagatgaccagtaagagatgttctaagcattttgttttttattatgttaacctgagattatcgtttggtagacagaagatgagaggatattagtaatatttgtacaaagccttttatacttgatgatctaaagtgcaatatgttttctttaagagaaaaagcatttaacttttaaaatatttttaaaagaagatttagaacaaattgcatatcagaattatcatttcacaattattttgagtaaacacatggtttttgtgtttttttaatgtgtggaggttgctccagattttcaagtactgtgttgaggaaatgtaaatgattttgaattatgcataaaaggatagtgacttaggcacatttattaaaagtcagaaaagctatgaaaaccagatttctacaggaactgtttatatatttgatactttcaagcttttctaaatatttgctgtctgtagctgaatcactcttccaagtcctctatgaaaccctcaaaagtagatgagcaattggtcagaattgttagaggatattatttgagctaaatgtttcctctctctgtttcagtggtgtatgtgcaagtgtgtgtatatgttttttgttggggacagtttcaggtagatggtatgaagaggcagcaggagatctttaattgaacaacagttgctctggaattcagtcttgacaaggctcaagaaagttgcttggtgattgaaacctgtggcaaagggaatccagtgcagtgatatttgccttgagtgatgaataactcttgtaggtggttaaccttgtgaaagccaagtcacaggtacctggagtaggttttacagtgagcatgctactgaaaggaccatcagtgcagcatcttccctccttccttttcacttggctatcccctgtcacaaaagattctgtgaaggctttgatgatgttataagccatttttttaagtgtcagaaaattcaagatttgaatatgcacttccatttagaaattctatactttgaaaagcaatatggtattttgcataacacaagtgctctcagtgagtaaacttcattagaagaagcgttatattgaaatagtttctttggagacttaaaaatgttgaattatacatttcaaaatatatttttaaaaattatatttaaacatcacaaaagtcttcagtgttcttttcagtgttagaaattagtgggcttggctaagctaatttttaaagagttcatgctctaaaactttcagtcaaaagcattatctctcaaaagctatgattaacttcttaaattgagagatgggagtgttctgtttaacaaaacatgcccccagaatttattagtaaagttttatccttcttatattcaaattcatgttcaaattattttgggtattcattcaaaagcagtatcattgaacaaataatagcaaataaacagcaaacacctaccaatgaagataagtctttcctcccatttatcatcaccattaaaacattttaaatcttttactttataatttgacttcatgcttacaaacttataattttcatttggtggcatggactctatgggttctattttaggcagcaaaattgcagagtgctcagagcattatttttaaggttttacttttcctgttttgatcatggactttagtctggtctctccataaaatagtgaagaaaaattattttcttttgtagaaaacttcagattctgttgcttggctgccaaagggaagaaggaatacaataattatttctttaatttggtttagagtttgatggtatattgagatagaataagtacaacagtgaaaatggatgcttttgcattaataggaggcattcaagcccaaaagctagccctgttccatcatttgatagttatgtctcctccccaagcctctgcttttcactaaataatatctgtatttttgagatacattttgtttattcctcattatttatctgttctacactttatttcttaaaatgtgaacattcagataggattttcccattctgtttagtgtcaaggacatttcataaataaagcagatattttaataagtctgataaatgaaaattaagagttctgatgtatgttttgagctttctcttatttacccatatcaa

SEQ ID NO: 109870 - DNA, 3874 bp, Homo sapiens
caccctcctcgccttgtcccgagacacggggcgcccacctttctttctactgggaaccaagttcgcccagctcgatccgggtaggagaccccttgggggcgcccgaaggcggagcccgagcgtggagttccgtgcgtgccccccctagacccccgcgggcttgatctaagcaaggttctgagtgctttaatttctgttttaaaggtaaagtggaattgcatgggaaaatcatggaagttgattactcagtctctaaaaagctaaggtaaatatactttgcttagttttttttttgcgattggccttacgtataagtaaaaaacgtacacacagctttaaaaaacgtgctcttggtagtttttaaaggggcttttgtttgttttgttagtggagatacatagtttagaaagctactttttttttttttactttcattatataaggtgtttactgttcttggaaaatatctggtgcctaattgggggtcggggtggcgaacaccagctatgttcagttcgctgggaccctgtaacttgtttatcaaaaattgcctcccacccccacctcccgcccctacccccagcagaatagcagcaaatgcttgtcaagacttcctgtgagatgtgaagagtaaatatttactatgtcagctaaattgcttaactaaacttagcgattaattacttttctcttttagatagtttaatgttgaatagtaaaataattcagtaaggggtcaatattttgcatagctttctaaagaagtgggttgtttggattggatggcagttaaaagccggactttttcagtcactgagactactgagtatagcttctgagcattttgttgttgttgcttgtaagaaatgtttgcggctaaaataaatacccttgtgaaatctatagttatatttaagtgcactgttgttaatgacggagtaacaagttttgtggaggttggatttctccacagtgatttgctaacatgagaagagaagagaaaacatctttgtttaaagtttattgtggactttaaatttgggccctttattactcattctaaatttttttcttctgctgtgtgtcgaaacttagtttatatcccattcacatacatttcttcaccattagtcattaagtagctggactggagctgttcaatgaagtttttgatgaccacctttacagtttatcagtcaatagtttaaccacctgatttttgtcaggattgagtagattttaaaacaaactaccctaattttataaatacttagatgtgttgctgaagggatttttaaaaattgtgtgccacatttccagatatgttttattttaagtaagcaacagaataacttttgtttgcaaataatctctgtggcatatgagaaaattacttaaatcctgttttttttttaatttaaaaaaggtgagttatgatttgcagtttcatgtgtaatattaagctagttctttcctctattgggaaagatgtaacgtgtaaccaattggttttcaataaggtattctaaatttgtatacttttctttaaaataatattttttgcttgagaaatccaagttgaagctttctgatatattaactatttacaacaaatataaattactatctcacaacacttgaaaatttgcagaatgaatatattgaacagtgaaataactaccccaagtatttgatacagtatgtttctataaatgtctaattctgttggctgtttgcggttgtgaatacttttgggggttataattagtaaaaaaaaaaattactagaattttatcttagttggtgtctcatttcatgttgcagtgtgcattatttaattttgtggtatatgtgaaatactggtttatctaaagttattaacagctcctaaaacttctcacaaatgtactactttttatcttttttctttcaaaatgcagattatttgctgttagccggagtgtcatttaagtaattttgttctgtttaagagttcagaattgaaggcatgtccccagtttttagtataagttaaataaagagcaatctaggatttatacagccctattagttgatgatttctttgaacatgtgggcgatgtgaaatacccaggaggtagattaaaatgcgctgtgtatgattcactacactgaaaatgtttaacattccaaatgtatgcataagctgctgctctagaggagttacatcatttctgattggatggttttaatttttttttcctttcctttattagtttaaatgcagaaattagctacttgtactgcaggctaagggagagatagctaatgaccggtattgtgtactgagatcagacttcagggatgaagcagctgtatgttctcatgtcctggacactaccacgttgatggctttctaaatccagggtactgtgacatttgaaaccaaagcttttatgttatatggagactattttggtgttcttgtgttgcatttctgtgaatattaacaagttagaagtaaatttggcagtgttaagtcaattctatatgtggtttttgtgttagttgaaatgaaaatgggaagaaaatagttcatcctcattgcttgcttacttaaaaatcattcaacaattgagtgcattttctttgtattgtagtgatttctttgatttctcaagaattagtttgattatctgtatctcaaatagattttttaaggttaatgatagtttgggaggagatgtttttatcttatgaaattattggcatgccatttgcttaccagttgtatcttttgttaaatattctggcatcattttataatagcataatagactagatgccattattttctcagggtcacttagaaatagaaaactcttttctttttgcagcgtatgttttattcttattaaatgcaaattattctaatgtcaaccgcacataaagcatttatttctctttgtaagttggtttcaggctctgttgaataaaagtgtttgaatctttttttctctattaatatttcttggtagtacatatggtcaaatgtttattaaagaggaaaaaactggtaagctttaaaatgctgttaaaagttttggaaacttccttgacagaaatttcatttttggtgttgttgaaggttaacttaaaaattatgtgtgtgtgtgtgtgtgtgtgtgtgtgtgtgtgtgtgtatgtgtatatatacacatacacacacacacatactgcatgccttgttttgaactaagacatgctaacttgaatgtgcttttgtacctcaagttgaatgattctgtgagaaacaaaactttgaaaaatgcagtttctgcccacctctaggaagtaactaagtggttctagacattctttcactgagatggtgtgaatagtatgagatagtgtaggaaaaagctatgaatttgtctttcatgagttaaaaatcagtaattgtgttcactccaatgcaaatgaatttggtctcctataggaatgttaaagaaaacagtatctcaattgtattttgcttgtatgtactacattgtgtatggttgaattaaataccaaaaagaagaaaaaaacatccaatctcaggccctccctgctgcagtcttttgctgcatcaatttttaattttctagaaacagaaatgacttttattaggttaaaattgtgtggtaccttcctacttcaagaatttgttgacttagaaattaatacctgcatttacttacatagattccatgtgtagatataacatatattaacacagaatatatattaaactgtaaggttacttttgatttggctttggagttaaacttttagtttcccaggaaaaaaaaaagttagtaattttttcacatggtgctaggtaataccctag

SEQ ID NO: 109871 - DNA, 1026 bp, Homo sapiens
cgcctggcgcggggccggagcccgagcagccactgccgagcgcggtgggcgcgaggcgaggggcgcagcggcgcggggcggggagggggcgctcgctcgctccctctcggctgcgcacacgcccgtacaaactctcacacagacacacgcggggtgcgctgccgccgcccgccgctgctcctcctcccgccaccgccttgagagggagagagagggaggcagagagagcgctttgtccgcgcgccgccgcccggcccgggactctgccccgaggaggcagccgcgccgagtccccgcctccgcctctgcccccgggcgggccgggccggccgcggtggggggagccaggctgagggtgggggtgggtggcgggcgggcggagggcggggagggggggcggaggaggaggagagacgagggcagcggaggaggcgaggagcgccgggtaccgggccgggggagccgcgggctctcggggaagagacggatgatgaacaagctttacatcgggaacctgagccccgccgtcaccgccgacgacctccggcagctctttggggacaggaagctgcccctggcgggacaggtcctgctgaagtccggctacgccttcgtggactaccccgaccagaactgggccatccgcgccatcgagaccctctcgggtgagcactcagcgcggccccctccccccgcctcgccccgctcaggccgggacggcgccgggagggaggccgagtccggcgggcggcgcccggcggcggctcccgcgcccgcacgctcacttccacgcaccagaccctcaactctcgccgccggcccgctcctgggacggcccgctcccctccccccacagctctggactctgccctcgccctcggggccgcagccttggggcgccccccgtgccgctccgaaggctcccgaggctcgccggctccttaggggcacccctcgttcgcctggcgccccgggctgctctgagcttccccgccccccaccctttgagcgtcccctgtctcactt

SEQ ID NO: 109872 - DNA, 1154 bp, Homo sapiens
tgtctgtgtgagagtttgtacgggcgtgtgcgcagccgagagggagcgagcgagcgccccctccccgccccgcgccgctgcgcccctcgcctcgcgcccaccgcgctcggcagtggctgctcgggctccggccccgcgccaggcgggcggaagcgggtcgcggccccgggctggggctccgggcgccggaaccccgggcgggcgcggcgccgaggccgggcgagcggcggggcggggaaggcgcgccccgggcgcgggtgggagcgcgcgagggggcgacggggagccgcgggcgtgggagggagaggggctgcgagtgagcgcggagaggggtgtgcgcaaggtggaccggatgtgagtgcgctgctgccagggcaagcgggaaggtgtgtcccggaggtgagaggcgagggcaggctgggagacaacaactttcgcagcgacttggccggggctggcgccctgcgcgttcccgggccgtgcgctcgctctgagacccgctccccgccacgctctctgaggtgaccgagcggcgcgtgtggtcgaaggatcgcgcgcgggagtcgggacgcctaggaccggggttggccgggccctcgcggaccgtgctcgcggggaagtggttcccggtcccgggcctcagtttcccgaccggggagggaaggcggaaggccagcgcggagtcacgtcctctccgcccagaccccgcgtgtccggaaccccgcggcaggcggcagcctgacgttggcagctgctctctattctgggaagtgccgagggcttcccgggcggcggcggcgaaagccaggtggcgggtggggaaacgaacgccgaggggccagggactgcggcgaggccggagcgctggggtcagcggccgggggacggatggtcgccgcccggctgcgcggccggttcagctccaaagccagggtggtgggaggcgagggtggctggaagcggaggagcgcaggctgtgtaggagttccccgagcactgggaagggcccggagaggaaagaggtccttccaagcggaggaaacaacgtgaccgacggaagaggcagggttgggatgagagcaggctggagccgaggggctcgggcaggagccagacaggctagagcgggctgcaagttccggggcccggctgga

SEQ ID NO: 109873 - DNA, 1383 bp, Homo sapiens
gtggatcacatgaggtcaggagtttgagaccagcctggccaacatggtgaaaccctgtctctactaaaaatacaaaaattagccggatgttaaattagccagatgtggtgatgcgcacctgtaatcccagctactcaagaggctgagcatgaaaatcgcttgaatctgggaggcagaggttgcaatgagccgagattgcgccactgcactctagcctatgtgacagagcaagatttcacctcaaaaaataaataaataaataaataaaataaaataaacatctacatgcaaaaaaagtacccttattacacaattcaatgagttctgacaagtgtatagtcacataactacctctgaaactcatgatttagaatattttcatcactctccaaaattaaaaatatgaaagctgaaaggcaagtatttacacttcaagccatgacagaaactgatactcaaccagctctccctcagtaaacagctataaagctggacaaaatacatgaaataactgttgtacctcaggcaacacagcaccatgattcttcagcaaagggaacaaacaaaacgagcccgcatgccatggctttctctctggagccaatttctggactgtggtgtctgaggggtagcccaaccagaggacaaaagtctccctgacttaagaacacggaaatcagagttcaggactaccttgtgtctggaatgtgtagggcagattaccaaagagaaagaaccaatgccaaggaggacctccaaaaatctgcgtcgggaccctgttgagtcttcgtctaaatactaaactatgcatgcacagaacaagtctccaagaggctgggcaatgaacaattaccagagaaataacaactatcatttagctgagagctaaataactaccgaatctcatacaggtctgaaagatgttcaagtttcaaccagccagagtggaaatactttataaaaaatgagaccacagcagacatctcagaaagaccccatcttaggagaaagactaatctagccctagagttaaaggtttctctagacccaccctaacaaagctaaaaaataagtttcaaaagtattaagctaattcccaagtaaattaagtccctgaaaaagaaaatctaaaaatctatcaaggaagttaaaaaaaatttggacactcaacaatttagcatccataatgtctagcatataatttaaaaattactagatacagaaagaagcaggaaagtatgatctataatgaggaagaaagttagtaaatagaaatacaccccaacatgatggaaatgatgttattatcaacaaggactttaaacctgcattataaacacattaaactattttaaggaaaagatgaacacaatgagagaacaa

SEQ ID NO: 109874 - DNA, 3525 bp, Homo sapiens
ttgataatggtattgaggtatatggatgtctattttgtgcattatttggcaatgtttaagaagttaacagttgtcagtcattgtctgaaagtgagtctgtaagtgtattgttcagcattttatcacccatgaaaaccctttttttatttaaagcatcactctattgaatggtactaaaggtacaaatttgttggggctgagatttttttcttagtttgatttttttttttaagagcatttacttaggaatgttctgtgttctaatactacttatttcagccaccagagagaaccctatgccagtttctaaaaagggtggcaaatcacttgacctgcaagaaacatctcattcatgctctatgaaagtttttattttactaaatgaatgacataattttttaaaacttacaaactgaatgcgtgttgtgttgcctttctgtcttcacagaggaggaggtggaggaggaggaggatggagagctgcccaagacagggatcagatttataggtatgccaggagaggacttagcatctgtacaacagtataaagcttcacataaagatgtttgcctagtaatgttttggtaaattataagtggaatacccaaaatcagactgtttgaagctcatgaaaatattctaacggaaactaaatgtataaagtctttgtatatttataaaaattaattggttttgcaatagattatttagtgataccattttataccgtgatgaggtacagtgatgttagtcactgataactcattttttttgtcattatgttcttgtattacattttccttgctttttaaaagtaagcatctcaaatagcacaagaacattcaagccagcctttttaacacaaagctaaatcctgaagcacttgtgaaattagttttgggtgttcaagagggtgctgttgggattatttaatggtatgggaattttctcatttttatttttaatttttggagacagagtgttgctctgttgcctaggctggagtacagtggagcaatttgagctcactgcagtctctgcatcccgagtagctgggattacaagcatgcaccaccgcacagagctaattttttttttttagtagagacaggttttcaccatgttggtcaggctggtcaaactcctggcctcaagtgatcctcctgccttggcctcccaaagtgctgggattataggcgttgagccaccgcacccagccaggaattttcttttacaaaactctcttaacatagttcacaaaatttaaaaagtaagtagattaaaatatagcaaggattatttgaccttaaagttattaagagtgcttatttgacacttgggcctgataatgtgcttcattctcaagatttaaacagaccttgaaggttcatgcagctttccttttttggggaactgatgaaagggcagtatatatagtcataaatttatatgtttggtctaattgtgatctattgagacttagacaatcttgacatttgtttatagaaggcggtcaccttctccttactatagtcgtggaggatacagatcacgttccagatctcgatcatactcacctcgtaagtttttatcttaatatgattgtttatattgtagtatggcttgctctgatgacagtgtattccctttatcagataatggattggtttcaggtagtttcatacctaatgattctccacacatcctgaacattttttggttcaagaaagtttgtggaaacaacccttagaatcctattattttttaagaaggaaaaattggacagcctcctgagccagagtaggctcggagactcctgttgtttctaactgaaatagtaaataatgtatttccaccatttacccagagtaggctcagagactcctgttgtttctaattgaaacagtaaataatgtatttccaccatttagtagcttttcaagagtccttaaaaatttttggacagcacagaaacatggattacttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgcctt

SEQ ID NO: 109875 - DNA, 2358 bp, Homo sapiens
atagctctcggaaaatagcataaattttatcttaatctctagtgccagaaactgcctgggcgtaaacactagcttgaacatctgaactagaagatagcatagtattggaattagaaacttaaattctatttaggtgaaaggatgtttcctcaaattatgaacaaactttaatgtgtttgaaacggggtatttttattttttaaatgtatgctgttaatacatactttgggaaaaggaactatatgtacttaaggctgtgcttcagtcttagcttttggcttccagagaagggctaagaaaacttccaagggttaaataatgtgttcaggtttcagtcataggatctcagtcgcaactatttaactctgttgttttaacccaacagcagccagatgaatgagttggggccctattccaataaaagattattttggggcattggaatttggattttgtgtgtttcttcacttgtcatgaaatactgtttttccccctagttatttaaatttttagcttatgggttatacagaaacagccagctggccagatttgacctacaggctatagtttgccaattgtgtgctgctttggagctggaaatactgtcaggatcatagttaggtaaaataattgtttcaagtttttatgagtagcttttacaaatgaacatttagtagagggaacaacacatttgtaagttgtagaccttacgttctggctaacattaagataacttaatgcacctaactgaaatgtccagtgggatcttactcatagccacaggataattagtggctttgttcaggatgtatgtaacaatttatttaccttttgaaggctaaagaacgtgccaatggaatggagcttgatgggcgtaggatcagagttgatttctctataacaaaaagaccacatacgccaacaccaggaatttacatggggagacctacctagtaagtttattttcaaaataaatataattggcagtttttcacttgtcaaagaaacacttgtattagtggaaagtcttcagcacttaggtttgtgccataaacttgactgttgattgattaaatgctcctcattagggcatttttctcatagtagaagttcaaccattacaggtaaaactaaatcttagtcaagtccatttttaaattttttgtttgttgttgtttggttttgtttttgttttgttttgagacggagtcttgctctgtcgcccaggctggagtgcgatggtgcaatctcagttcactgcaaccttcgcctcctgggttcaagcagttctcctgcctcagcctcccgagtagctgggactacaggcgcgtgtcgcaacgtccggctaattttttgcatttttagtagaggcaggttttcaccatgttagccaggatgttctcgatctcctgacctcatgatctgcccgcctcggcctcccaaagagctgggattacaggcgtgagttgctgcacccggcctaaattttcttaaatagagcaaagtgatactatttttgtttcctcttagaaatatgtgggatatgcagattgacctctggcaggatctgtgtgcctccttaaccaaagatttttaaaaataggtttatatatattgaaacaagggaaagggcaatgtttgctcaatataggtgagaattttaacaggaataattttcattttccagttaatgtgtcagaaaaggcctactagtagatataaaaactcatgtccagaaagataagggaggtcacctgaatatttttttcttcatagtggcagctctcgccgtcgggattactatgacagaggatatgatcggggctatgatgatcgggactactatagcagatcatacaggtaagttatgaggtagaaaggtcaacgtctgaatctcagtacagtgtacagagcagcactatgcttaagttttagcctttgttaaaagctttgctttagtacttttactcgagaaatgcagagtagaaagttaaatcagattctaaggttctgtgtcttaatcaatttaatgtgtaactggatttctgttcaaatattctagaatataaatgggatttaaatgataacttggaatattaataataaaatgtgttttatttttaaacattgaatgaggccaggcgcagtagctcacgcctgtaatcccaacacttcaggaggccaaggcaggcagatcacctgagatccagcctggccaacatggtgaaccccgtctctaccagaaataaaaatttagccggttgtggtggtgcacgcctgtagtcccagctactggcaggtgaattgcttgaacccggcaggcagaggttgcagtgaatttagattgcaccactgcac

SEQ ID NO: 109876 - DNA, 1068 bp, Homo sapiens
ttttttctagctgatagacacagtgtggttccagttatccttgtatgtcatgttatgaatatgtgaatttttcttagaataaattcatagaaggaaagatgccaagttgcttttcgccagcacgagtgcttgtttacctacttaattctaaggttgaaattttttcttttgcattctttcctacccattcccaaaaatacttgtagtacttgctgtaattttgtaatttctaagcagtgtttggtctaatcattatgtacttttcttgttagtgacattttggctagtatacagctccctttttaaacaactttgattttatgacaacttttccaaagtttaaaacttttttttttccctaggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagtaagtaaaagcccgttcctttgtaaaccatcagttctattgttaacgccaagttatcagtgaccaattgctaggataaggacaaggacaagtcagtaatacttcgaactttttctccaacctcttgtggagactcaagatacatgcagaataacaaaattttgtataacttggggaagttggtcctaccacctgctttattagttgccacctattggggtcaactataccccaattccgccaggatatgtagtcagtgtttacactgggttcacattctagagtcaaaaataaccaaaagcaaagttatgatgcagaaggaaaacattgttccttttttggctagtgaatgatgtcatatttggattttgatttgttttgaggcagaatatagagtcaagatttgaaatgtggggctagaccccatttaagaaattcagattttaggtacattaaggatggtagctaaagtcatctccaagtatagagaagaggaagaactgagaaacacttaatg

SEQ ID NO: 109877 - DNA, 1010 bp, Homo sapiens
ccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggtaagatgaaaaactggttttgaagcagtcaactgcctaaatttactttttcttaaagttagagctgattttgacaatagagctttagcagttggtgcgtgagtgaaatcttcagaggcttttttagtgttttgagagagtcttttaagttaatcttccatgacggggtctgcatttgggctgcctgtcaattaagcataatactgacacaatggtgtaactccttagcccatcaaaaaaaaaaacttccgactgcattactatactgtagtatagtattagtacattagttcaaaatatagttctatgctaacattaactctttccaggctgcataaacctagttagatgctctcctgactttcccatttaatttgaagctaatttcttttgggtgttgttaaggcattttttacatttcatgaaaggcttcaaatgagatgatatttattgtgatttcactgtataatccaagtggtttaggaggagggtgcagggggggacttaatgtttttagagtagagtagaatttttccctagtaaattgttagtttatgaaataaatggaatctttaggtaaattcatcacagcatctggaatgttagcaacatatggctcactctttattctttcctcttgtcatctttttttgagacagggcctcactctgtcgcccagtctggagtgcagtggtgcaatctcagcttactgcagcttctaccttgcaggcttaagcgatccgcccacctcagcctcctgagtagctaggactagaggcatgccaccacacccagtaatttgttatatttttgtagagacatggggtctcactgtgttgcccaggctagtctcaa

SEQ ID NO: 109878 - DNA, 2720 bp, Homo sapiens
tcctttatactcagattcctgggctgactgatttctgttaactacagttactttattggtagtcttaactgttactgtgaaacacccatattctgctttcacttctggagaaaattgtttcatttccatagaggtaatctttctagtgttggagtaaacaggcttttagcaacttttgggttccccatttctatattctcacctatgttaatttttgcctgtggtaaaaatagcaaaaactacaccctcatttttgagacttcctcctttgtccatggagagaagggaagtgtccgttcagaatacttgatagggaattccaagggattgttgttaattggaagccccagagcatcactacatcctttaaccatttcttgatgttaaaggcagctgttcatatatttttcttttaatctttttacagtcagtcatggagggaggtagaggggaaaggctgtcacatttcatgtcaccccaccatgttttataatggctttgaagtcatttgaacgtttctagagtcgtctggggcctagagacctgaactcattttactggatgagttagcctttccttctgtgttaaacctcaaaccttaatttgtctattctgtgttacattataaatgttttccctgagcatcaaaggatcatccaaattttctccattatgttgtaaaccacaaaactatcttctaaagtgttttgagctgtaatttagaataatcctctactgtcctttcaagaatgtccagaatactctgaagatgtatcacacaaggaaatctcttgtgattttatctgaaagcttcacctttgattcatgccatatagtgacttactgtaatactgcttccttttgagtcttgccatttctgctctctggagtagaaaggcttaccaggctttactttgtctaagtttgataacctaaaataaaggttgccttgataattttacctagctatcagactgactaggagtaggttctgtcctttcctcatctactgttttggtgccttggcagaacttttccttggtttcattacttagtatacccttttgttgattatgtgtctttagctcgttggtgacctagttatcctggttaccattcctttgctatttttcattacaaatccccccttaacctgccagccaatcccagttttggttgggaaagctatgagtacacaatgtttacctaaactttggcttttgtatgtagtttctgtactcttttgcttcctgggccctaggttaggagctcctgatttagctgcctggttttgatgtgtacttaagtaactaggtaagttaggttaattcctggttttccataagtttgccctggctcatctccatttagctggagaagctgtggaggatctctgacaccctctctactcttatttgtgtgtagttcgctgttctgttgtagctccatctggttgctttcagttttttagggggcctcccaccatggttagatgcaatagggttttacagggtttagtgtccttcaagctagcctttgctttccactaggtttctgcttttctctaggatttgaaactgagatcatcatctttatctcttatcactgaattataagtagtaacttgaaaggtcaaggtctttttaaaaatcaagcatttttttaagtaaattatataaattatataggattttgttttattgattgcaacttgattgaaataggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtaagaaagactgtcttgagatttcctcgttactcttagctctgaaattggtgcgtgttttgtaaaccaggaaggtagagagggttagattatttgttggcctattaaatattggtactagaagtgaacttaagttctgggaggcaagactaaaagcggttaagagcctgggcttttggagtcagggttttctatttttgctggtttgggcagattaacctttcagctttagcttctttataaaaggcaaattagtaatacagtaccagttcttcagggttgttgtgaggatttactaaatgtaagtaaactgcttactagtatggcaaatatactgcagaacattggctttcagtaattagaattcttgataaataagtatatatatggtgcgcttttttttttttaatgttggtcaaaagtaggctatatatacatcctggtttgcctggggcgataccatttatgcctgtggtcaggcataattaacagca

SEQ ID NO: 109879 - DNA, 6258 bp, Homo sapiens
aagaactggtgtgtccctcatccctcgttggtctgtgggatttattttttcccccctctcaaaggtaatagattaacactaaaatctgtctataggggtctaattagcaggcttaacctgatctggccaaaccactttcaaaagtaagatctcgttttcatctccggattcaagactcttcccccaaaattgcttgcattttgtaaaggggttgactagcaccatttctttgtaaaaagaggcactcctggcctttaagtcacaattacaagaagttgaataaaaagttgatgaagtgcagggtaatctttagagcccaataatggtcacagcgtataggttgtgtgagatttgtatgttggtcttgcacgcagtgtaatgttctgagcctctcaatattgtaatgagtttctacgagtgagtctttactaaaggaatccagaaactaaggagacactgatgtatggaccagatgttaaagaaaatgttttgacccagcagatactctgatagaatactggctattatttttgtaaagccgatgtgattgcaacataggcacgtaatctttatcattagagatgaatagcagcatctggacaccaacccatcaaactgcttttcaaattctgcagtttttctcatcttctgctgaatcttgggatgtctttttatattccttggttttagctcctaaactctaaattctaattttcaaaactgaaacatctctgaatctacttctttctaaagaattgcagccatctcaccaaatttcctttaaaaaaggattgaattgtcaaataggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggtaagtactactggttttgccaaaaggttgaaaaggaattcaggtggtgggggaagtgttaatgggatttgccttacatagcgttttttcctcctttctctacaataaaatccgaacgtaggtggtaaatattaatgctttcatagctattttgcccaggacaagggcagagctacagctgtgtatatttcttgagccttagcattttatgttgatcagtgtttttacatatgcgactgtttttttaacaaggcatggtgactgatgtttaggaattttaagtgttttgacccaggttagtattgggggtgtgggctatgtagaattagatattgaaatcacttagtcttgtttttaaactgcaaaccaaaagaagttcttcactgtagcaaattacagtcttgaaattcccccaaaatctttgctttgaattgggttttggaggttacattgagattgatgttatcaacatagattgttacctgacagtttggataaggggcccctttttctctaatttttgtggttagaaattaggttaaaaggtagtcttctgaaaagtcaaaagatatttatatttgcttttgttggggagtactgactgttttatgaatgtaaatttaacagtctgtgctatatttacaagagagtttttataagcacaggcctacaactaatttcagatgatgtttttttccagacactattctccagtttttgaggatttacttatccatttactcttctggtagacagtttggctgccagaaaaaaatatagtccttattatattgatatgagcattgacctttccataacaggattaatgaggttttctttgcccctgtccctcccaatttttaaaatattgccttgtcagtcaacttaatgagtttgtgcatgtttaatgttaaatggattctagttgtatcccctagaaacattttaacaaaaattgtgttgataggacaagtttctgtttatttctaactagggtctcttaactaaatgtacataacattagcccaagagttgatcttctggttttataaagtagccacttgaacttagctgagttgaattaaatctaatatttataataatttagtaatggttttgttcttagactataagagaaggaaccaggttaggaaggggtaatgaagtaacagcaggaaggtatccacattgaaaacagttgtgatagctagagctatggcctctattcttgtatcttctgcatctaagtgccctgtctgtatcgaagttttaggaggccctaaggaaacctgcttgggcattctgattccatgattacatttgtgctgccagaaaacatttcccattgcattttagtgatggagatttaaagaaagccaattactgtaactcccttaaataaaaacatatttaaaaattttcggattaaataaacaataattgactctaaaactagactggaaattatccttttgttaggaaagacatcacagcacttgccagattaacgatggttgtctttatgcccagataggtataaagacttgcaatttttttaaacaaagccttacatttttttcaggaggaaaaaccaggagaggaagtaattgacaataaaatgaaagatcatcaaagtgaaatgtaggataacaagaaaaactagcatgttttatgtaggcagtattttattttgtttagtatgttcaacagacatttacagatcaactaaattcaatctttttaattatttgaggaggtgagctgtaatttaaatagtgccaccttttaaagtagtatttctcctttggacatccagaagacttaatattttctaaattgagggggaaaatgtacaacaaaactctttgaaaataccagtgttggattcaagtttgttctgctttccttcatagctactggcatattgtaggtggttgacttgattttgtctttttatgattcatactataaaatctcactagagcagcttttccagggggtgggttacacttaagctccaaattgtcaggttccctgacaccgtctttctgcagagctctttaaatacagtacaaaaatgtgtgacgctaaatacgtttctttatcctatctagacaagtcacaatactgtaaacctcttcaaccctgagcgtttgtcattgtacaaatgaattgtccgtgctttcctttcatgcacttatgtattaatgtgtcactttttgactagaggtgtgcttttgacacttaacctattttctattgaatataataagaagtgtgaaatgtaactaatagttcttaaaatgttaaatgaacagtaaatgttcagtggcgcacttcacattcaacttaagcatgataagtctatttggagtagagaaatgagattaccatatattctagaaccagcagaaaactatgtagttttcagttttttgagctgcatattctagtttctttttttttttttttaatccaaatcaacaaagggattttttttttctagtttcagttttggcactggattttatcctggagttttaaaatattcttcatcctgttctttttctattaaggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagtaattactagtctgtttatgtgtccctgtatattttgctaaacatgcatgcattatttgtttaatagaggaaaatatatacagggtaaagaagtgccttccaggggaaacgtttaaattaggtaattctgattttaactgcttagttaaatgattgaaatgcaatttttaaaaaatatttagtagtcaagcaccaggcagcagtgagctctccagcatgggtaacagtgggcttcatgttgtcctctctagataaactttacctgtctaatgttgctggtcctggggcatgagcgaatacctccagggttggaactggtggtctttgccacctccctggactcttagattgcactgtcccctttccttcagtactgagcaatgtatagtagaatattttctgttaaaccattttcaaaggaatgtcaccaggatggttatggaaccaaacccccaaaatccaaacaaagcattgaacaaaatagttccctttggcattagtgtgttagttttttccatatggcactagtggaaatctgtgagcatttgggccctaaatttaagatgcatatttgctaaatacacagggatggtttttcaaattctgtttctgtttaatgcctatttcagctgattgactaggattactgataaaataccgtagcttccccttagaagaggtgggtcacacaagtgaacaggatagctaatacaaattgcagtaatggcagatgctttcattcctatttctccttttttgctatcaacatttagctattgtaatgttagaggtaacggttacaaagtagctttattctggttacctggtatcccttgcacttattgagaaattcaacccaaaagctgtcccttcttttctgtgtgttttgttttagctgagtagaagggtcaagtgattggtgtaatgttactttcagttgaatgagacaagtacacatatcaaaaataatacccagtagtagtcagccagcggttttctacccagttgagaatgccaagggtatcatgtcacacatgtcttcctgaaataaactttctctgagagttgtcaggtcttcatgctcttggagaaagtgacttaaatggcatttcttggagaatccattttctgatgctttcaggcctgtttatttctatatcttgcaagcagaagaaaattttctcttaagaagttttgcattcctttgtcaaatttcttgccatagataaactaatgatgataaatgttattttatgttccaaattactcaaagagcaggcaggaaactgaggtaaatgtgtgaatgaatattacattttaattccaagcccatggattcttttatcaagaaacctgacaggtccttggggtgcaaaagaggaaaagacctcttaacccccagcccactaaaggaaagaaagcaatttggaatctggttatgacccaagctggatagacttaaggtgagaaaacgttgctagtggaccattgtgtccatttgtttttgttttcccccttgaccaaagcatctgtgggtcctaatgtgtctcctcctcgggccatagggaagatgaggaggaggccggcttctgttcctgagaacaggcagtgtgtgaaagactgccttaatcagaggtctgattaatgctaaggggagtcaaaacaaggaaggggatgacagtgtttcaggaagataacctttgccaagggaaaaaaatgagtaggaagcatgtaacttctgaggttgactaagtcaagtaagtcagacttaactagtatgataaacagtgttttaagagatgcagtgtttatgagccactattttaaatctaacaaaccacattcagtttttaaaataatacagggattggatggttagtcctttcaaatatgtttttgtaaggtggttgctgttctcagaatagggagatgtggattattttgttggaaggctaagtgtgttgtatttttacttgatgtattccctttaggttttgtattaggatgtggctgagatccagtctgtgagagcttgattgatttcctgagcattttttcagggaaattttggttttattcatgctaattttagtttcatggtccctttttttgaggcagtggtgtccagttctgtctgttggtgtggttttaatgtgttgaccatgtcagccctgagagtggaatttgaagtatgcttagatttagggacttccccaactggtttttatagctttacctgtctgcattgagatttaaagttaattatgcttttgatttgggtgctaattttaggtcttatttcttgtaggcaagttttattcccttgccatatgtatttcccagccagttaaatggccaaaataacttcagaaagctttaacttctttaagaaaatatccctgataaaggatcgagacgtttaggtgttaccca

SEQ ID NO: 109880 - DNA, 1250 bp, Homo sapiens
gagggcaggcaagggagacagcatttaaccaaaaaaagcctttgtggatagtgccttagtgcctttggtcgtgaaggagggaggcccccggcgggtttatgtggcttctgcccgagacggccgtttttcccgttataagagggggaagatgaaaatggccgctgcgtccccgcggtgttgggggaggggagcgatatcttatttcggcgttgctctcctgcgaaggtccgccgcagccatcttgggctggcgggctgggcgagctgccagaggcacaaaatggcggagaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacggagtctgggatgtctttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaacatacgaggcttgctagaattaagaggaatctgttagaagggtgatagaaaagcaccatagaaattgatttttgaggctgtgggaataatttgtgcttttttaaaaaaaaaaaacaatttgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagcc

SEQ ID NO: 109881 - DNA, 1045 bp, Homo sapiens
tatttttgaaatgttaagtgtttttaaataacttttttcatattacacaattagcatatgttctttgtagaaaaccagaaaaaaatcatagcccaaattaaaaactattctgaaaactcaacctagagatcacagttaacactttacatcttcccagatggcttttctctatactgtattttaaatattaaaaatggtcatgctatacactttacaaagtctttaaacttgttttaagcattgtattttgaacatctttccatatcaagaaaaactcttttacaccatttttaatgacaggatgccattccatagtacgtatgtaacatcatatatttaagcagtcccctttgctggagataaagggaccacaaatatgatatacccatgcccaccaaaccaagtaatctacactccccccagcccaaaatcaaacaaatgacaaataataatttgggtcttttctattgttttaattagtaaccaactcctattaattctaccttctaaatatctctaaaatccatctccatcatcagtaccgtaaacctcccaatatctctcacctggactgttgcagtcaccacctaacaggtctcaccacatcttgccccacccccgccccttctgcatgatgtaatcagagtgatttgtttttaagcgcgagttactcccctacttgagacttttcagtgatacccactggagtggctaaagtaaaaaagaccagcaacaccacatgttggcaagtatacaatgcaggcaggagtgttaaatggtacaaccaactttggaaaactatttggcagtttattacaaaggtaaacatacatctactctatgatccagcaattccaattctaagtatttgccaaaaagagatataaacatgtattacaaaaagacgtatgcaagaacatttatagaagctttatttacaacagccactcaaaacaacccaaatgcccgtcaaccagagaacaaataaacaagtcatggtatccatacaacagaatactactcagcaataaaagaaaatgaacta

SEQ ID NO: 109882 - DNA, 8228 bp, Homo sapiens
ctctgattcctactccatgtttaacatttggcttttaaaatatcgaaggggccgggtgcagtggctcatgcctataatcccagcacttcgggaggctgaggcaggtgggtcacttgaggtcaggagtttgtgaccagcctggccaacatggtgaaaccctatctctactaaaaatacaaaaattagttgggcatgacaatggacacctgtaatcccagctgctcaggagactgaggcaggagaatcgcttgagcctgggaggcagaggttgcagtgagccatgatcgtgccactgcactccagcctgggcaacagagtgagactccatctcagaaaataaaaataaaataatcgaaggaatatagtttgttttttttttttaagtttccaaaactgacctaaaatgctccaaacgtgacccctgacccctggtttgcatacatttgaaaacctctgagtaaaactcacatttccagggttattctactaccttgacagtcattctcataagtaggattttggaagctgatatacttgagaacagaaattgcttggctgccgtgataattgggtaaactctactaggaagttttcctgctagaaggctgctttgcccagagctccaattatattgccctatcagtgtgcctcaggtggactgggttggatataatgcatttcagaactgtttggaaagccctgttaatttttcattaagtggataatggtgctacatgctttcatgtccattctgcaagtctgctgggagcatgggattggatggcagcaggctgaaatgatctgattcccccttagtccatgagctgcaataagtaaacatctcccagcccccctccaatcttattagaattgaacttttgctctgctggcccattagcaactcactagtgtgtttctaatgtttcaggaatgaccattctaattattccttattgactgctacagaaaccatagcacttaatggcaacacgttaatggtctatgggtattggtcaataattcatacgtggagaaatagtagagggcctgcatcctctgggatgttagccaagccctctgcaatcttaaagtgctaggattcttccatctctaggtctcacctcctagtagttgtcactgaatcatcgcctttgttgaatgtttggtcttgagggagttaaatgccttcccttccaggtcagagtagcagatcattgaccaaagcagtcaggttacagaactggctctgctgggattgggagagaacatggggcccagggaatgcgtttccattgctcttcactttcctgtctcttcaggttgctcggcgctggggcatccagaagaaccggccagccatgaactatgacaagctgagccgctctctccgctattactatgaaaagggcatcatgcagaaggtgagccattatacaagacccttagcccactctggtctcttttaaggaaaaagtccagggcttctgtagtgagactggtgatcgtcgctacgaggaaattttagccccctaagtgattctgtggtaggaaacaatcttgagaagacaaacttgagacaagaatcaaatgagatatagagtacatttgatgctgttggttatgtggaaactagaagttgcatgcagaacacacaatagaaaattaggcttctctgctttcccaaaactgcttctatatatagaaatttccagaaacttaggccaactgttgtatccaaaaaggactacagggaatcaacttgaaggtctctacttcaacagcttgattgaagtctttagttattaaaacacctagacctccaaatctgttagtttgatatgctcagaagtgttagaggaataagagcatctgatttttctttcagacttacagaaactggaactcaagttaaaaacccaacgtttgtagaatggcagcagagtcacctggtagcaggttgctctttgtggaatagaggatgaagcatattttgaagaaatcagtacaaaattcttcgtgggataggtagcaaggggccacagtcttaacatcccatggataagtagaagatgggaatggcaagtctttcttagctaccaaattcgtaatgtactgttgcccagatactagcatttacacattgagccagtctacctggcagtagccaataagatgaacgtggcagaagcatatgggcaaaactgctgagaacttgtctacaagaagccagattcatctttctcataggcgggtggtaatgtgaccccatattctcctcgccaccttaaaaaatactcaacagctcattgtgattttctggataaactctagacttgctagtgcgtcatacaggctctgaggctgttcccagtctggtcaccacctaactctcgtttcttcactcaaacttgacggctttcactagcatagccaccttttaatgtaatgtagtatttgtttgccaaagaatacatgttacatgcatgtacattatcaagcataccataaaatggaagacacctattaaactgtcatcctacttaagacctagaacattcctaatgctctcagtacctggccagcccctccttgttttctgtcacctttccatttcagattgggttaggtggtcccctttgctgcttctgatggcaccagtacttgttcctaccactgctcttctcgctgtgtcttaactcctttcttgttactaccccccactggagtgtaagctcctttgggttaggaattgaggtttaacttcagtgcttgatacagagttaaatgctgtaggataggtggtcccctaccttacctctcctttttttaaagtatacggtccagtggtttcacagagctgtacaaccattaccacaattaatttcagaacattttatcaccccaaaaagaaacgccatacccatcagcagccactccccattgtcctctatcctccttagagttgatatcatcaggccaaatcctaagttcaggtgggagagccattattcctttgctgttcccaactccacatccagcatggggagatgcaacccaggacacagtaacttgaaccaatggaaatgagctgtccttatgactagcttctgtgttttctaagggagtagaagagaactttatttctgagaataagtaggcaaagagtacaggaaggcccaggaatgaggcttcgtgggctcagatcctaacacttcaatttgttagctgtatgatttgaggaaagtcacctaatctcccaaagcctctatttctaataaaaatatagataataattcttgctttaatcccacagggtaatatatttgaaaatatttcagaaataataatgtgccatccagtgtaaggaaggggttattattttatttgttacatgactcacgagtacatgagagctcattaaaaggtgaatgatagcccgtcggtgtgtagagagacttagaaaagctgtagtcccatgccctccatttttgaagggaaaattgaggttcacagaggttaagactcattagtgactaaaccaggactggaagccgtgcaactcccagcttctgatctaggattatttccactgtgctctcctgcctcactctcccacacaaactaatttttggggttgggctttaaggtaaaaccagcgtacaacactaactagaggtggttgattggtagagatgtggaagcagagccatacttgttcaattaaaaaaagattttagaatcacagcagaatgactgaagggcaggattaaactcaacagtttgcatttttaaatctaaaatgtttatcttatcagtaaatttggctgccttcccttccccctctgcgtctccagacagaagccgattattgggtttgattttcggtattaggtgcctcttgtactattgctgaacaaccagcagagagaaggtgatcccattgacgcagatgtctcatcagccacataccatgaggtccttgaacaaccaagaccttctggttctaatattataatgcagaaaacccatagaaaggtagttagcggttccctcagtgtagcagagccatgcggtgagtcatttaaagctgcaggtaagccaaaagcaattcttttcagctttggaacatacttaaggcttctgcgcaggctcgctctcatcagatttctaacctttctaaataacaaggccatactgtgaagactgtaaactctggaagtgactaaaaatgtggtcaggcttctgccttgcacctgtcagtccttaaacctttttggaacaccagactccaggctcagcataaccatgctttcaaagctgtcactggaagacagaaagtgaagattttcttttaagagtccatctagtgtgaattcgaaattcagatatcttcttttttaactgctgtagtgtcagtaaaacacttggcagataataggttcccaggagttctcaaaataagtctgagtgattggggtaatcggctgctcctttggtccctggctttgtgacttaggaatacctcgttctcttcccctgatcccatgccctgttccaactgggccctgtaaggtgtgtgttctcccgcaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaacctgcctctttcttgccctcattggtctaattttaaagcaggcaaaagccccctggctttctctccgcccccgccctagccctctcaacaatttagccttaccaatggacagtggcatcgagggtagttagggaactctgttacctggaaatagatgtgcacagctcctcttaaactccagctaaaaatttaatccaaagaggtggaaagtcgagagatcctcttcccagccaatggtgagctgagatcacctcatccccttgagcccaccaagccaccaattcttagtaactctttttttaagtgtagcccatgtttcgctttgggttgtgtgaaaagattacaaagcagtctaggactttcgagtcccagaattatcctcagccccttatgtggatactttgaaaaccagtaagaacttaagaccattcattttctaatttttccccaataagttttgctcttgacaagtgaaaaatcaattaatggttgataaataacgaaaaaagctcaggaaggttttgcccactatgtttttttctggccgtgcagcagtaaaaacctcctcctccaagtttgtctctttctcgtgaatatgtatcactcgggaaatacgtggaaggaaataaagttcgccgggttgtattgcggtgttattacggttattacggtttctagtgctcttatttcaccctttttctgcacctctaatttggccttctcaagactcctattacagtggagaaataaagtagagccttttttcaagcctagaacagaaggctttctgtcagtttatctgctatctttctttactgttttacaagcctctaagtgtagaaacatcgagactgaatgagtgcaccgcctcttgaattggagcttgtgaggaatgaatgtctgccacataaaccccattagcttcgacagattaagaaaagatgcttggggagaaggggcaagggtgcgcaggaaaaagccgtctctgcctctcagcttcaccatgataaggctttaacaatccgctccccattattcacgggctcgttatccagcctgggcccggacccagatcgttaacctaa

SEQ ID NO: 109883 - DNA, 1789 bp, Homo sapiens
ctgaggctttctgaaagtagttctgtcatgtgggcagcccttattgatttatcttgtttcacaaacaggagcttttattattttattgccactgcctcgggcctaagcacaggccgtccagctgcaggtaaacctggttatgatccttcgtaaagctgttattgaatcttctgcactcctaccagtggcatagagaatgatgaacagatggcaaagggcccctgctttcttacttaataaagaaactaatattaatacagaatgctcgtaaatgccaggcagccaagtcatatgagaagcctgtggtgtccttgagcctccctcggttgaccgggcagctttgtttcttcaggaaatggtgctttccaccccaccttgaagtccccaagctttccctaagctccaaatgttcctttctcttcacccaggatcagttgggtgccacatgtgcacgttagcctcaggacaggtgacatttgctgagctccccccacccctccttgtatacctgtgagggccctgttcttgttaatgtcaggaagataccagcttctggaaaaagctgtaagaagtcgtcatgggggagcttgaagggtgaagcggaggaggaagctgttgggacgtaattgtaggcagctgtgtggctgagtagtgcactctgggtaattatccataatatccattacactgtgcatggaaattgtggttttagaactgcgttttggcaggccccctaatcaaatgtcttttgatagtcatccagcttagcaccctctcaattatgactgactcggctttaatctggagccattttaactgtgaatctgcattaatgaatattttggggggtagggttgtttgttgaacatgtggcagataactgctgctgggaggtttgaagggatgggctgctagaaagagccactccctgggctgtggctgctctctctttaaaggggagaaggaataggtagatccgttaactccttcagcctcagtcctcaagatacgtgctaccaaagtaactaatgagagagaagaaagatctgatgacaagctattgcctgcctccccagtcccagaagaggggcagccctaattcccagctgctctggagctgagccgcctcatgcattactgtagaaggaacagccgtggtgagggctacagaatcacagggctctggcccgggaggatgagtcagtaactatggctaccagagctgctttgaaatctgtgcgtataccaaacctttctccagtaagcaattgcatatgcaagtgacagctgagaggtggccgctgaagttgaagaatattcaaggattgttttccaccccttaacatagtaaaatgatgaggctgggcttctctgaaatttccctgtgtcacttgtggcagacagcaattaaagattagttttataaggcatcattgctttgaacagggtacaatgatgtatattattaggttagcagatgtctcttcttaccattatttctattggttttaaatgtttatcttctctaaccaggatgtaatttttggttaattttgccttttgggctgtttcaaaggtagagtagagtgggtaccatatggagaaaagaggagacccaggacatcgtgtctgctgtggggacatgaagcaactgaacggaaattggactttcacagggtttcttgcaaggcagagcagaatcattgctattattgtaattaagagagatgcattcttatcagatcatttttggcttttatgaaaggtcattttagaatcctgaatttag

SEQ ID NO: 109884 - DNA, 2124 bp, Homo sapiens
ctccgcctcctggattcaagcaattctcctgcctcagcctcccaggtagctgggattacaggcgcccaccactatgcccggctaattttttgtatttttagtagagatggtttcaccatgttggccaggctggtctcgaactcctgacctcagatgatccacccatcttggcctcccaaagcgctgagattacaggctatttgtcttcaacaaaccaatctaaaatcacttatttcctactcctccataagccacatagcacttgttattatggctatcctcattcagaacccttaaaccttataattgctcatggaattataattgctcaccaccgtgcccagcctcgtggattttttaagtcgcagtgaatccttctcagatctaatggaagtccttcattgcagagccttttcacctgcctgcccccactgcattatccaacacacacagacctgtagtatgagccaggtgaactaacaggaaaacggagcacagggaagcactgcttatcagacaggagccctggggcattctcctaagacgtgtgctggtaaaggagtatgcactggagaccttacaccttgagacaggctgaactacaaggagggatgtgaccccatccaagttatctgttacctggctttgatttgaaccaccaatcttgacaaggtgcctagcgacatggtggttagcactgagtgtatattaggggtttgtggatgaagactgtcaggccatccttccttcttgagccctttaactttttgccttgccttcttttatttcgtttgcatgtgttgttgggccagttcctccttgacctctgttttgtcatctatacagtgaatttgtttcattgctagaaagtcttttcagatcctctccactgtttggtaataatacccccaatactgctttcgaaatcctctacaggcccaagtctttattcattttggcaacattctttacccttcaagctctttcgtaattgaacgaggtatgtgagtagcttggatgagttagtaggaaaggttgaaattaattttagctaaaaggaaaatggcaggtctgtgtacagatcaaccaaatccatccagctaggccaactgaaatagagatgtgtttccagctgtaaaggcttagtcagagcaacattgatccatgcagacctcagaagcaaaatgcaaaggaacgtactggtgactcagcacttccctgcagtcttagctgtaaaagcaggaattgatgctgctctgactgaggcgcaggtgattacatcagaattggaatgcctaagccctcttgaagtccctgaaaattcagtctgccatagatacagcagtaggacttaggatctgaaatgataggattgcactctagtccttaaatccatagttttagtacaacacagaatttgttaagcaacgtagtctttcttttaaattctctttcaggtttttcatatgaaaaagatccccgattatactttgacgacacttgtgttgtgcctgagagactggaaggtaagtagccccatccaaggtttgttgccaggtagaggtttggaggtgtcagaacacctcagccatgactctcttcccaagtccagtgattaaatcagcatgaacaactcctttttgtcccaaccacctgagaaacttaggactaagctattgtgtgatgtgtccttgtcccaaacaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggtatgcactggatgctggactcagacgggttttgatttgttgttgttgatgatgttttttgtttagatttccattgaggctttttgtgtcaagtctgctcttgcttctcattcatattctggcctggccagtgggcttggctgtatccctcctattaatgggacagtttctaatacatggacaggcagagttctccagtgtagaatacatgaaaagtatttgtaacacttctgcaaaatttagggggcaa

SEQ ID NO: 109885 - DNA, 1824 bp, Homo sapiens
agagcccatactcttcatctccttccatatttcacagccaatgtcatctctatagcacccaacattacactatgatttcctcattaatggctgcacagtactcattgcatggggatgcttttagctaatcacctattgctgaaaagtgggtacttccaggttattctcaaattccatgaacattcatctagctaagtgttttcttgttctcttgattcttgaagctaagtttctgaaatttctgggtaaaggagggtatgacattttttaaggcatctgctgccggtttttgtgagggtctgttttgttgttgtttttagtacattgtcacagatttttaaattttacgatttatctaaagaagtaattagatgtgaatcaaaaggaagaagggatccttttgttgggggaggataatcgggcttttaagctcctgcataaatgaatgacagtagcaaatcagtgggctcatttgatggaaaggagccctggtagggactgagatcatgcttgagggatatgaaaggcctggagaggtgggctcagagcttaaagttacccttctgggcaaaggctaacttggtatggtggattgaggagttcccttctaaacattgaaatagggaagtttttttagaacaccttccccagatgtatgtcttctttttctcaagtgtatttctccctgaagatttaaagcagtgtgattcccaaaatctgtggcaacagcttcacctgggactttttagaaatgcacattctcaggacccatcccaggcctactgaatcagaacccccagcggtggggcccagcagtctgtgttttaacaagtcctgcaggagattctgatgcaccttcaagtttgaaatctactgagtagtaacggttctcaagtttggtcaaacattggaattacctgaggagcttctaaaaatgtagatttccaggtttcctccagagcaattaaatcagaaattctggggtgggacccaggctttagtagtttctaaagctccccaggtgattccagtgtgcatccaaggttgagaaccactggtctctgtcattttaaatgaaagtcaaaagagctgatactcatgaagcattgggtggcttttataagtgattagttcataagagccgtgtttatgggtagctgcttcgcactcacttggttagatgggagaccgagtgttgtttcactgggtaccctgtgatgttctgagtaagtgtccagccctggaaaggcagggctgtctcccggacactggctgtgatgggcacagctgcatggggctctttgaggttcctgaatgtttctacagaagcagttgatgtctgcagcaggcaaactaggagggagtgggggaagagagggaggaaaacattttgcataattacaacatttaggaaagagcatgctcttaagggaaatatttttagcaaggcattgggttgcttactacacacagactatctggtgcatttgtgtgtgttttccctccaccctttcccattcctttccctgacttcacacacatcaaagaagttagtttcaaagaatccagcatttttaattgttctaaattaccctgacatgcttttcctatccttatacaggcttgaccacagatgcctgtgaaacagttaaggaaacaagtgtttctgattggcatctgtgattgctaagatagccatcctgccttaagtgttcacctggagtccttgcataatgttttgagtctttcgtttctagtttgcccctcaaacaggtcttccttcctgccaccttcatttgagtgattagatgattgtggccacaa

SEQ ID NO: 109886 - DNA, 2795 bp, Homo sapiens
cccccgccccctcagggattcaaacaagaataccatgacccactctatgaacatggggtcccgggcatgccagggcccccagcacacgggttccagtcaccaatgggaatcaagcaggagcctcgggattactgcgtcgattcaggtcagcatcaaattgtgctattctttgcttcattcttgcattcttctgtctcgttattcagtgtcttatacatgcagggccttggggacaggaatttttataagaattttttataatttttataagaattgccctcaaataacttaggagctagtagagctgacatgtttatgcgcaatggaatacaaaacaaaacagaaaagctatgtaagtggtaggaagtgcggtaggcattcagaagtggtatgaagtacatctctgagtccaagcctggagagtgttggggttcagttttggatggaatttgctcgaccttctctgagataatacatagattgatctattcaggcaccagttggttatgggaaatgctgaggaaataggcagaagggagagacctgttgctttatgacagaaaaattaccaagtgtgaggtagtgatcgtgtgtaaacatttccatcagcattcctctggaaagctttgatgtatttttctcaggagtagcatgaacagcaacattttttcctttaagactgacattttgatctgtcctgatgggttttgcaccccactccactcccttaaagcaagacactcaacagaggttaccatatctgtaattctttgatctgagttgtattgccagggtgatggctcatcccacatggacacaactcaaattactgtctttcgtctcgatggacactgataacatgatggctgaagaagagatcacttgagtgtggtttggtttcagtatgacagccccagcatggcaaaaatggaccaaactgcaatcctctaccccttccaatgctggtcctggcttcctaacttcaggtcccctaatccctttggcctaaaaatactcccacctgttggagcaaaattagatgtgaccaccagcagtaaaggggagcaaattagaaaagatctaaagcagtcctcttcccgttcccaccctaacacccaggagtcagcatgggcaagaggccaggcttggccttttgaaagccagtattttttcccctgccattggctctttcaccagatttagtgttaacacatttctaaaataagtgaacaatgagagtgaaacatcttttttttcctcccgtgactcttgattaggagagcctgcctttcagctggtgggttatggtgtttgccatcttgcttattggtgtggcacctctttcccaggacaaagccagaaagacatgaccccagagcaggaagtttaggggctttaccacagagctgcagttgaccgatgtgctgtttctgctgcagaaactattgacaggattgtgtccacctttgctttcctttcagaagtgcctaactgccagtcatcctacatgagagggggttatttctccagcagccatgaaggtaaggaacctgcttttctttcctcttctctcctctctcctctcctttcttcctttctttctctcggcttttctttctcctaccttccttccttcctctttctttgcttgactaatacccaagcttaaaattgctcagtttccaggctaagatttgagatcatagtttaaaccttgcttagctcatgaatatgagagctgattgattgtaatcttcaattattttgcacgcagggtttcaagcatgcccctaagccctgtgagggctgccattttcattagcaatgaccccaactttttaacagtataggacaatttggagaaaaaacaaacccaccttatttccacatttccagaaatggaggttatgtttatataacactatcagctgaaactggaatttaggagttatgtcagtgagggtggtttttatatgttttacagttatgtcagtgagggtccaaggatgtcttagagttttaaaaatgtgtctctaggttttttacttagtttgagtgcttgggtgggtaactcttcattgtaattattattatatgataaatggttgccatttttaacatgggagggaaattgaaggtattcttcaccaaccttgagggggctggtggggaagtgagctagcagggggtagggagtactggggatgggagtggagaggtatgttatgtacaaaatgcattattgaaggacacaaatgttttctcattggatttttaaaaaatacctcaaaggagaaacatgagaacagatataaagcagtttacccacaagcctggattatcacatatcctaacatttatttttatgtgaagatgatcgttttatatcaagggtgtatgctgtctgctcaagttcttgtgccctatccctttgggaccaacttaattcagtaagtctctgagatcatctcactctaattaggagcaggagcagtaggcaaggttgagcctgtgactttgccttcattagtgctgacctactaattagggtgaaagtaattgggaacaaataagatgcataagtgttccatagcatatggcttcaaggaagtggtcagaatggagctagaatgtcagtttcttggaggagcttgctttttttcatctttttttgttgttgttgttgttgagacggagtctcgctctgttgcccaggctggagtgcagtggcatgatctccgctcactgcaagctctgcctcccaggttcacgccattctcctgcctcagcctccc

SEQ ID NO: 109887 - DNA, 2044 bp, Homo sapiens
gggattacaggcctgagccactgctacaggctgacgcctgtaatcctagcactttgggaggctgaggtgtgtggatcacttgaggtcaggagtttgaaaccagcctggccaacgtggtgaaaccctgtctctactaacaatacaaaaaaattagccatgtgtggtggcaggcacctgtaatcccagctacttgggaggctgagtcagtagaattgcttgaacccgagaggcggaggttgcggtgagccgagatcgcgccactgaactccagcctggacgacagagcgacactccatgtcaacggtgaaacggttacaggtttcaccgtgttggtcaggctggtctcaaactcccgacctcatgtaaggaactcacaaggtgatctgcccgcctcgagctcccaaagtgtggggattacaggcctgagccaccatgcctggccatatttgcatatcttctgattttagcttgggagttgtggggagaaggtggggcagttgaagataatgtttattgagaacttaccagtgttataacagggccgggccttataacatacattatcttacatcatctttacaaggtatcctggctgtccttatttttttggagaggaaactgaggcttcagagcggttagataactcatccaaggtcacacagctactgagtggtaaaggttggacttcagcctaggatgttctgacttcacagccacagcctcttacccagctgtgctgcttctcgattttccgtcttcttccctgagccttaacggaagtactaagtgcatgatgttgatttcttggcagattttatgtatcatctctcagctggcctttaaacggccactgcttcacctggcacccataatcactatataacctctgtcagatccttttctcctttttttttttcctgtgagcattgtgtttactctgtgtgctggcagcagaaaccagaaaggaaatgcagaaaaagcatctaacggttttcataacgtaaaccaaatgttgggagtgtgggtgagctcgtgggaggaaaggcgctatataaatctgacaaataaataaataactagttctttaaataaactggcaccgaaaaagccttaaactgtgacctattgaatttaggcttattcggagtcagaagtccctttgctcaccaaatgtgagttccttacacgtgcactctgttgggctaatggtgggagtggatggaagggaggaggttaaggggaggaagaggaggtttggtaggaaccaggctgtgccttcactgaaagtgattgcctgccttggtaaattagaggcatctttgttgtagctgtattatgtatacaacacattcttagatacttcaaaaggactggagaagggagggtggttcaagtgaaggtcagtgagtaaagttcacaggatgtattttgaggacaaggactgaatgacttcactaatctctgcacataaaagacattatcagcagcaagctctgagaatctttcttccaaatatgttggctttgtgacctacccctgagatcccccttggccactcctgctgtctcaagacaaaccagtacggaacaatcccaattatagaatctgttctgcagatcacaggcctctaagctttgcgcatccttaaagttatgccgcggggaggggatgaggttgctggctagtgcccatgtggaagtaccttttcctgaggaggccataccaggccaactctagagtttcattctggaaggtgagaaaagatgagcactaagcggaagtgaggccaccagcctgccagctgcagaggctctggttacagaactgagcggcacatgccatctcggagctatcaaaggaactgatttctggaggtcaccttcgaaggtgctgggatggtggcagaggggaaagggagagaaaatggaaggcgttactaccattcctttcaagtagcacaagatgtgggcactttacaaaaataaggccttaagaatatcttcggccgggcgccgtggctcacacctgtaatcctagcactttg

SEQ ID NO: 109888 - DNA, 1122 bp, Homo sapiens
tttggaatacactgctttctcacttacttgacatcaaccaaagaggttaaaacccaagaagcagcaacatttaagaaaatgctcctgtacctgaagaatcctctgcttctggatagcccctaagggcatcagtattgtggtaggctagcatgctgtaattgacagaacaaaatgtgtagtgctggagtcatcaggaaaaggtcaactgggtagtgtcttctgaaggaggaaacagcctaagctgtttgagaatgtcaagaacgtctgcttcggtggttattattgaggattcagagcttaaagggatgggctaagttttctggaattttgatttaacaaaaactaccaattccttaaggatgctagataaattaagagattttatatactcgtttttcctcttgttttttcttcctctcttaaagttcattacccttaaagtaaattgctattcattttttgtccttcagattttgtagtacaataatttttagagaggaatgaacttgactgtaagtcacatttgtagcctggcctggaataaagtgaatgtgcctgatgcatctcttctccaagtgcctgttaataacatgttgtgtatggcagcacagattcactttgggatctgaaactgagtttcatggatgcttaatggatccttctttgacagactgaatgatgttcttgtaatggttagagtgcgtaggtttttttagttctgagtcttaagagggtttgtttttagcatttcatcatgtttactgtaggcttcttgttaccttttaacaagctaaaggacatttccttttatccccagtttactgaaagttttttaacatgaacagaggttgaaattcattaaacatttatactgcctcttttggggtgatcaaataattttctcctttaatttcttaatatggtgagttacactgatttatatgaaaccaaccttgcattcttgtgacaaacctaacttgtttattctttttttttttttttttttttttggagacagagtctaactgtcgcccaggctggagtgcagtggcgccatctgggtgcatagctggaattataggcgggcaccaccacgcccagctaatttttatatttttagta

SEQ ID NO: 109889 - DNA, 1001 bp, Homo sapiens
gaaaatgagacagaccaaaatccctggtttgatatttgtaaaagtaatagaaattacagtcatggataatatcaagcttcataatcacatatttaataacttttatgcctgcccaaaagtggggcagattacttttattggtgactataggttgtctcttggcttagaactttttattaagattagagggactattacttcaaaacgaaatccctaatacaaatatatggtattttgcatgatagaagtaaagagagtctcatttgaaacttttaaccgccctgtgacataggcagagtgaaaaaacccattttataggttagaaatcaagcctcagcacagttaaaggactttctaaagctcacatagccaaatacagggtcctacattcagcaaccaaaaacttccatgacgtgtaattacgccatttgtttcagttatgattttatttgggctgctaacatccactaatgtctactataaaaactgagtaattgaccttgataaatttgttttgaccttgaacattatctgtttttttattatacttttaagttctatctatctcttcaactacaaaatcttaataaattcctacatcatttaatccaaacccatgtgcttaacatgtgtcttttttgttttgctgggtgtgccgtatctgttcagttgaatagagtaagctctttgaggataaaaacctgtgatttagactcctttctttaggccacatttagccttgtaccttatttgtcctcagtatatgtttattgatagtgataaaagtttgctaaaattataccgtaaatagctaaaatgtaatctagtcaaaagtacacccttgccacacatggcggcacacacctgtagtcccagttacttgagaggctgaggtgggaggatcacttgccctcgggagtcctgggctctgtagtacactatgccgatctatcaggtgtccacactaagtttagcatcaatatggtgacctcctgggagtg

SEQ ID NO: 109890 - DNA, 1032 bp, Homo sapiens
gaaaaccattaaaaaccttgtggctctacagagcactaagttcatagggtacccagtccttctagggaaagagtctcaatcctgggatacttgatctgtggctttgaggcaggtaatatatacttcttcatgtctatcatatgttaatgtgaactttaagcaccagagaagtaatctccaaatcagaatatatgaaaaagtcttgaagcttgtgccctttacttaagaatatccaggccccaggaatgaagctttaattttaaatcattctttgctctagaagataaacatagatttgcctgaaagggggaggagaagagttgttaattcaaatgatgtcacagcacaaacagaccttcaacacatattctgactaattcctgggaaccctggaaatagttgggagaggggaccagagaacacctggcaaacatacattctcccctcacccacccaccctacacaggcatacacggagaattcttttagaaggagggaaaaaggaaaccggaagcagaggctaaaattatccttgagaaaaatcactagaagtgttaaacaagtccctgtgacgcagtgtgtttgtcacttttcagaggtacaaatatcccctcggggctacgagcgatttaactatgttaatgctgttatttcctggcaacaatgggctgcaaactagctttctgctggacctggtaaccatgctaatggcttcatttcagcttaatggttccttctctttttctgtttacagtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccat

SEQ ID NO: 109891 - DNA, 1011 bp, Homo sapiens
ggccaacatggtgaaaccctgtctttactaaaaatacaaaaattagctgggcatggtggcgggcacctgtaatcccagctactcggcaggctgaggcaggagaatcgtttgaacccaggaggcagaggttgcagtgatcacgccattgcacgccagcctgggcgacagagtaagactccgtctcaaaaaaaaaaaaaaaaagagaaaagtgatgatttgtttagctagttctacctcgtataattactaagaagtaactcctaaagatgttttaggagtaaacattgagtcaaaatgaaaatgttactgggtcaccagaccactgactgtagttagctatttaatgagacctttgatacagtggccagtggccagcatagaagcttaacttgctctccttccccaccttccaaggtagctagacaaggagtaaccattctaactcaactagaaggcagcccttatagcgcaaaatgcatctttccactttggataaaatgctgtctctgcaacaatttagctcctagagaagacagaaaaggcaaactcggttttttgttctttgggtttattttggccactacatgtaaatcaccttgatttgaaaaattcttgttactctgccctctcagaatcctatgtggtatatgtagttggcttccaagccaaaagcagtagctccatgtatttattccatgaattcagcaaaattcactgcaccatctatgaaaggactggttacgcaaacctacccttgctggtcggtcactgagacaggcctggagcagatgttgtaagcacaaaggtagccaggctttctgctttctgtattcattagcctttcctaggtggtggattggtctgttgttttattcctttgcttttaaaatttttggaatgcctctaaagttgagtatttcttgctgagagctgatatttaaagttacttgagaaaggactttttaaaaattctatatttaatttgtaaatatgcatctgaataagaaatat

SEQ ID NO: 109892 - DNA, 1186 bp, Homo sapiens
agggcccctcatggctttcctgtcagtgtagatctgtgaaactttccattcttgttcctgccatgttttgtcctgcggggaaagtatatgtaactaacattgtacccagccttgtagggtagatgtggtccctgccttcacggttaagaacaaattggaaatataatccatttgttcacaaaaatactttttgaactccccctttgtataaagaatatactattccacatataagacgttttggggtagaaggtactatataatttagagccaaaatgatgtggtacacactaagtactgtctggatttgaagaaatcaagacatcagaattcgctggcagcttagatccttttagatacgtgcagttcctgaaacaaatacaaagtgtttctgggcaactttggcataccctctggtgttagacttgtcagcaaaattggtaactgttataataatattgtgacaatgtcaagacacttctaaaacctgaaatcagaccattcaataataccctaattgttttctttccaaacttaggtaaagtggtgattgcaaatgattatctttagataaagcaagaaaagtagacgtttcaaggacatgtagcttttgtttaaattgggtcatcattacctttcctcattattttgccaaaacttttatagcagaagactggtgagaggaagggcagtgaccacggggcagtgctgagaactgccagactatctactgtgttggaggaagggatttctgtgtcaaattctcatttactagcaacattcaaacaagcttcgctattttctgtgtctgaatatctgaaacagttgataacaattgagtgttggctgccatgatgtcaccatcaaaaaatcacgagagaaactctaatgacttctaaatataatctgctagttctcaacttattttatgtattcaggaaaagcagttggcattatataagaaaagaattatgaaaacctgtcctttccagtcagtcactggcaagactttgcagcaacattgctttataaccttgtcatctgtgatagagtcatctgtctcgtattcaatcctgaattcagaatttgggattatagaggcacctgagaggccagttggctggaagatagttcagccttatcagatattaatagaaaagagatgattgtttaggccgagtgcggt

SEQ ID NO: 109893 - DNA, 1416 bp, Homo sapiens
ttgccttattgcattggctaggaccaggcttggattttgatccctgtgtcagatagaaaaatctaaggagttccgtagtctaataagaaaagcaactatgaaattggttgacttgtgagcatcacatctaaatttaaaatggtgttatggttgtctgcaaggcaatacatgtacttgattgtgcatacccacagatatggacttaattacatcttatcagctaactgcccttcttttttctacccctgacgagctaagactgtcatatatatttgtgcatagatccttagcagagttcttatagtcaaataggggtccagacagctcacgcaagatcttcctgcctcagtggtggtagtaagacaattgtccagaagcaattgcagggcagggcagggcttctggggagagagatggcatccatggctgcagtgcggagtctgggtggtagtgactggctatagaagatgccaggtcttctgaagtgctggtagctgtctgaatgagcagaatgttttgatcagctcgactatagaagggagagtgagatcttttagatggaatgctagaatgggaggcaaggattacaaaaagtgaaggctgccgggtacggtggctcacgcctgtaatcccagcactttgggaggccgaggcaggcggatcacctgaggtcaggagtttgagaccagcctgaccaacatggtgaaaccccatctctactaaaaatacaaaaaattagccgggagtggtggtgcatgcctgtaatcccagctgcttgggaggctgagataggagaatcacttgaacccgggaggcagaggttgcagtgagccgagattgcaccattgcactccagcctgggcaacaagggcgaaactctatctcaaaaaaaaaaaaaaaaaacgaaggctactggagtcagagatggcattgcttgtgacaatggaggtgaaatagagatcctggttaattttggtatcccagagccagacaaaggtgtaagtccttgagtggatttaggggtatgacgtgtggctcgcactggggagtgtagggtaaacatgaggatacagccctgagagctggaaaaaagtatccttctgttgtcttctcccgtattgtcttccttctctctttccctttatcttttattctctctttgattggtcttttttctctcagattccttctgggagccaatataatgaaaagactaagaactgcataggtaggaatcctggccactgaccagctgtgagacgtggcaagtgactttgagcctttacgtggcaagtgactttgagccttgttttcgtgttcgtaaaatgaagacaatggaagcattaatagctttctcattgaattgggaagattgagtgaaatgatgtatgtaagagcaactgggcataaaggaaa

SEQ ID NO: 109894 - DNA, 2708 bp, Homo sapiens
gctgtgccagttctgaagcttctttccctgtacctgctaatagcaaaccctatcccaaagcacaagcacaaagcacaagccttactttcttcatgtgggactttgcccaggacaaatgcagctgttcttgcagaatgagcctgccctgaaatctcagcccctgcatgtggtatggccagccagttgttggcttaccaggtgtttgtcatgtcccctatgagtcgtatggagggccttgattccacactaaggtccagctgccattcttggttcctaagacataaaggcacaggggattttccaagccagtgtacttacttcaacacagtttaggtcttcagccccgtgttcctttttattagcctggtaaactaggctgaacagttggagcccccaggctcagagcagcgaaagcataggccacctatttccagcttcctctcgtcctgatcccagccctgctcagcatttaggggtaaaaagggctaacccaagctgcttatgagggaagaaaatgaaggagaaccataagaaagagaacttcaattctgccaaccttcccaggttggtgatagctgccttgcactctctggaggaccctggggatgaaatcgaatgagttgtccagctgttctggacaacctatttgtcctaaacgtgttttacatataaattcacaaggagtggaaattctccattttttctcaagaatcgtttgtggttgacttgggcatatattttagttcctgttatagatgcattaatatgaatatagttactgataggtgttatttttgttgatcattttgcatttgtgtaactgctatctttttacccaggcaggttgatggaagtattagcaggcagtagtcacagtgacagcagtggctgtttttattttgccatctctggagtgttcccttgtcctttctaagtgggccaaagccaacaaaatgtgtttgagaaccactggcgtagacattaggtatgaccagcatatatccttgtgtaaggctagattcccagggctgtattatccttccaattcagtaacaggccaagggtggctttcttcatttgtcgacgtatggttttgaggttctaagcatttctacttttgacatgttagtcaactataagataaaggattttttttcctccaaatatctcagaggaaatgggacataatagctgttttattgatttatttttaaaacgtattgctacatttgcttcatctctgtgtatatatggttttttcttaaccatttgaaagcaagtttcaggcattataacatttcaccccaaataccctggtgtgcgtctccacagattgacattctcctacatagcctgagaaaattaacttttattcagtaatgtttggaattccccagttgtctccagatatctctttagcaatgttgataatggttttgatctaggattcaatttaaaatcacacattgcatttatgtttatgcttcatttgtcttctttaatatgcaacagtctccctagcttttttattttccctgtaacagtgacttttttgaagtcttggccagtcgctgacttttttagggtccatttttaaagaatatatagaaatgcaaacagcatccagaaatgctgcccttaggcttagaaatctctaatattgttgattctctcacttctcacatttatgtatttgtgttgaccttaaaacagtggtgaaagaacagagtgacacagatggagataattgggtcagagatcatttgtgcatgtttgaggagagggcttttggggggctcattaaacggtttttagcacagcttgctcaatagttgattttaccatttgtggatgatttttcacctattaaatttgagaatttatccttacacaggttagctgtgtgagatattaaagaaaaacggcacattcttccatacctacaccaattctgcttttagaacttgtgtcccctaactaaatttgataacattgtcaatttttgtttttggaaactgttgccaggcaggatcaatgttaaacaagtttgagcatgcctcttatttggtttggaaatccagacatctccttttccagatattcttttttaagtgccagaacctgtccacttaaccttatctccttgtgaaccttcttgtttcccagaacagagtattatctactattagagtcattcactagtgctgttagagcagttacaaagaatattgaggtataatagattttatgtgtaaaatgagtttttaatctgctcagtcctaaaataaatatttctgaccctctctggtaatactgtagaacttaaaaaataagtcttaccctatctacatcttttttcctgctaactaggtatttgagctttgtctcaaaattcgtcaaaaaaggcaagagctaagagtaggcagcactatgttggaagcacaaggtacactccctcctgtgacttaaagccctctggtctttgccagtggagtactcagacaagttaagggcaaatcagggaaaaagaggtcatacctgctcttccctggtggatttttcggttctgttttgccagtgtccttgttatttttccatgtccctcttcttgatcatcttttcctctaccttctttccctgtgttctactcactcccacaaccacagaatattaatagtatgggcaggtgtctcggacttctctcccct

SEQ ID NO: 109895 - DNA, 1049 bp, Homo sapiens
ccaggtggctcccgatgtagctaccagcagtgaatgggaaggaaggtctggagaggcaggcttccagagagagttgtgccctaatgcaaaccagctcaccctggggcaggagaaataccactgaagtctgtttctctccgctggtagctacagccagattctgaaccgaggggcacatgatagtttttcttttgcctttcccgttttgccagagggcactttctgaccttacttctagcggacttttgcacagccttgcagatttccacaagggtcttggccatttgaatcctaggaagggtgcacagcaggcaagatcccctgccgtgtctgaatttcttacgtaaacacagcgtactgagcgagcaagcgtccctgcggcgacagctgggcgctgagcactattaggtctgccccagctagcagagctgcagattccccctcttgcctgaatggagcattccaaattggttgtgaatggagggcggggctcacttgcagactttttcaatgaataaccagaccccattgtgcagcccgtggaaaaacaaccaactcaaacaacactgggactgttagaaatatgcttgtgattggcagcttggagagcctccaaaattagtttcctttggcttccctgctgctccctgttctccaagcctgggcttaatggggtttgagttttcttttaagtgctcactttaacccttaaactgccgggctgatggcctgggattctggggaagagctgccgctgacccacaaagccagtgaagcccattcccctttctttgtctctcattttagactgtagctgtctaaagggcgtgataataagaggagagggtggtttagcttcccctggagagggaggtgttgagacttgatctgaggctgttaaacccttttatctccttcccgtggggttgtggctttagctccccattgaggattcctgcctgctcttctctgacctcccctctactccaggcctgaatagcccaggtgtttacctgccacgacacagacacttcttgcttaggcttaca

SEQ ID NO: 109896 - DNA, 2876 bp, Homo sapiens
caggaaagcatctgggaggcctctggctgtccaattcagcactcacttctcttccttctatgatcctgagaaagttactcaataccttcatgctttgagtttttccatctaggatttggaagacagagagtaattataaaagaaaaaaattataaaaaactgacatatttaggctcacacctgtaacctcagtgctttaggaggccaagtcgggaggatctcttgagcctaggagttcgaggttacagttgaagcgagtagtgatcacaccactgtaccccagcctaggtaccagagcaagaccctatctctaaaaaacgaaaacaaaagaaaactgccatgtttcctagaagacacctttcgtgtgtatacagataaaactgtgtacatatttcctatatatgaaaaagtgtttgtgcatgtgtatatatctatgtaactgtgtatgtagctaaatgtgtaccttaacacatagagcggctaaaccagggaatctgggtcagtgcatagatgtatgtacatatttactacacattttcatagaactaactatgccatggataagattggaactcaagagtgtttcaaagtcggggtaaggtgatgtgttccattcatttttctgaactgactgggtacttaaagagtgtgttactagattttagcatatataaatagcagttttttaaatatacattttgggtctgatttttaatctcacttattaatttcagttatgatattataaatatatacctgttagcatcttgaataactaagatattttatgctgagtagagagcatgataaaaatcttatttcaaagtcatggcctccataccaaatacagcctagagaattgttttaagatccaaatgaccccattttccccttgaagtgttctttttagatctgtgtttcaaagagaatggaacaactggaggaagtacaagtaatttcctaaggaccagctaattaactgataaaatcgacttttcataaatacattgcaatagacggctggggaaataggattaactgttatgacagcccttgagcctaaaacacattgatcttaatcctgtttcacgatgagattattcagctggatttctttattaatgtgtgagtttagtacagtagaggcagtgcctttcctttggagagggtacatcattttggtctttggtcctaggtgtggtgtagcaaaacaccacgttttcttgcttgggccacctctattcaaaaggatcatcctaaagtctttttgtttggcaaggtaagaaagaaaacagtgggcactttaaaaataagaggtttgagggaaaacaaggccattggtttatacttttcaggaatcagtagttctgaaggtagaaaagaatgctgatgaaagcgtgaggaaaacatggaggagagattctttgactccaggttttacagtgttactttcaaagtgtttgttagttagcccagtaccttactgctgggagggtgctaaatgatttgaaatccttcctgttttgatagcctcaaagattcttagactcagtattctgaaggacccaagacctacagtacgcatttacttaaaggagccatctgttttacaaaatctgctttcgtctacctttaattcagttaggcttatttaaaactgaatttttctcttacccttctgtgtctctgcgctgttagtcatctaacaaaacccagtaggcttaccagtcctttgtatttggtgagaaagatttgggacggggagttacatctgtgtcaagatcacttgtgtaggtgccagaagtaacaaaatcctggcatccatgaagaaattaccatttatcccctcctctttcagcattcttcagttttacaggagtaaggcatgggtagcataatgaagccgaaaatgtgtactgtctcccatttctaccatctagtagtatcattgttttaatttcagccctagaaaaaaatgtttcttggtggtggggtggggtgtgtgattctctgccgagaaactgttccctccacacatttcttgggttttagtggtggtaaagtacatccagcctcagaggctgacagccccctctcgggcatacggctgcccttgaggcagcttgggccccatctgtgccctggcacacagtgcttctccacttggaatccaaggagctcagaggcttgtcatgttgcagctcccagctcttggacaagtgccaggcatgctgatgccattaccggattaggttgcttttttaaaaattcattttgtgaactcatcaagctcatttaacagaggctttggtcgtcagtttctatcattgtcctatccctctaggcttggcttaaaggagtggcaagataccaggcccctagtatgtgccggcactagttagagtgtgtatgtataaattataaccataatgtaagtacacctttgggcctggcaggcaaatgacagtgggttagcaactcagatgttaaagggaaaagaattccccgtaagaggactctgcatagaaaataaagggggctcccttgtttaaaaagaaagaagcatctaggggaaaattgaagcagagagtgcaagattccagggagcaggataagatctagttattaaaaggccaggagtttgaggctgatctgaacagccgaggcatggaatggggattctgtggtcagaaggacttcagagaaatgcttccagtggcactgagttcgctggaggggacatgagggcaggcagtgagaagaagcatacataagacatttgaaaatagccaaatatgtgatgaaaaaaaggaaacaaccatgagctaaaatttatctcctggatttgcttttcataaagaagtatgcttttcctt

SEQ ID NO: 109897 - DNA, 3444 bp, Homo sapiens
gaaagaaaaaatgatgactgggtaaatggatttggcacggagtacatcctgtacctctgataccattaatcaagcccggcattggtgtgtaaagcttgcaccttgagtaggttttaagtacttcacagaagggtaataattttgcacaggccctaaaaaaaaggcagtctaaaattgtttcatttctttttttcccccctcttagttaaaatctcccaaattcatattacaggaggatcccttttcccccagaaattactcaatgctgaaacctctcaaagtggtattagagacgctgaaagcaccatggacgggttttatgatcagcaagtcccttttatggtcccaggggtaagtttatgtggcttttggtttgttttgtcctccctctccaatatgagtcttccccctgtggacctctttactacacttgagccttcactttctgttggcctctttcagaaatctcgatctgaggaatgcagagggcggcctgtgattgacagaaagaggaagtttttggacacagatctggctcacgattctgaaggtagtaaagctttccctgattatgttgtggcttccctgctcccagtgacagtagcgtgtagattcttccctgtcttctccctagcgaaagaaatatcctcattctggggtcttctttttcaatttcagagctatttcaggatctcagtcaacttcaagaggcttggttagctgaaggcaagtttcatggatgtcctattttccatataaaacattttactgtgctttttaataaaacttaaaggtctaaaataaaaatctattttccagcacaagttcctgatgatgaacagtttgtcccagattttcagtctgataaccgtaagtacctttctggtgatggcacatttgttctgaaattgtttggtcttagatcatccatgtctagaatatgcttttttcagctatggccagatttagacagtagtatgcatttagtttcttctaataattcagaattaaccctgaaaacttttatttcataataaaattatttctaaagtatttctactgtattgcaggtaagatttactgaacataattttatcctaaatttctttttaccttaagaatattgtaaagctgactgggcacagtggctcacacctataatcccagggctttgggaggctgaggcaggtggatcacttgaggtcaggcattcaagaccagcctggccaatatggtgaaaccccgtctctactaaaaatacaaaaattagccaggtgtggtggtgggcgcctgtaatccaagctactcaggaggctgaggcaggagaatcacttaaatccagaaggcggaggttgcagtgagctgagatcgcatcactgcactccagcctgggcaacagagcaagactccatctcaaaaaaaaaaaaaaaaagaatattgcaaagctttaagctcaaaattataaattaactgacaaaatatatttggtgttaggccaagcatctattaatcacacattgttttatggcttttttggggtttgttttataaattaagtccttgatgtgaatcatgaacctgatatttctctttttcttaaaggtgcagaaaatagttaatggaaaactccagttaactttggcttcatccaacatgttgtcaattttgtctctacccctaagctgacaaggggtggtcacagagtggcctgatttactcttacttttcgtgtagttgctgtggcttttctcttcagagaagagaaactttttcttaaaatggccactaagtgctcattactagagagaaaatgcagtgggaagctcaaaagatggctttcaacactggcaggggcatggttactttgcactgatcttttggggctgtcctcaacaggtttgggagcttttatggtctaggcagagttatgaaggacaaagccggctgatgaaatttgagcagcacagggctgctctagagagcattagtcactggcgaatgagcaggtttaagagaggcctggagaaaatgctgcctctcttgagagttgcatcatagagaaattcatgtctcttagtcatagtttataatagcaagcacctgagccatgcaaggactcaatttctcattttggaccaacagattcttcccagctttgttttatctctgggtaggtgggtgtatgtgtgtaaaaatgccactggagagagagtatcttaggtctctctctaagtaaaaagttgggtattccaaatcttttaaatgtaagagcagaggtaacagctaaacattccttaatgataggcctcatgtccaaggcacaatgccatgaaactgtaaaagggaataaactggaacacacacatgcatggttaccttagctttgtcacagcttgctgtggatgtgttctatgggagagtaaatgcatgttaattattgccctttgattgctttcgagtgattgggaagcttgccactgaaagactaaataaagataatccaagtgtgtgtgtgtgtgtgtgtgtgtgtgtgtgtgtgtgtgtgtgtgtgtgtttgcaagatgaaagacagggtttgtaatccaactttgttctgtgttgacaatttggcccagcctttccagttcttgctcagagcagcataaactgcagtctgtttgggaggtggctttcttggcagaggttctttgaaatgcttttatgacacttttgtttgtttctctgtaacccaaaagagttaaaagggagatgagatggctgcattcaaattgattgcatgtgctgaagcaagggtatgttctttgtcagcaagcaggatttatatttggagagatatttatctgtgggaataggctaaagtgaagaaatcaataaatgtgttttggctctttagaaataatttctgctcagcaaatagaatgtgctaagttctttaattaaaattccatacctcaagtggaggtaatttgggagatgtttctgcttaccaagtatgatgttttttttactttgcttactttttgttttaactgcctaaggttgagcctttctgtcttttaaggataaaagagatggttgactagcctagaaaaggtcttctaatgattctttccctctgactttatttcttgaggtagagcttcaagaagggatagattcaaatagaataacttgcttaagaagcaaggcaagaacacaaatgtgggtggtgcatctttgagccattcattcttgcaaaagcaagtttgtttgcctgcagttcagaccaacagccagaagcatgaggaggagctggcagagcccacagccggctgcatgcacttacttttccatgagcgctttccacagcctcgagttcaggaccagcttcactccagtcattttctggaagagctcgtgatttttttcaggggagggaagaaaactcattcaaatttaatgaaa

SEQ ID NO: 109898 - DNA, 1020 bp, Homo sapiens
tgtggtgtttggacggggcacgcaggcaggctggcgcgagtgtttttctaggaagttatgaactgtgtgctattttgctcctctctttcctttgactttgaaaatatctgattccttgggccaaagtgctgcggaggatgctggctgtgaagggtgtccttgtatcctgcccacttatgaaaaatttgatatgctacacacagtgtgaaaaacaaattggatggaattgctcaccgggggaaaagtttcctgtttaaaattgtgtatatgtcaaacaaaagaagttgacctttaagcattttgaattgcttagagctggagtgagtgaaattaatgtttttccaccttttgttgacttaacggtgtttttatttgaagaataaaagtgtttaggaagatggtacctccctgaaattgttactttattccactcacgttaggagaagttttctcccttctaaccccaccctttttccccagactcacacacttacccgtcctgaaatgagtttcatttgggggtgggggggtatgtctagaaaaaaatgattccgctatatgaaacagcctaagttttaaaagacctttggtagagatgcattgtaccacatgcaatggaattagtttttttaatccattacttttcatagacattttactcttttagaagttggagatgtcacaaatatctctgtaagtaaccagggagatatttgtgacattacagatgctatatctgtttagtcctcttttaaataaagagttgtgtgtgaagataagtatacctctgatcaatttattccaggaactatatatagtgttttaacagtgacctacaaaatgcttttggaaacaccatgtatgtcagatctttaattgccaataatttggaatacttaaacccagtttctctgcttcctgacactgtactgtcaaaaattaaattatctcttttttaaaaaccctactacaaatgccctggagtatatgagagaatcttgaaatcacccttttatttta

SEQ ID NO: 109899 - DNA, 1049 bp, Homo sapiens
cttacgcaggccttgcaagtttcaggtggtggaaagtggacatccagtcgccctgctcccacccagcaggctgagggcgtccggctgtgcggcgactcgagaaaatcggggcgcaccggaacagcggcctggggatggtggggataacacgggtgtggaggggacagcaccgaaagatgctgcagcctcgcagcggattagggttccggccgcattttcagagggtggagaaaactcgggggggaaccgaactcctggtcgacgagggggtgccagggagagatgttgggggtggggggattggaagcggttggtagcgccgggcgccgcacctcgtttttatgaatgtgggtgactttatgaatgaagcgggtttctttcgttggctcgctgctccctgcggcttttttttttttcttccctttttgtgaatgaagcattgagctttcttcctaaaacgctggggtgaggggcctgcgtcggaggctgggcgtgcgttggaaatgggggcgggggcgcagctgaaggagttttcatgaatggggaaggctgagaattgggtggaagtgtgtcttgttttgtgaatggggcccagcgctagagatccagttacagcctctacctgatgtggcggccgcggctcgctctcccattcataaaaccgggcccgctgcgcgccacaggggaggggcctggatcgcgccgctgcgctgtgctaaagttttcctgggggcgcccggggcgcgggtggtgggggggcaaaggaagtggtttaaactcctggatgaactcgagcctttccttcaggcttttaaaaaaattatacttggaatacaatttttctaaccctggaatgcctcttttccgttcgtttatggcagtttatttcttttaattttttagaattttttttgctcttccgggtgaagtatttcatcatgagactgaaaaatatctccccctcccgtcttctactggttgtccccttcctcctaacacattcacaaaatgtcttaggccatgatttaatctgacagattttcctaagc

SEQ ID NO: 109900 - DNA, 1035 bp, Homo sapiens
gaatgtggagaaaaaggaaagtgaaactaatgtattttgggtgcccactctgtgccagccactttcacattcaggtctgccatttaaatctcataaccccactttgaggtcaatattattatttcaaattttccattgaaatagcaatagatcaaagcagtcatgaaataacttgttgacattcttcttcactccaacttctgtatatattttgggcagttttcttgcctaaggcccaagttctcaaacttaagtacgcctcagaatcttccagagggcttgtcagaacacagactgctgggcccaaactccagactgtctgattgggtaggtctggggtgtggcctaagaatttgcatttctaacaagttcccaggtgatgctgaggctgccggtccaggaccagactttgagaaccactgaccaatgggaatgatccacccaataacttagcccagtggttcccaaactgtgctcattttttcatcatctggaaatctttaaaaacaaagaccgatgcctagctcctatgctcacacattctgatttaattggtatagggtgcaacctggcattgttgtttttaaaagctccccaggtcattctaacgctcagcaaagtttaggaaccactggcctagcctcatttctcctagactctaatcccaccctccaacatccacttcagctgcccaccactgggactacaggtggaatttgtgcatcggctagtgcttttcacagcacctctccccaaccctctctttcactgtctcagaacagctttttctagaactccttaagtctcttactcaccttctcccttttcattcagtccatctcctttcctattcaacccagaccctgtggcacagtaattactgcagccatctcctgcccacagccaatatcatcaatgcccttatcttccttgttctttctttgactatatctacctgggagggtttgaggaggagcatctaagtcaaactgcaggcacagaagtttgaagttcattttgaacttgtggaagttg

SEQ ID NO: 109901 - DNA, 1111 bp, Homo sapiens
tggcaagtgacagagccaagatttaaacccatgtctctctgccttcaagcccaggcaggcacgttctttccaagacactacattggctctcactttccaagtaggtgcattccaagagggagggaggacatcagcgtccagcagaccccaggcttctcccatctcctctacttgccctatctacatgggacccactgcggtaataggggaaggggacaacctagaaagcagagtgaggattgcctgctcttccaggaagaggtaaacgtttaccaagttaatagcaaacacacttagctggctatggatagagatggaggggacagggtacagttaaaactgtagtacggaagaaaggtgactttgtggaatactatttgtcaaggactgtgctggtgatgtacttttttaaaaaacaaacctggtgcggaggcaagatataataatattaatatccaacattgatgtgccaggcattgctctaagcactctataagatagagcagtagtgggagatctcaattattcaaacagctggaagtttaattttgctataagcctagcatcagcaaaaatcccgatttgcctcactgactcatctccagcgtaggatctggcatctgccttcctaggtttgcatcctggctctgccatcttgtagagtaggaagctgtggagccttgagcaagcatcttaacccctaagaggccctgtcagttgggggtagcaatgctgcctccctcatcatgttcatgtgaagatcgcaagagatactatgggtgaatcccagcacagtgccctagaaagctctcaccaagcatgagttgctaatattattcttattactgctcagaagggaaagggatgttttgaccaacagtgaataaattgagatgatgtagaagcaactacagccaagatggggaagtggctgcttcatctagagggtgataaggataaaagaaaatgtgggccaggcccggtggctcacccctgtgatcccagcacttccggaggtcaaggcaggtggatcacctgaggtcagttcaagacccggctggccaacatggtaaaaccccatctcaactaaaaatagaaaaaaaattagctg

SEQ ID NO: 109902 - DNA, 1350 bp, Homo sapiens
tttagtgattttatggtttgggtcacaacatttttttggaggttggtgtgggggtttctgaactgagatacgattacggagtgatcttgttctttctttggtctatcatcatcccagagtggctttgtctaatggtggtggtttaaggtattgtttatgttcaacaaaagaatacaatagcaagtccagatcctacaccaaggcctagctgacagtgctaggctagctcctggctgtcaggagctactcttctctttcttatcatgaacatgtgaaatacgctctcactttggaacctttgtacttttttggtctcttctgcctggtatattcctctccaaatactcattctgcttattccatcatttcatttagacctaagctcaaatattatcttagggaggccatctctctccattctttctctgaaataacatttccagaattgctattccttcaccctgctctatttttctccatggcacctagaactacttaactttatattatatttttattgtattgtattgtattgtactgtatttattttgagacagcatctcgctttgttgcccaggctggagtgcagtggtgtgatcttagcttactgcagcctccacctcctgggttcaagcgattttcctgcctcagcctcccgagtagctgggacttaacaaacatgtgctaccatgcctggctaatttttatattttttgtagagacagggtttcaccatgttagccaggctggtcttgaactcctggcctcaagcgatccacccgcgttggcctcccaaagtgctgggattacaggcgttagtcaccatgcccggcctatttattttatttttacctatctttcctactagaatatatagtcttcaggagcatggattacacagatcacaatgtgaatggtgccctctggagtcgtgaagtgtcatcctgcttcaacaggggccttgtctcttctctatacatttatccccatcagtcagaacagtacccagtgttcacttggtccttggtaaatatctgacaatgaaaaagtagaaagaggacattgtatctgatcaatcctttgtggggtgggggtgtccagtgtactctgaacagtgagaacaaaaggataacaagaaataattaatcatttaacattatcctattaaaatattgtataattgcttagagtacaatttatatgaattcatgttcttatattctttttactcataatcgcaattttagggatcaaaggaagcagttccaggtactggtagagaacaagttttatgaatggttgattaatacaggacatcgccaacagctggacagccttgtaccccctgca

SEQ ID NO: 109903 - DNA, 1023 bp, Homo sapiens
tccactttaattagttttaggaactcttggccaggcacaggggttcacgcctgtaatcccagcactttgggaagccaaggcgggcagatcacctgaggtcaggagttcaagaccagcctggccaacatggtgaaaccctatctctactaaaaatacaaaaaaattagttgggcgtggtggcacatgcttgtaatcccagctactcaggaggcagaggcaggagaatctcgcttgaaccaggaaggcggaggttgcagtgagctgagatcgcatcattgcactccagcctgggcgacaagagtgaaactctgtctcaaaaaaaaaagaaaaagaaactcttacatctgggtaccagagacatacatatcaaaactggcaatgtttctaagttggtttttttaggatcagccaacttgtgaatttactatgtctacttagttgttagactagtggttgatgttttaaaacgtctattcatcttttattttcttcttggacagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataaggtactccttatatcttgatctcattctctaaaagggacaatttgtgtgggagatggttcacttgcattaaaaattatgatgagatttcttacataagccagtgatttgatggcttgttttgtttttcactttttttttaaattataaaacaaaatcagtgtgtacagtcttaatcacaatagagaactggttgcagtgccttcactggtaggaaaaccacttgctgatttgtgggcagatcatcactatgttcaattagcactgccgttttcaacatgtcaatcaatgcgaatcaacttatgtgactaaggagcatcaagaagatggagtgcttgcaaaatcttttgaaatctactgaaaaaaatta

SEQ ID NO: 109904 - DNA, 1027 bp, Homo sapiens
tcttggttggtgaactagagctgccttttaagatgatgatgtagtacatatgacacagttgagagagaggggtcaccttccaagaaaaaatgcataaatgagacttgtttcaaatcagtttatgaagaaactttgtttcctaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcaggtacggattgatatgtgtgtatacttaattacttttggaaagaaaccattcttttttaaattaaaaaatgtttttgcttattacaatttttagatagaaacagagtttcactttgttgcccaggctggtcttgaactcccggcttcaagcagtcttcctgcctcggcctcccaaaatgttaggattacaggcatgagccaccatgtctggcccaataaaccattcttaatttttgtattagctgtaaaattttaggttttaggctaatggccattgtaatctcaagttatcatttgagttttagtagttccagtttggcagtatttcatgtattcaatgaattagtccttacttaccagaccttactcacctactcccaaagcagtaatgttacagagaccctgttattgaaaaagggaaatattttactgactttaaaaagattttggggtgaatgagtgttatgaacaactgatatgttacagtcagagcacctgactatttt

SEQ ID NO: 109905 - DNA, 1053 bp, Homo sapiens
gcctttgctggggggtgggagggggtgggggaagtggcattgccagactgacggagtggagaggggcatcgctgtgggttggcggggtggcggaggaaggggtagtatgggccaggctagtggggtgagaggagaaccgtgggtgacaccagtgagagggccttaggtccagagagggtcttaggtagagctagatttgcccagaggagtgggagttggatgcattgccaaacggcatttgggggatgagggaaagaaggtggttgcgagctgaagcagtgtcacgtagagctggggaagaaagagggatgcctgactgtaaggaaagatagtgacagtgccaggctgaggttgaggggatggacgtttgtttgatcaaagaggtgagttgctgtgccccgctgaggtggagaagcggacgatgctctatgccaagccttcgaagagccattctggggctgacattaaagtgggtggatgatgccagcccgagttgggactgaacgaaattggatgcgggatgggaacaagaagatctttagacagcccttgtacttcccagcttcttgagctatttattatcttaagttgcttcatctttaacattctggcagtgctactgttaggacatttatgtggcataatctttttaaagaaggaaaatcatcctttgagagtgttatttgacttttagaaaagtcaaaatcatttggagccagtatagggaaaggggggaagagttaatttgattatatggttattgcctaaagataacatgagaccataaaataaggaagtggttttcttgaccgaaggtggttctgaaagaaaagtgccacagatgttttgaataatccgaaaagaagtatatagcctcttactgtgattacttcaatatataagattcattacaaattctggtgttctctctttagtcattctttgtgtgtgtatgtgtcacataaaccttcatttttatacctctttgctcagatacaaacctaaatgtagaggaaaaataaatcttttactttgaaaaatgtaacatgtaac

SEQ ID NO: 109906 - DNA, 1308 bp, Homo sapiens
aaaacttcaagaattatttcaagcaatgaaattgaccttgaataaccttcatagagtatttttacttactactctttctgcatttcaaactcaggacattacaaacttaaacatatatatatatggcaggcaaaattcttccacaaatggatttctgcatataccaaaaaatgaaaaaaggaggatgaaaagatatcagtgtaggcctctctggagggcctgtcatttgatttccttgacttgacaatctcctaatacatgcgcgcgcgcgcgcgtgtgtgtgtgtgtgtgtgtgtgtctgtgtgtgtgtgttttgggtagggggtgttatagacctgtggggccaagttgttctgaaggcagtatagtggttaacagcataagcaccaaagtcaaactgcatgggaagtaaacctgaggaatccgtcttaactctttcctgtcaccaccctgaccttcacagctgcattgctaatctcaggtattattttttagtgactacacgagttttgagaactttaaattaaaaacatgaatggagcaatgtggaatgaacagtgcatcaaagaatttagtcttagagaaaataactttgtaaatatgccttaatacagtacataatggaaactgcattctattaaaattttagacccactgtcaaagtaaaaacaaacataaatatgactgtgccttaactggatattaccaactcatgatcttttcctccactggcttttatccccaggttctgtcagatagtgagaaacggaaacagtacgatacttatggtgaagaaggattaaaagatggtcatcagagctcccatggagacattttttcacagtgagtaatttacccatctgcaaagtgttagtgtctgagagagggtcacttagcgattaaagaattattctcattccctagttcagaaacttttgatgaacagtacaatttagctgatccaaagatcaattattgtcctccctgtgggaagatagtcttctattttcacaaagcttcaggaaagactgatggcactgaaaggacattccatctagccaaccatatcagttaaatcagtgcagacaattcacggggacatgtgttggaaatcagttcatccttgcctacttgctaccttgcaatctgcaaaccacttaatgagcaaaattattgttagcagagatagaaaaattcctgctcccatacccagagctgcctctctttcgtgctatcaacaagtgagggtgattataataaccagcattaggggaaggaattagggtagaggacctttatctcttgctt

SEQ ID NO: 109907 - DNA, 1041 bp, Homo sapiens
gttcacatagtaaacgcatatataatttccaacactcttcggccaattttaggatatacaaagccttttgtttacctgaagcagtagcattaccgtttatcctttgaatgtcatggccaaaagttattatgaggtagcctaagtttcatcaaaatttagggtgttcagaccttaatgagttttaattcagcaatgaaagaagatatgtaactctagttggcattaataagatgctctcaggacctcacctttagacttaagtttaaaactctaaaaataaaaaaagctttaagacttaggttcaggagaccagtgtatcattctttgtttaggaaatgggtcaagttatgtactgctgtatctgaggcaaaggtgatgatttctaataatctgaaacttgatacaaccaggcagagacactgccgtcacagatttgacaggtcaatgcccaaagtagtggattaaaaaaatgtatcagttgccaaatagatttgtggtattcaacttgtatgatttacaatatgctgtaatctgctctgactaggtgagcctcacgtggatggggagcctggagatttacggttccgaatcaaagttgtcaagtaagtaatctaattttagaggtcttctcagatgagtcaaattatagagacgtaggtggccaccagagcagttagacttttttctctgtttcttacccttattaccctaaacgatgatttgtaactcctctacaaggctgaaaacttggggttgggccctaggattgagccccagttatttatttacttaggacttaaaaatgcaaaagatgttgaaaggaaataattgataagtaaggagttataaaagagaaacaaacaagatagggagtcaaagctgagattttagctgaagaagtatggcaccatacaagaataggagacttttccatagacagaaccttctacataatatgcagcttctgtaaagagagcttttcttttgtgagcttctcttcagcatgaagtgctgcttagacagttttgcctgggactccag

SEQ ID NO: 109908 - DNA, 2098 bp, Homo sapiens
taaacaaaccaatttactcgttctgcatccttttgaagcctttatgtgggtagttttgagatgtatcagctgtttcagtcattgagaaccagatggactcctttcttggtcgtattctgccgtctgtacttactctgctgctgagcatactgcaataacagtgccagacctttcagctactcagaatggattgcacggcctttgacaatcttgtccttatagtttctattgacgaaaacctttctttgtttacttgtttttgtgtttgatttttcttctttaaaatcctttgttcttgactcacattgtcttaatggtatttcctttgctccttcattctttctttttgctgagctgtgacattagctttgtgtaccagtgctcactagaagctgtgtgatgtacttcagatgtaccgctcctgctgcagtacattccctttggttttctaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatggcatattagtgtgtgtgtgtgtgtgtgtttgtgtgtgtgtatgtgtgtgtgtgtgagatgagaaaaggatggcaatagaagaactctccagtgacatgagacatcaatcattaatgctagtagaacactaaggaatgaactcatctttctctgtaaaggcgatatattaaaaatcctgcatctttgtgttacaaaagtctatgtaagctgtgcttcaaaacctagggagtgatagagtatatgggagtgaaacagaatcacttaaaacaaatgaactggaccacactgtaaaagggaagatgaggtagactgtagaaagattagaagcttatgggtgcatgtctaggatgactggttgagaagagggccccactgggggtcctaaatagtaagagaaaggagagcaatgaaggaggtaaaaactgaaaagaggatacagaagaaggaatggaagactgagctgaagagttttctttcccttttgattgcctcttctcattcctcatttcatagagctttgtgggacatgtatgtggtatgtgggcctaaaagacaagggatcatcctggacacacatgtgcatgtgtggggttacctacatgcaattacgttggagattggtagttatttaattcacatccatgtttgtcataaggccttttatgagctttttcttgaaatatgctctttaaacgctaggaaagtaacatttttttgttaatggagtcatttgttcattctttcttcaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatgactcctgtttcttctgtgagctatttgggttgtcctcccatcaagcaagatggatgcacacgcatgcaaaagagtgatatagatccagtccccatgcccaattacacatacggcatctgctagaaaggagcttggaagaaactgaatggttgattggggtccatgaatgaaggttacacaaagatctaattgtccttgaagtatattttctctcatttaatttgggaataataatctgatatggacactttactgtttagaaagcacctttcatgt

SEQ ID NO: 109909 - DNA, 1082 bp, Homo sapiens
tctcttgggtcctagtttttccagcaagttacactttctgtctgtgatctgcacactaccatttgaagcactttttctcctgcacaccacctcacaccccacccagctccctcctgacacccatgactgccatacagaatgtctcctctcctgccctctgcctgccccttccctcactcctgggaagaaatcagagaatttactcctctgtggtttcatttgcactgggtgatggtgattttttgaggcacctgattgagctccatgtacacattatttcagctcatagacagcaggtccacttacctgaggccacacctttacttcatcaatctggttcaaggtgtgtttgtatccccaaggaaggttttgattgatgtagtctatagccaccagagctgcttcctcagtttctggatcatcgcagttcggttgtctataaatcagccctgggccatgtggggctgagtggcagccccagagctgagcaagacaaaggagcaggacgagggacttcatggctgccccagagaggccctggcaggcgtgcaggtggttggaggcttcgggaccaacccaggtgctctgctgggaaaggtagacccatggagggtggtgggctttatttatctgttggagcctgccggaagaattgcataaggatacaggatgatttctgctttggttcaaaagaaaaaaaaaaacaccctgcaaacatcagccctggaaaagcaaacaggttaggacatcgctggtccccaagaaatctgccaaagtccatgctgctgtgggggagatgctccaaagtctgcttggaacatggtaatagcagcaaagagaagacagctgagggaatgaggtggacacagtcagcctcagagtgccatgggtttggcagcagaggaaatgtcttctactgtgatctgagcatgccatggggtctgtgagagggaagggaggatactcagcaatttgataaaattctccaatgtcagggggagttagctttccaagaggagtcctacagggagaacaaggcccacagatatagcaaaggtacagatgtgtataggagatgccaa

SEQ ID NO: 109910 - DNA, 1196 bp, Homo sapiens
ttcttccttcctcctccttctccatcttgtccttttccttctccttctcccaatggcaagtagattatattggccttgggctgggacactcggggggaacccacacccatggtgtgtgtgtgggggcaggacgaaattgaagctatctgatggtcacttgcagcatgacaggttctggctgtgttggatgacgagttgctgagggcctggttggttggtagctgcaaaacctagacgttcctgctggctgcatcttcgcggggagctgggattaggcaaggagtctagggcctggatgcagaacctgggcatgcatgggggtcagggaggatggaccagggaaacctgtgtgctggttagcatggtctatctgcggtttcaaagacagagcagcaccagaagaggaaccctgtctgggtgtgctgaaagtggcccagcagaacataaggttgtggctgggacatgaatgcaccccagggagcactgaactgctctgagctgccgactagggccataggctagctatgtgggcccatattgaggtaggggctgagcagtcccagcggcaccgcccaggctgcctgctctggggtccctgcaaaagccgccgctgagcccacggacttccgggtcgtaagcacgtggggcctgaacatctgcttggctgggtcagctgctatgacaatgcccgggcgatcgtgccctccagcgctgcctgcatgccgaggaggaagcgagtccccacgtgaataatcgggctccgccggctcacagcggatgtcagaaggtcaggtcgctctgctcctttcgcctccgtttttcttcctcatggaaactttcttcagctgcagaaaaagctggtccttttctttctgcctggcccacagcttctcctgcaaagtcaaaatttgttccttcggtctcctctggtgacattctctcttccatctcctttctcttccttcgtctgctcttcctccatcttctcgccatcaccttatccgccgcctcctcttccctctcgccccgcagcctgcgctcccgccgggggcgctccggacacactgtctgcgcgaccccccacgggacccggcccccaggccagctctgcccgccgcccacaagggctgggggcacccgccgccagcccagctggcagctatggctcctccgagcgcacaggaaaacctcggctt

SEQ ID NO: 109911 - DNA, 7602 bp, Homo sapiens
cttcattgtggaattaaacagcggtgggagcaagcggaataaccgagttcccctcccgcacctgagtgccggcagcgagccgcgagccgggacctgtcacccgcgggaagccccggccgcccgacgaacagcatctccggtttccgcctccggctccggcgcggctcccccggcccgcctctgcgtcagggacgcggaaaccccgtaggagcagggcgggcggggaaagcgaggtttaactaactccgcagctatattcttccgccgcgaggtaaagagtcccaacccaaccccgggccctaggatttccagcgaccctgtaatatcgagaaattaccacatttgggtttttctaccaacttgcttaggattttatccgaggtaacgaccccaggatcacaattttgtagctgaccgaagcacggcgagaaaattcctccgcaagaaacgggttccggccacgagcctataaaaaacgggtggttgggcgccgctgtcttttcagtcgggcgctgagtggtttttcggatcatgtctggtggctccgcggattataacaggtatgcagtctgttggcggtcgcggtctgtagtgaaggtcatagggcgccaggggagatgatagtggatggcacggaggcaaaaactctaaattaatggacgttttcttagggtacagcactcctgtgcccttccagaagcttccatgatgggtagggcccggattgtggggagataggacggtggtgcgaaagcagtggctaaagggcgtttttcctctctaagacattacgaaacttcggctgctttccttcccagtgtagagcacgggaaacatggagtaaaaagccgtggcgcagtccgagttcggtacactgtaaccaggacccgaagctttattttcggtcatccacacgagttgggggagggtcctaggctttacttggggaagggttggaggcagcggtctccactcggccacggcgcggaggcgacgggacaggaccggtgccggtgaaccgttggcatcgccctcgccaggccgctccgcccgcgtcaatcacccggcttgcgcattgttgggggcggagttcggcgctccgagctctcgcgagacgctccgcagttgaaacgggatcgccatgcgctcgggcctggggggctgcctttccgggcatccgcaggccccaacctttagggaaggcgcacagtgtggatattcgccctgaggctgctgctttagcttgtgcaggggaggctaacgtgctgagacgggttgcaaagggctatgcgcttaaggtgcagttgaggtggcctggaaggggtgtctgactgcagtattcttgtcagcagagaacatggcggcccagagggaatggaccccgatggtgtcatcgaggtaagaaacggttgtggatcttgaagctttggaaaggtgagtgtgttcatctcatttatgcgtgcattattttttctaacttacagagcaactggaatgagattgttgataactttgatgatatgaatttaaaggagtctctccttcgtggcatctatgcttacggttttgagaagccttccgctattcagcagagagctattattccctgtattaaaggtaaaagaaactggcatttttaggaaattgttctacatagacatgaaccataaaagggaaagtaacctctgggggactagcacctgtttgtattccttaaagtgaaatgatggcaatcatctttcgggactgacctgaaatgaagagaatactcattgctgatcacttgattatttgggcataatgttccaaatggaatacatggtgtgaagtagaagtgacaatttgatgtgggatcggtaaatgtgtatcctactttttttagggtatgatgtgattgctcaagctcagtcaggtactggcaagacagccacatttgctatttccatcctgcaacagttggagattgagttcaaggagacccaagcactagtattggcccccaccagagaactggctcaacaggtattgatagtgtagttcaaaaaaactgcttgcgtgttgcataggtttcaggtttcacaactgtgaagaatttaaaacttagtataaattggtcctaccagatccctccttttaattgtccatgcatgcagggagtttttgttgaaagttttaaaagaactgggtatgcaggtatggtttgtagggttgtatactaatagattgagaatccgaagcgctctcttggatgtactagatctgtccccattttttaagtttgaatgcagttgtgcaacatgaaaactgcagtgacatgttaccatttgactgtctccgtagttcgtgatgcatctgttgcatgctatgttttcaaagctcactgctatattggctttgaagtaaaccttcctaataaagctgtaggctttattgaggtcaggattatataaggcacaataccctctgggggaaaaaaatcatttgccctagctgtaattacagaacataaatttcactacgtactccctacctacagtgaagaataatgtaggaaacgttattcttggattgtctagctgatgcgtggagcagcagcatcccaagtttgacaaggcataagaaagacattaagggaattttaccttgcagcagttaggtcgtctgcattttaagcttggaagtagttttgtgctgtgcatgcataaaagctgttggcagaccagattatatttgcctttatgctttaaaaattagtcattgatcctggagttctgcggaataataattaaggcttgggttttagatccaaaaggtaattctggcacttggagactatatgggagccacttgtcatgcctgcattggtggaacaaatgttcgaaatgaaatgcaaaaactgcaggctgaagcaccacatattgttgttggtacacccgggagagtgtttgatatgttaaacagaagatacctttgtaagtattgtctttaagagagtattttttttaaaactgttaacatagttgaaaagtcaaattgtatcactgagtagatctagaaatgacagtatgactttgtttctaacagctccaaaatggatcaaaatgtttgttttggatgaagcagatgaaatgttgagccgtggttttaaggatcaaatctatgagattttccaaaaactaaacacaagtattcaggtaagcattacttcacccccctcttaaaggtagagatggggtttatttaatgcaggtactgttacaatacaactgatgtgttttgttgtcgttccccctgcttaaagcacttgatgcataactctgtctaccttcattccgtagtaagacagagacgcttggcttcagacattttcctttgggtattaatgtgtaagttgtgctacaacataattttctctttttaaggttgtgttgctttctgccacaatgccaactgatgtgttggaagtgaccaaaaaattcatgagagatccaattcgaattctggtgaaaaaggaagaattgacccttgaaggaatcaaacagttttatattaatgttgagagagaggtaactgtctgattgttagacattattttaccttcttgtataagcactgtgctaaaattgcagacactaggaccatgtcttggtttttgcaataatgctagcagagtacacacaagaagaaaagtaacagcactagattgtaaagactggggtggacctctttcttaatgtccaatgtcctttgtcttaagatttggtgcaatatctcattagacctaacagaatgaagttaatttttataatttctacgttttgagactgggttatgagactggctaagactggccaattttggtattttgggtagagacagtttcactttcttgaaaccctggtctggttggaactctgggctctaagtgctaggatcccaaagggctgggattacaggcattagcactgtggctggcccagaatgaatttttaactgaagagttggaaaaactaaatgactgttaactttaacttctaaacattacaggaatggaagttggatacactttgtgacttgtacgagacactgaccattacacaggctgttatttttctcaatacgaggcgcaaggtggactggctgactgagaagatgcatgccagagacttcacagtttctgctctggtaagaggtgttctaaaatgtctggatttccactaaagcaggattcagactacaatatagctgctaagtgctgtgttgtcgttccccctgcttaaaataaagttgtttcttaactatacctgtctgctattctcctgtagcagccagggacgcttggtctcatacatgttgattaaaattaaataccgacctgactggtgattcttgaattaaggtttattaatttgcagcatggtgacatggaccagaaggagagagatgttatcatgagggaattccggtcagggtcaagtcgtgttctgatcactactgacttgttggtaagtctcttaatgctttttaaaaatctaccaaaagttagctttttggggggcaggtttttaagtaacctttgccaacttgggctatttggaagagtaaaagaccacactccacagtgggctataccacttagtatagttcgctactattttgtggcctacatgacaggtgtcaagtttttttgaatcaatttttaaaacatgccattgtgtttcaggctcgcgggattgatgtgcaacaagtgtctttggttataaattatgatctacctaccaatcgtgaaaactatattcacaggtgagaagccagcatcttggctgtattgaaaaaaattcatacgtttttctactgtgatttgtatgaaaggtaacatcaaatcaaggaatagattcagtaaagtcagtagtgttcagtaagatgatgtaattaaatttgtactagggaaggttgatgagaacaaagtgggaaaacttgtaaacattgcccagattgtggacatagggtttttttccacaattgttggtcttaccttatgcttgagcttttagtgatgttcttgtgtccatgtgtttttcttggtgattttttctatagttgggattttcttggtgtcgcctggtagcaatttgagtgaaccctggtttagttatagtggctttatccctaaataaattgaattgtactttgttatatgatgtaaaaaaagactttttaaaaaatacaggagtcgatagcagcagttggtgacgagatggcactcagaaacggcgttgacgtaatttaggacgtggaatcataagcgaaacagcacactgtttgaataaagagcgagtcggtatttatatttgtttttcttttgtcatgattatttgatttttaagttgctccagctaaggcatttttttgtattagtatttctattagggaacctttcttattaggtggtttgtattgtctggtttctaacatgcaggtagctgtttggcagttaaacacgtttagagtaatttgagttacaacgtgtgaaactgagcaaaaaagcagtgataagtttgggttaccataccaaatatttgttttcccactggaaaaaagtaagttttagaaaatagttaacctttgcagcatttgtttacagtttacagttccagaagtgcgtcgaaatggattacataactgctcttttattcctggtgttcacatctgtcccaggctgacacctgctcttggctggcccactttggtatgggctttaatttcactaccccaaacacgatactgtcatctgctttataataatgctcaagatgcctgataaaaatctcattttgcagccagacaagccttgaatccttttggcactaactgcaaaggaagatttttttctctagatatgcattagcagctagtgctccagttagaagcacgaactataaccttgataagtaaacagcagctggtggttaacaagtggatcgtcatgttcagtagtttatacattatgtgagaagtaacgttctgattctttttcttacacagaattggcagagggggtcgatttgggaggaaaggtgtggctataaactttgttactgaagaagacaagaggattcttcgtgacattgagactttctacaatactacagtggaggagatgcccatgaatgtggctgaccttatttaattcctgggatgagagttttggatgcagtgctcgctgttgctgaataggcgatcacaacgtgcattgtgcttctttctttgggaatatttgaatcttgtctcaatgctcataacggatcagaaatacagattttgatagcaaagcgacgttagtcgtgagctcttgtgaggaaagtcattggctttatcctctttagagttagactgttggggtgggtataaaagatggggtctgtaaaatctttctttcttagaaatttatttcctagttctgtagaaatggttgtattagatgttctctatcatttaataatatacttgtggactaaaagatataagtgctgtataaaatcagccaattatgttaaactagcatatctgcctttattgtgtttgtcattagcctgagtagaaaggcctttaaaatttttttagaaagcatttgaatgcattttgtttggtattgtatttattcaataaagtatttaattagtgctaagtgtgaactggaccctgttgctaagccccagcaagcaatcctaggtagggtttaatccccagtaaaattgccatattgcacatgtcttaatgaagtttgaatgttaaataaattgtatattcactttaaaggtgcttttggtcattttatttttattacaacttcattatttacaaaaccccccatccagatatattcacgttaacaattctgagataactgctgcatcacagttgcacaaaggctgatgagttgcaaatgttcatcagcaccatctgctaggcatttgtcaacttcctacgagaaaaatttaagaaattagcatccttcaggtagttaaatgttccattgacatgtgcaaagtacctacttacggcaagtttttctgtgataatagacttctgtttatcagataagttattttctacaaccacatcatggagttgattgacgagctgagttgctgcatgaccctcatctattaaatcctataataaaaaaaacttttggtatgatgacttaatattcctttccccaaagttagtaagctgactttaccttgaccacagcttctagtttgtcaaaagagccactctgacaggcagcaaatactccatcaattttctcagctggtattacctaggtaattgaatgttcggtattaaagatgtttctaggtgagactagacatacactctgccaactggcccccgtgcccccagtcatttctgttccacacctaagttccatactttcctgggaaggctttgggagaacggaaagggccagagtaactccagtcaccactaagcaaccaaggtgctaacaactgtgcttttaaagccctttaatggctttgtgaacttccaagtttgggcacacatggattatagcttgttctggtcagtggatga

SEQ ID NO: 109912 - DNA, 1043 bp, Homo sapiens
gccatcctcatttcagtggacaacaatttcatctttccatcttttagggcttaaactctggagtcattctaaattctctttctctcatgctgcacccactctgttagcaaaccatgtcagctgtgctttcacaataaattaagaaacaactacttaattcatcaaattcatgttggtccaggacagaagacctgttctttctcttagaatcgtttcacaactgagcctcctgcttgtagtcttgctcctgtggtatgttctcaaaacagtaaccagagtgatcattttaaaagctgtagtgatgtgtcattcttccgctcaaaaaccaggaaaggcttcctcttttactcagagcttagaaaggcctacaggattctgtgtgacccagccttcagaccctgcagacttcatctcctgctcttttccaccgcttcattctgcttcacctcactgagcctactcctcagatataaagcacactttggtctcagagcctttccactgcttcctccaggcaggacaccttccttcatgtatcctattgttttcgtctcttcttcaggtttctatttagatgtcaccttgtcaaacaggccatttgacagccttatataagattataatctcctgcctgtctcctcccaccgacttggctctctcccttttatccttccttgttgctgttcaatagcgtaggtggccatctgagttactaccctgtgtcttttctcactaggaacttgcttccatgagggcaaggatgttatctcttttgctcacagctatttctttaggacccagagcaatgcctcaggtatcataggcataatccacatttgttggctgaatttaacaaaatcctcacaatgacatttcaaaattagttggaataacccaaaatttatacatgaagaaactgagacacagagaggttttttttttttttttaattttattttattttaagttccaggatacatgtgtaggatgtgcaggtttgttacataggtaaacatgtgccatggtggtttgctgcccctatc

SEQ ID NO: 109913 - DNA, 1048 bp, Homo sapiens
ttccttgttcttcagcccagttcaccagttataggaaatctttagtcattgtcctgggtagcccatgaaaagtgatattttatagagctgtgtatttttccagggaggattgtttttgttcacagatgagcaaacatcctgtaagtgctgatttttcactgtgctttccaccctgttcctccctggtgccagcgtgccaacatctctacttactggcagcctagttgaagaaacctctagagttggcccaggaggactgttttctcagtgtttagagatcatacagtgccaagggcagctgccatggcctcaagccttccctagctcagcatcttctactctttcctcttacagatggagaggcaacttcaatgcactggggaaagaaacgaacaatgacagtgaatgatgatattgcacttcttatggaccaggctctaagtgttttatgtatattaattcacttaatccccatgacaaccctaagaattgggtacaatttataactccattttataaatgaggaaacaggcatagagaggtctcatagctagtaagttggaatttgaacctggggagtaggacacccaggtctgtcctcttagtcattatgctatgctacctgctactttcttactttctttttttttttttgagacagggtctcactctgacacccaggctggagtgcgcctgggagggatgtcatctcactgcaacctccacctcccgggttcaagtgattctcatgtctcagcctcccaagtagctgggactacaggcacgggccaccacacccagctaattttttgtgtttttagtagagacagggttttgccatgttgaccaggctggtctcaaactcctgacctcctgtgatctgcccgccccggcctcccaaagtgttgggattacaggcgtgagccaccatgcccggccactgcttgttactatgtgtacattacctgcactagggtggatagaacctcatgtggcacacacatgacgccacataacacggctcatgtgttcacagtgcccagcacag

SEQ ID NO: 109914 - DNA, 1081 bp, Homo sapiens
agaggtctttggagacctgcattggccatgggctccccagttgtgagtgggctcaggctctggatcaccgctgggaagatacccttctatttatttattcattatttttatttttgagatggagttttgctcttgttgtccaggctggagtgcaatggtacaatctcagctcactgcaacctccgcctcctgggttcaagtgattctcccacctcagcctcctgagtagctgggattgcaggcgcccgccatcatgcccagctaatttttatatttttagtagagacagggtttcaccatgttagtcaggctggtcttgaactcctgacctcacgtgatctgcccgtcttggccttccaaactgctgggattacaggcgtgagccactgcgcccggccctcttctgttttctgagtctcctgtgcactcagggctggctcacatatactgcaggaagaggcaggaggaggatgacacaggggactggaccttggaggatagcacatgattgcactggccctcagattttcaaccccctgcctgtgcagcagtaaccttgactgcattgtagagactcccatccacttcatctcacccttgcccatcaggggtgtctgggaaagagaggtttctagcctgacagatctgagttccaattgcaatgcctcagttgcctcacctgtagacagagcaataataatagctggtttgtagattgttgtgagggcaaagtggagaagtgtcttagggagtgttggctccctctcctaactctttgcctctcctcctctcctggaggccctcttcatgaacacccagctgtagggcagtgctgcactgaaagaaaacgggacatgtgccttacccaagttcagtcagcgaagagtgtccattcactcattcagcattcaatcgactttttaaatgaacacctactgtgtgcttgcctctgtgctgggcactgtgaacacatgagccatggcgcttgacctcctgtagcatgtgagctaaagagagagagacaaatgctaattaaatagtaacacaatcaaatgtgaaaccgtgaattgtgggggttgct

SEQ ID NO: 109915 - DNA, 1787 bp, Homo sapiens
agtccaagacaaactttccttccttaatacatagtgctcgggggcatccttctggctgtagcatctgcgtaatagctgctcctaagaatgcaacgtgagctgaattcaaacatgaatttggagccagtacctgaatatgtgggttgttctatgccaccgggccccctgcctgtttaatttctccttcccctgctgccaaggcttccgagaagttgctgtgtaggtgcttaatgcttcggagatggtcaggtatgagtttaaatcctggtctcgggcactttaattgctaattgtgtagcactgagcaaaaataatagggatgcagcttttatagcaccaatcaggtcagtgatgttggtgatactgttgagagcttactatgtgccaggcattatgctaagtggttgatgaccattatctcatttattcctccgtataccctacaggcagatgctgtcatcattctgaaattccagatacgtaactgaggttcagagaggttaagtaagttgcctgaagccataaaacaaacgatgatggaatcagatcatggatcctgatatgtcacaccttaaccattgtgccattggtctacaatttgcctgatcctaagaatcacctgagactcttgttaaaagagcaattcccaggccctgtctcagattcagattcagcccagctggggtggagcctggggagcagtggatgcagcgggcaccctggatgatactaggatctggcaagtttaagaaacgctatattgtgccttcctgcctgtaagttgtggctcatggttggccctcaagaaatgttagctgttagtattataatataaatgaattgaaaggacagcttattgtgaaagaatatacgtctttaaaaagcttattagtcctgacactagattttaaagatagaggtcggatgggcgcggtggctcacgcctgtaatcccaggacttttggaagccaaggcaggtggatcacgagatcaagagatcgagaccatcctggccaacatggtgaaacccattctctactaaaattacaaaaaaaaaaaaaaaaaaaaaattagccaggcaaggtggcaagtgcctgtagtcccagctattagggaggctgaggcaggaaaatcacttgaacctgggaggtggaggttgcagtgaggatcaccccactgcacaccagcctgggtgacagagactccatctcaaaaaaaaaaaaaaaaagatagaagtcaaggggaaatagattctggatcaatgaatctatactctaatactctaaactcaaaactatctgcaagtgggatgtgtgcctttataggtccctgtcactagtggtcaagcaatcagtgccatcacgtgttgggtgtgatggctgagctgttcttcagggacccattcctcagtcagtgtctgctgtatacatgcagctgcagaggacatttgtgcactgaggagggctttgggtgtgttaatattctagaagaggtggagtagagcagctatgcaaagcaaggaagaaggcaggaggtgttaaaagaaaaactttagagaaaataaatgtagcaaagttcatctgagcaaagaaccatgtgtgaattggacagcactcagaaccagaagaggttcagagagctctgctgccgcagtgaggacagtgagcttttgtaggctgaacgtggaaagaaggctaagaaaatatattttattagagtgggaagaccctagttagaggttagttggtggtttctgattggtgaagcctctagttacattttactgt

SEQ ID NO: 109916 - DNA, 1030 bp, Homo sapiens
tttctcatttaattctcctaacaactctatgatagcagtcacgctatgatacaggtcacactggtattgtttcacaaatgaataaacgggcctagaaaattcaactagatttccctaggttagcagtggagttggacttcaaacctaggtctgtgtagctcacaaatgaacacttattatgcttataccattttgcctcattagaataataggaagtccttccttttttggtgaggaagaaatttagagattggttaccctgactggtgatacagagcaaagctatgtacaaattgcatcaaagggtggcagatccctacattcccatctaacatcacatcattcctaacctttttccatgtggataagcatgaccttagtcaagtcatttcttagtaagatagattgttggttgctcgtgactctcagtgaagacccagtaatgccaagaatcatggcagacagttagggggaatatgtatcttcaactatggggcagtatggcaaagatattgagggccaggaatttgactacttttgaggagcgatgacaactgagtacaggaagtgagaggaagggagcatgtaccgtgtatcatttaatcaaccttgagcttgagaccaaagggaacataccctaagtttaactaggatgggtttatccagatataatggcatcacatcgtaaattgaaaagtgtctgtgtgtaattctctctgtcttatttcttcgagaaggagtttcgctcttgttgcccaggctgcagtgcaatggtgtgatctcggctcactgcaatctccgctacccgggttcaagtgtttctcctgcttcagcctcccaagtagctgggattacagtcgcccgccaccatgcccagctaatttttttatttttagtagagacggggtttcaccattttggccaggctggtcttgaactcctgacctcaggtgatccagccacctcgtcctcccgaagtgctgggattacaggcatgagccaccgcgcccagccccaattctctcttttt

SEQ ID NO: 109917 - DNA, 1027 bp, Homo sapiens
ccaggcttctaccctttgtgcttggtggtagctaactgacttttttctttttctcatgtggtcaggatttttccactgaagcatttcttttatgatgtgggagagacagatagcacctggctagttgccttcttttggacttgctgtgatttgacttttcagccaggccaggtatttattttcccttgggtggagtgtggttctcccagagatgcctcattcatgattcatttgttcagggcatacaaaaggcatttcttaggacctaacctgggcctagcggtgtggtaggtgcctgggcttcagagaaggctaggatggttgctaattctctgaaaggtcatgccctaatagaggaaacggacatagaaactgtgaggggcgctgtcttggggtctgtacagggtgctgtgggagcacagggaagggttcctaactcacactggggatcagggaggctttggctcctgatactaaatgacctcttatttgatacactttttatgtcagacttgctggttctttccacacattgagtcaaagggtgtctctggttcctccctggatggactgatacaggccatttcactcactctcccaagggtttatctcctctggcctctccgagtctcacctggaggtgtgtgttcctgtggcgtgggttccttgggagcgtgggtgattcaccggctggcctcatcccatactgatcctctggggtgatccctattcaccttgtctcctttgctgtcataactccactgctgggggcagaggtggagatgttgagcttgtgggcaggaataagttccactgagccacagagcttgactctgctcaccttcccacaatagaactcagagttggaatcctttccccagccacctcccctcccatctgaggacagagggtaacctgcccgtcatctctggggttatctccaattttcagtctccctcatctccagctgacctcccatatggccaaatcgatcctgaggttgggaatccagttcttcaaactgagc

SEQ ID NO: 109918 - DNA, 1016 bp, Homo sapiens
gatgagttcaggatttgtttcaaaatctagggatgtaggcgtaagtggggtatacacaaaacaggactgaccatgagttgataatactgaaactggtcatgggtctgtggggttcattatctgtcatccatgtttctttttctttttctttttttttttttttttttttttgagacggagtcttcgctgtttcgcccaggctggagtgcagtggcgcgatctcggctcagtgcaagctccacctcccgggttcatgccattctcttgcctcagcctccccggtagctgggactacaggtgcccgccaccatgcccggctaacttttgtattttttagtagagatggggtttcaccgtgttagccaggatggtctcgatctcctgacctcgtgatctgcccgcctcggcctcccaaagtgctgggattacaggcatgagccacggcgcccggcatctgtcatccatctttctaatgatctatttgagacaaaagtttcatgaagctctactttctcttattacatgcagtggattctgatattttaaaatcttgtttattctctttttaaaaacctggtccttgtgcccaaattgcttttgagatccactgatgtaaaataatacgtattttgaaaaacactggtgtatcgagggagagagggacctataaaataattgattactgtcaaccagaaagtgctactagaatatggtcagagggctgtgggagcacacagaagggaaggaccgaccaacagggtcctggggagtctgggaaagcccttcagtaacttgcatggaagaggagacataggcatctttgacaagatggtggggggatatctgaccttgaggatgagggaagtggtgcaagtggggtgagccaacctgagttcagtatggctgcaatgtgagggctgttggggagtggcaggaaatgaggttacagatagcagcagcagcaaaagtcactagtcttctgggacagcctaaggaatttatattttatctgtgtt

SEQ ID NO: 109919 - DNA, 1102 bp, Homo sapiens
ttttttactgaagaaatcagtgcaatcatgaactgtgaagtaatagacatttatagagaaaatgcctggggtgcaatggtcattctgaaaatggtagcttttgttgtccttgggaagctgaggctcaggatgtgaaacaacctcctgctctttttcagaggcggcaaggagctcagagctgggttccttcacacagggaaggccccttgcaggaactgctgctggtatctgcgtcattaattctttaccttttattcttccaggctcctgtaaccatttatccttttaacttttttacctattttatttctgtaaaattttatttctgtatcttccatgccctgctgggcatgaaggcagctatcacaggccaggaaattcatgttagggaattgggtcatcttagggaactaattcaaattgctaatggtatttatttgattcagtggaaatgcaccttgcagtacttgattcggaggactgggttgaatttcgggagggtttgtttgacattgtctcatcttactctctggagcaggattcagacctggaacgctctctttccagggcaacctagccaagctatggtctctgcctcaatttattgccctttccccaggactcacatcttcctccccactcactgtttgcccaggctccggtcatctatgttagtcgtgctcttgctacacatctgccacctctttcagaaggttgagagcagccaaaacagaaacgggaactgtggctctcaataaactgtctgctcgcagaccaagagagaagcgggagtgctttgtctgtatttactgcattttttttcattttttttttctttttttgagacagggtcctgctctgtctcccaggctggagtgcagtggcacgatctcggctcactgcaagctccgccccccaggttcaagtgattctcctgcctcagcctcctgagtagctgggataacaggcgtgcgccaccatacccagctcatttttatatttccagtacagacggggtttcaatattggtcaggctggtcttgaactcctgaccttgtgatccatccacctcagcctcccaaagtgctgggattacaggcaa

SEQ ID NO: 109920 - DNA, 1050 bp, Homo sapiens
tttaacactgcctctgctggaaaacagctctcacctcctctctttctgtctcttattttttgcctttgcagatgagttttgatcatcctgagaaaaatgggccttggcctgcagacccaataaaccttccctcccatggataatagtgctaattcctgaggacctgaagggcctgccgcccctgggggattagccagaagcaggtaaggaacacacagaggcatgggctagcaaaggggtacattcctgagtaaaagctggtgtggcagatgtcctggcagggaatctcaggatctcagtatctggctccagctttgctgttttctttttgtatgtattttttagtcctctttaactgctgattcaatgtgggtttcattggggggtgtagagaaatggcttgtccatttctattaactatataagatttaagttattctgtatttcagtcaaccattctgagtacctactacctgccacgaatgcaactggtactgagtatgtcatgacgggtgggtcgggacaggatttccttgctttgagcattgatttctgccggttcagtgttggccagttctttgaaggtgatgatgcaagtcgctgtgttcttcctctagaagcctcgtgatgattgtaaagattctctgatacaattgcatcagttcaataatctttcattgagtatccgctctggtccaggcactgtgctgggtactagggtttcagaaaggataccaggaggagttttccttgagcagcaaagtcaggcatgaaaagcaagcattacaaagcactggctggcagcaaaggggagcagggatagtgcggaaggggaggtggcctccactgaccttcagaagcagaaaggtgatgctgtcagagctggcaggcacatggacaaggagaaagagtgcagcagtgcagacacctggaggcttaacacagtctggtgtaattggaaaattcaaagcttagtgtgtttttccaaaacatttgtagagaaaagtttgctactcttttccctcggttgcgccatttagagaaagtttc

SEQ ID NO: 109921 - DNA, 1058 bp, Homo sapiens
catcttgtttcattcagacatgtgaaagtcaggttctaagtccactatttccaaatcactcatgcaactttgaaaattatttgtatttccaaacctcactatactcagctataaatggagctcataaaatctgctgtgcttatctcacgggagtataataggtctgtaaaaccttaccaatacggaaagtacctgagtgttaccactcagtgcacagcagggatggcaggtgcagcactgatggtgaaggtggcttgtctgcgactgtctgacagacgaagttgcctctctagtgaccttgagtccgacttgatcacactgacttctcactgtcccttatcacagatgcatgtccttgggtggaaagatgatgaacttttagagtcagacagacctgggctggaattctggttctagaactgacttgctgttgacattggagaaaccctataaccttgctaagtctcagttttttccatttcctaaaataggattgtcaatatctctatcatagtgttgtagtaaaggttcaatgagatattgcaaggaaagtgactaccacgtagtaggccctccttaaatgctactttccttcttttctctagttcttcttcagttgtcatatggtcatgtgattacctgtgttgggtgtctgcggaaattgaattccttagtttctggtaatacaacaagcttccacccttcacttcatgatcttctatctgaattcttcttccactgtgtacatttaatcatttccacaacttcagcagcccaagataggagcccatcgttcccagagtcactggttcctgaggtctgggatggtggaagcactgctttggttggtactgccaatggattccaggaatgagctggatgtcagttcatggagaattcccagggaagagcctggagctcagggctgctgagtcatggctgtggcttcacactgctgtcttcactacccgtatcacctccacatggcccccaggctgagctgctgctctcctgtctctgttcagaataccttctgtgcctttttgcttatctagttc

SEQ ID NO: 109922 - DNA, 1087 bp, Homo sapiens
ggtcaccatcttgtttttttgttcttcctctaataccttttaatttttttttaagaaaatcactttctatcaccgtcacatcttctagtcacctctaggtgcttccaatgcctgtttgttgttcaaatttatattttggcttttggtattacttttattattattattattattattatttgagatggagtttcgctctgtcacccaggctggagtgcagtggtgtgatcttggcttactgcaacctccttttcctgggttcaagcgatcctcttgcctcagcctcctgagtagctgggattacaggcatgcaccaccatacccagctaatttttgtatctttagtagagatggggtttcaccatgttggcccaactggtcttgaactcctgacctcaagtaaccacccaccttggcctcctgaagtgttagtattacaggcgtgagccatcgtgcctggcctacttttattgttactagaagagataggattgaaaggaatggactggctagcaagaagctctctggggcaaatgacagttgagctagactttgaaagatgggcaggacttggggaaatagcaatagccgggcactccagaaagtggaattggcaagacagaggagaacaggaaatgagggaggcgttacaccactccaagagtagtgtaatgatcactcccctattagtgatcaggctggagtgcagtggcgtgatcataggaaatgagggagacattcagatacccctggctaagttggaggtggaggtgtagaagaattggctggccttgccccgtagagagagatgaggctggaccttcatggctgcttgtgctctggcaagtgtggaaattcagacagagggttaggaccagctttgtccctttcccttctcatgcctagtcaggaaccctggagctggagagcactttagggagcactaaaacctcatctccacttctatataagatgctacctaaatatccaggagagatgttcatttactcttaattaattcattcattcaacaaatgtattcagtattgagtagactgtggcagtcagtacataaactctatagtta

SEQ ID NO: 109923 - DNA, 1106 bp, Homo sapiens
cgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataactgagcttggacctgactattagaaaatggtttctaacattgaactgaatgccgcatctgtatattttcctgctctgccttctgggactagccttggcctaatccttcctctaggagaagag

SEQ ID NO: 109924 - DNA, 1109 bp, Homo sapiens
gctcccacagtgcagtggctggctgaagggctcctccagcgcggccagagtgggcaccgaggccgaggaggctccgagagcgagcgagggctgcgagggctaccagcatgctgtcacctctcactttgcctattataaaaaatgagagagagaaaataaaagcgaatttatatgtgaccccagaatctagaacagagctctttatctctctctcagcaaggcctattaactaacacagttttgctgctgtctgttttcagaacaaagacttgttctgtgtactcagacagtctaaaatgaaggttgaaaaaaacagctcatgtccatacacagaaacagaaactgaaccgaacaccgaaactgaaactgtttgtctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggtgagtgtgggtttcccaggcaatagctcttctgagaagagaggctcaggctcagcttagcatgatttattcctctgagagcttgttgaaggagtaaatgtcaccagggcctccatcctattgtggtcatagtactctttagggtcgacatgataagacgactccaaacctccattttgtttaactgctggaagtttcttcttttactaggtttccctccgtaaatatttctggaaaaccctggagaaggctccctattccataaattttcccttctagtttctcaccacgtcatttgttccagactacctctagagtcttttgcagtctccccagcagtcctgaccagcttcccccagctgcaccagctctccaagccttggcactgttcagtacaagcctgggacggagccttttttttttttttaaatatcttaagaattggctaagatcaagcagttactctgaacattgctttactgaaggcctggggataatagtatagaatgatgttgcaaaaact

SEQ ID NO: 109925 - DNA, 1051 bp, Homo sapiens
ttgagttagtctgagtaaggaagtattttacacttaagtagtgtatattttttcatagcaagagagataattcccttctggggcagaatagcattctgtaaatcccacaggcacttcctgtggtcttgatgtagcaggggaccatcctactacccttggactgagagagattgtgggctgcggggaagctctggctcagtttgaccctggtcagtgatctttctgcagatactgtttggagataaacttgaggacaactctggggtctcagagcttgagtgggcagcccagctctggcctctgggcttgcctacacacagggaggagagggtggtcttgaggccctgccccaggtgctgaggctgtttttactcctgtccataggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagtccttttccctccctcctcttgtcagggagaaggaaggcccctctgctccataggttttgtgctccattttacttatgctgttgtctctgattggagcagtcctcaattggaagtccactggcactccaagtcaccagccgttcatcccacgcttcgcttcttggggaactgggttaaccaaagcaagggatggggttttagagttgatctggggtaatcaagacttaccatacagtcattttagcttcatgccagcaaaagtagcttgtggggctggctgtaactcccagagctttctccattcctctataccaaaatgactaggactgacctgtgtgcatgttattctctgccaggctgtacattctgtaaggagaagcatctgaccttattcattctcacatcccccataggtagtagtaagtccctagcatggggtaggaactcagtaatattagtcgagttaaaagagttga

SEQ ID NO: 109926 - DNA, 1070 bp, Homo sapiens
gtcggcggggatcgagttcggcccctcccactgcgggagccgtcggaggccgcgtcggagaaacgcgcctctgttcggactggaaacgaatctgggaacgagtttgaagcgcggtcaagtttgactcatcgctttccaaggacagttagtgccttccatcttcattaacgtgaataaggaccttggctgacttctttccagatcggatttttaaaggcattgtttgcttgaggagatcatgcttctcccctcccccgccagcctttttgcaaaggctgagcccagtccagccaggacggccgagggatctctgctccgggacgcgatttgctggcattgtcttcgggcccttctggaaggctgtctcgcgctgagcgtatggggaacgtcccttctgcaactcctcttcagatcttgatgataaaacacatccctctgttttattgcatttcctagaagcttgcaggcttgcaagagcactgttggcaggaaacgtgatagaaatgaaagtcaggacacaatgtccccgaacacctcggttatccaaagcggctgtcgaggccatcgcgttatcaaattcgcttttatttactgtcgtctcctgcaccctcccgttccccagccaagagggcgaagagtgttttcccccaagaataaaaacagctccgcgatttgacctcaccccctgccgccggaccacggtggtgtctgcagccgtgcagctagttggctgaaacactgctgagaccgggagccccacggcagggcccctgatgcggggttcactacggcagttgcagccttattaaaattccttgtccttgtccctaaacagtgctttacactttcagatttccctttggatttttcagcgggttattggagttattagattaccaataatccaacagcctctgtagcctctctggctggagaggaggggggaagggcggaaggcattctccaaatcgggaggctctggccaaactaggtcaatgggaaggaggggaggggcgagaaaggggttgacggtttcaaaccttgatggagggctctctctagcgttaggc

SEQ ID NO: 109927 - DNA, 1061 bp, Homo sapiens
gtgttacatgaagtaaaaatggattatctcaatcctcatggaatataacgggacttgaccagcatttcctttttttttttccttcagtaactcacttataaggaataatagggtcctaatgaggattaagatttaataaggtgtaattagagttgttcatttcttccatcatatacattataagagtactgtgccggatccagaaatgctactaattatgttgaaactgttgtatgggtgtgttggggaagtcactgtgtttctcctcctgaaatgtttatgaattgctcaggtgagcatggtgagcatggtgttagcatgaacatcatataaagttaactacaaaagataattctgactcatgaggaacttcccaagagtacaaccacccaagtcataatctggatgcttagtgaactgcatacagtgttgtcgtcagtgctaaccctaccaaaagcctcattcccatttactgttctggtttctttcgtactcttacttttctcaacctcctgttacaactttctacgtgcaggcgcttgcgtgaaatggaaaggttgtatgaatttgcactcagtggtagaaaaatactggtttaccaattcagaggctaaaacacagaatttcaggtgtagtgtggggtcgtttgggccaaggatagcacactggtggcctaaaggctaccagcagcattttcatgggttcagtaatggcataaaagacttttaggcaagctgggcttgggtcctgcctttcgtttgcatccattacagtcctgtacacgtggcctttgtgtagctcatgccagtccttatttggagttttcatatacatttcacttaactctcacaagaccccttctgaggttggcattattatttttttattttatccatgaagaaactaaagccctaaagcccagggagtttaagtactagctctgtgttaagagctgagtaagctcatttttttttttttttttctttttttgaggtggagtcttgctctgtcgcccaggctggagtgcagtgacgtgatctctgctcacttcaagctccacc

SEQ ID NO: 109928 - DNA, 1033 bp, Homo sapiens
gtgtggtggcggggaactgtagtcccagctactcgggaggctgaggcaggagaatcgcttgaacccgggaggcagaggttgcagtgagttgagatcacaccactgcactctagcctgggcgacagagggagactgcctctcaaaaaaaacaaaaaacaacaacaacaaacaaaggagagtgtgcatttttgcatttaatttctacaatgcaggccccaaccccaacacccaaaactttatagtctagaatgtaggctccagaggggattacctattctgaatggtaggggtaaaagcctggggccttagggtctggcagtccccccagaggcaggctctctgtaagcagcatgggtctagagttggttttgagtgtacgcagagggaggagaagctgagctgatgagctgattgctgtggctgggacttgagtaggatctttcttagagtgacacattctggtgaagacagttccaggaaatgatggacgggagaggaaacttggttataaaggggcttaaaaatgccaggctaaggagtttggatatatcttaaattcatcatttgagggttttgagcaggctgagacatgatttagaggggaggtactggcatcgagaagccccctgctgcccaattccaatgagagaggtaataatttggcctaagaatattattggcttggcacgatggctcaagcctgtaatgccagcactttgggaggctcgaggcaggtggatcacctgaggtcaggagtttaagacagcctggccaacatcgtgaaaccccgtctctactaaaaatacaaaaattagccgggtgtggtggcatgtgcctgtagtagtaccagctgcttgggaggctgcggcaggagaatcacttgaacctgggaagaggaggttgcagtgagccgagattgcaccattgcactctagcctgggtgacagagtgagactccatttcctctgctgcgccccacccccccaagaaaaataatattatcaattggttcttgttcatttactcgacatag

SEQ ID NO: 109929 - DNA, 1032 bp, Homo sapiens
gattgttgattcacgtctgtaagacattttcattctcatgctttgtttggggcagagcctctgccttgtgaatcactcttatgagagggagtctcagtttcttttcttttcttttctttttttttttttttttttgagagggagtctcgctctattgcccaggctggagtgcagtggtatgatttcggctgactgcaacctccgcctcccaggctcaagcaattccactgcctcagcctcctgagtagctgggattacaggtgtgtcccaccatgcccagctaatttttttgtatttttagtagagatggggtttcaccacgttggccaggctggtctcaaacttccaaccttgtgatctgcccgcctcgatctcacaaagtgctgagattacaggtgtgagccaccatgcccagccgagggagtctcagcttcttcatcaacagcatcattctagtcagtctagtttccgtttaccttgtcatctaccacttcctccaacttaccttccccccagcttctcttattctggtgaatcacctgtgtcttcatttttcattcttattcatctgaatcatcttcttcatctaaggcaaggtacccttttatatcttcctggaaagacatctacttcatttaaaataatgctaccaatttcctcccctctggtagcaaccagcagatggaacatgctagatgaggtagaggataatctacaaatctggtctgccatatcatgggagatttcacgtaacagtgaattctttcagagcctctcagcaataccttccttgtttttcatatctgtatcaaaaggaacactggcaaacctgggttgtatttctcattccattttgggcttgaatttttctgagtctgagtctcagtttatctgtgtatgaaacgttagggttacgctatgtgtactctcagggccttttaactagaaaatgttgaatttgaatgtttactaagtcaacacaagctgcagtcaccctggattgcttgatcctccatgtacttttgagcctgg

SEQ ID NO: 109930 - DNA, 1076 bp, Homo sapiens
atcctgagtcagtgagagcagtagttagcttgcagcagcttcccctctccccctgagtgagcctttcttcctcttcctcctctttcattcagcctcatcctgccttgggtccatttgacagataatggcaccttgaggccttgtcttttgcatggcatctgtgcctgactggtcagaaattacttgtgaagcaacatagggggttgttggttgggtccacttttaggatgaagtcagaagggatcgtgagtgatgcttggccaataagaatgtattgatttgatttactaattaatttcatttccagacaccaatatatgcatagccttgtttgaagaaaattaaggagaaccattttgtaaatggcaatgagtgtaagacacttaactatcttcctgctctccctggcgtgggcttccgcgctccctgactctgcttttatttaaggtgtctgggaaggcatttgtccttcggcttcccagctggcttcttgccttctcactcactgcctcccgtagcctgtgggcagaatccctcaccgtgcccaccttgccctgctctcgtctgacctcacctctgtttccaggatttgctatggctgtcccctgccagtcatgctctgtgcttgctactctgagtgtgtccctggtcccactctcttgcagcctctgtgtcttagcacatgctgccctgatggcccaagggcccttcccctttgtttctgtctggggaatgttctgtctcctctttcttgaacctccttatattccctcaagaagacttaaggcaaaaacaaacctgaacttactatgtgtggtatttttgtgttataagtgtaggacctagtcatagtaacacatttcaaaaatatggaaccgtataaagaaaatgagcatcactcataaatcactatttagacacaagcattgtttacgtttctaatattctttctttagtggtgcttttcatgattttatgtgcatttgcattttactgactaaatattactatataaacattttcatatcttgccacttcacctaacaatacagcacaagcagcttctcatggcatta

SEQ ID NO: 109931 - DNA, 1695 bp, Homo sapiens
aaacattttctgtaaaggactgggtagtaaatattttaggccttgcaggccatacatggtctctgtctcctcctcctcttgtttccgctgctgcttcaagattcttttaactatagaaaaattatttctcgctagtaagctgtataaatatcagttttcccacctggttctagcctcaaaagtggagcaattctgtacatactttgaaagcaatgtttaaaaatttatttaatttaattaattaaaaaattaattggttactttttagagacagggtcactctctgttgctcaggctggagcacagtggcatgagcatagctcactgcagccttggaaatcctgggctcaatcaattcttctgcctcagcctcccaagtagttgggactacaggtgcacgccactgcacctggccatgtacatactgttttgtaattgttctcttccacaatttaactacttcatcagcgtcctcatagttttctgttttaggcaacccagatataattactggctttctgctgggatgcccacagcactttggccagatctctgatatagaatttaaggcacattttattgcgagtatttgctgagatgtctctttcttaagtctaactcctcgtgagtctttccagcctcagcacatttcctgagtggtgcttaatagatgctcagcaaatctgtgtggaacgattgccttaggctgcaagtttatcccttcacaatgcctacatttagattgcaactccaggcttgctccttgggccagcagcatcagtatcacttagcacttgttaccagtggagactctcggtctcaccccagaatctatgtctttaggtgttgctgaaagtttgagaagcattactgtagagctcacctctgctatattcatcatgtacttatttatagtcatccctacctcgttcttttcattggtcggaacttcctgtgactagaccatgggtattccttaattgactgacacaatttgtttcacatacagcaccagctgccatctggcctagtgagacctatgtggctgccattgtttttggctgggagtggttgtgatagatagaggagggagcaaatatttaattagcacctgctatgtgccaagtcctgtgcccagctctttacacacattcttccaagggtgagacatgatggtgtttgctgaagggaacatagggatctttaagtccagtgatttttaaccagctaaagaattgaatatatatatataacatatgcacataatatatatacatatatgtacatatattatatatgtgcatatataatatatgtacatatacaatatatgcacatatataatatatgtacatataatatacatacacacacatgcccagcccttactccagtctagaatcaaaatctctgagaagtagacctggtcaagagtacttagagaaaattccctcagtgtttccattgtacattgctggtgaaaaaccaatggtctaggccagcatcctattgtacagatgagaaaggtgaggcccaaagaggtcaatgagcatcccaaggtcacataaatttaatagcaaggccagacctagattttgtactatctgcctgaggacacacttcacattacctgagctgcttctgacctgcagtgttggggtggaagtagaagtgggtgaagaggttgaactcttg

SEQ ID NO: 109932 - DNA, 1046 bp, Homo sapiens
agtcgctctgctttttcctattttgtaagctaaacattgtcaaagcatccatttaaaggaaaagttctgctgctacatataaaagttaaaaaaccactgtgtctacccttccttttgctaacactgagaggcagagtggttcagcacaaggggacacaaagtggcttagcacgagtcacgagatgtgacgggtctgagacctctcagcctagagctcccttacccctgggccactttgttagacacacctcctttaattcaaatccccgtctcagtgggacatggctttttcattttttcaaggaaaggtttaatctgtccagatccctgtgaagatcttggctcttggcgcacctgctggaggttcgaggtcctgcaaccacagagtagctgcaggaccttcaggatgtcccgagccacaaggtctttgacctgcattttgcaacctggttgtgtctcccctttggactctgggaaccttgctgagattggtacaatatctgtgctaaaaaggtttgaaattatagctagtattgtgttaccttcctggtccaaccttcacagacattgtctgactaagtatatataactcttgagtgttcactgtgtacaccggctcacaagaaaggcaaggttcctgatcccaaggatctaatggagagacagaaacaaatataaacttttgtcaactatttcagagacagttatttttgttatacaagattgttatgcatgctagttatgtggagaggatttcatctcttagaaatgagacggggagaatctgggcgatgagaaagaagaccagaactggggagtacagtctagaattgcaaggggttgagtttgctatgtgaagcagttagttttggactgttgcacttactatttctgagatttgagcatctgacttttcctttaagcttttgttttctcatttgtaatatgggagtgagagtgcctagttcacagggtcattgctggggttaaatgagataatgtatgtaacctgcttagtataatacctagcacagagtaaacactca

SEQ ID NO: 109933 - DNA, 1035 bp, Homo sapiens
tttaggacacatgattggaccatttctagatatctgcctaatttgtaaatgaaaaatatgtaagctacacaaggagcactgactcgtctaaaatcttaacgactgactgatttgggcttggggtttggggcttgggtccttcatgccctgatcagagctgtttatagcttgaagacttcctgggggtgagaacaagcaacctcttggtgcagtccaaagccaggaaatgggtgacgattttgaaaaaggactcatctgacctccagaaagcctttacaaccaacagtagaacgagatcactaagaaacagaaccaccgggaagccaagatgtggtacttggattcccatctcggagcacctcctatatcccgacacaccatttcccctagtgtctgatctctctttctcctcctttaattcagtctggagtcattttagatcagattcattcctgattggcttcactgctccaacttagtcatcacagaaccttagggttggaatccatgttacaagttaaactgagcaattcacccccacttttcctgacaacagtgttctcttgagagtctggttttattctgagtcttccagcccggtgtctgtgcccatgaaggactcatgccaaattacattctcaggaggactcccagaccaagagactctgggcttgggcgtgagagacttggggctgttctttttctttttttttttttgagaagaagtttcactcttattgcccaggctgacatggagtttcactcttattgcccaggctggagtgcaatggcacagtcatggctcactgcaacctccgcctcccgggttcaagtgatactcctgcctcagcctcccaagtagctgggattacaggcacacaccaccatgcctggctaatttttgtatttttagtagagaccagttttcaccatgttggccaggctggtcttgaactcctgacctcaggtgatcctcccgccttggtctcccaaagtgctgggattacaggtgtgagccactgtgcccggccgaga

SEQ ID NO: 109934 - DNA, 1031 bp, Homo sapiens
ttatgttggtgagagtttcagacctagaggaaagggtcactgaaggtatgggttaagagcaactctgaaagccacctgccccccgacttctctgtgagtggggccacagggagaagatcccttcataggtagctcccctacccttgctatgcttggaaactgaccatggaaagggattcatttcttaaagggatagggctaccatttaactttctattgtgtcacttcccgaaacgcaacacctatggcttaagatccaagtgctttagaacatgagatacaaggtcttccaggctctggctgccacatccctttccaggcgtgtgtcccaccacattcctctgcatcctctgtcactggcctcaccagattagtcactttctctgagaacaccctgaactcatccttctcaaggcctttgcacattgtgttccctgagcctatttttctcctcctcatccgtggaaatcctcttgggtgttcaggcatcgtttagaagtcacatcatctgcagagaacttttagaccctcaaaaggacgttgcatgtactcgtgcttttctacacttttcattctgtcttttgtgttccagtgtgtcccccattgaggctcttcgacacccctaggcatgtccaactcagcacctacacctgctaggtccacacactgtgttatccaagacagaaggtgttagcaaacctctctttggtgcgcccctgaatgcagaacatgtgacattctgttaactaacagttgtgccagagtggtttccatagcccatactggggttcccatgatttgtttgatcatgagcccggccattcgaattgtttttgaattggtctgatatcagctagttaattgttaacccttttcaggtttgtttcccacataccagtagatgtctgcttagtgccagggttctgagctttttatttcacttaagaatataatagcaaggtagaattcaggaaagatttacttgctgttaatgtgaacttttaaaaaaatagtttgaaatgtaggctttg

SEQ ID NO: 109935 - DNA, 1058 bp, Homo sapiens
acgggaatgagaccatggattctgctgcaagattctgggacacacgtgctcatggccatcaagaacatagaacctgggcaggacagggacagcattgcttgttcatgtgtgtgtctccagagtctgctggggtctctggcatgggataggtgctgcatgaattttcatggatagaataaatctgaaggaagtgagggtccctttcccaaagggtgttctatcgggcattggctgactctctgttagggagtataggaattgtagcacagatgaagccagactacgtgatttaatgagaatgaaacaaatgactggacaagctgggcatcgtggctcacatctgtaatccctgtgctttgggaggccatggcaggaagatcgattgaggccaggattttgagaccagcctgggcaatgtggcaagaccctgtctctacaactaaacaaacaaaatcccaaatgactggacagaaagaggcttttgacttaagaagtttgtgagggcataaaaaggcagtgagtatggtgggatgccctaacagaagtcctgacaagtatgagatgtgcaaccctagaaaaacaacatcccttcacccttatttttttgatctgagaattaggaacaataatcattgccctgcctacctctcatgtttgcttagagcaagtgcattgttaaatgccaacctgttttgtaaactataaagtgtggttcctgtatgatacattattacagttgtcttcttccttaaagactcatcttgaatataaagaaaaagacaatgtaagttcagtgcacagcatcgggaacattagacatgctcagcgtatgcccttcctgccaacattgtacctcttcctcctccgggttggatgggcactaactcgtcctcagtcctgcagctagatctgcaactttgcttaatgatgcaggttaaaattgaaatagaattatgtattattatttttcacattcatttttgcctgagacaggaggtggagggtggtaaattaagaaacccgggaagctcagtgcttgagagaacccatagaagcta

SEQ ID NO: 109936 - DNA, 1049 bp, Homo sapiens
tgcggtgagccgagatcgcaccattgcactccagcctgggcaacaacagcaaaactctgtctcaaaaaaaaaaaaaaagaaaaaaagcattgattaatattatctcacagtttctgaaatttgggagcagcttggatgggtgccacaagatctctcaccacatcgcagtccaggtgttgctggacctgcagtctcaccggaaggctgaactccggggaagatctacttgctaccaagcacatcgcatgatggttggcaggatttgtttccccacagattattggactgaggacttcagtttcttgccgtgtagggctctctatagggcagctcacatggcagctgccttccctcaaaatgagtgagcaagagagagtccctgagaggcaaatcacagtctttttataagttaatcctggaggtgacacactgttccctctgcctcattctctttacgagaagcgagtcactaggtccaggccacactgaaggggaggggtgaatatgagcacaaggttattaataccaggaggtggagttacacggaaccatcttaggggctgcttaccacagattccccaggtttacatggatgtgctaaggtggaagtggacgttgcctgaagcagttgaataaacccagcacacctctgtggatcaattttacttgaagacatttttgggggaaaactccatttaaaactcttaagagaagcactggtacataatagcacaggatgtaaagttggcatggcttttaagaagaaaaacacaagttttcaattcatgccgtgttcccttacctctgtatttttgccctcctcagcggtagagcttttttggtagaaatgtcgaaaggttcttgcttgagccccttgctgtatgcgtgagacaccgagacttggaaagggcacatactcttccagggccacagagccagcggtagtcaagggaggaaccatctgcagctcctctctgtgccccgccttccaccgctccacacagtctctgctgcataatgagtctgtgcaacttttaggatgttttctc

SEQ ID NO: 109937 - DNA, 1987 bp, Homo sapiens
ccggctatttttttttttttttttttttttgtatttttagtagaggaggtttcaccatgttggttaggctggtcttgaactcttgacctcaagtgatccaccctccttggcctccaaaagtgctgggattacaggtgtgagctgccatgcctggctaactctgcttgttattaaagtgtttcttaccaattatttcatttttattaaaagtacatagtaggaaatagagttttagttggacaaggacaacatggtaaagaggaatttggagtaggaagactgtcacgttagtcactgaatcctacctagttcacttagttttttttagcctgttttcacttctgcaagccatggagtgaagagtgcctacttcagagtctttggtgctctcaaagcagcgtaatgtctataaagtacctattgagtgtggtacttcttatgtagttggcacacattaaatgttaagtttctgatcaccttaagagtccataactctttgctggagatcacccttagttcttttctttgttaggccattatctcatgtcctgtttacactgtccccttggattggcctagacctgcagcgtttgtgtattggtcaccccagatttcatgtttcctgaataattaatagcctcaacatttctaattttgcataatgactcccaaggcctaactacaaacatcataatgtgctcatgttttctgatacctggaaatatagtggctctaggaacaaaacctttatccactgtgtttcatggggaaggcttattgggcatcactactggaaagtaagtgttgattttaatggcaagactagtccaggggtgaattctactcaggtgccattagcaacctcttcatctgtaaatggaagtgtctctgggacctgctcagctctgacctgctttgggtcctttttggacttcttcaggatgagatcacctcaccgtggttcaatgccaactggtttgagttatatcagttattaaaaatgatctaatgttttccttttaaatctgaggccctggctcattctatgattaagccagtgatttatttataatatagtgtgagatggctgcagccactctatgatgtaatctaagaatgacatgaaaacaaaataggtttttacataatgaaagtattcctgtaatacagtttatagcaaggctttttccccccattgagaatggagatatattctttacttttccttctactcctgtttaaatcttcttttaccatttattacacttaaggcctttaagtcaatttttaaaaatcagcatttacaactccacaaagtctctggttactcttttaatcttgtcattttcttcgctcccaatccccactgccaccctccatggcctctgtgtgtagccgctgctcaccccctgctcagcactccagagtcctcaccattcctctgcttatgctgtttcttctgctggaatgctcaccccaatcctaacttttcttctgctaaaggcatacttcactggttcccacaaatagcatccttctgtagcctgctcaaatgcacatcttcctttaagcctcctgtgttgctccttccccttgttagaaacccgttatctgtactcttatggaacttagtgtaatagcaaacccccacccctgctccaagggctattcacagactgtcagagttagggaggagaaatgacttagaggaatggggtaaggggttttgatagttcccggtctgctcctaatagtgagacccgggcagtcagtcatggctcatctttgtggttcagtttttctcagctgaggaatgagtggtttggattttatttcacatggccaaatgatgtgttggtagtggttccttgaggtgctgtgctgagaaggactctgaggctgcatcctgactcagctaatgatcacttaggaatatcgccatgggagtggagagtgaaagcatatgagaggtatctgagctgctttt

SEQ ID NO: 109938 - DNA, 2459 bp, Homo sapiens
tcctttcacttgaacacttcgaaaccattgtagggttattaattggcctaatttcagtattagtgtgggagatgggagggtccaaggagagacgtgggaatggctggtcagtggagcagtcagaacacacctatttattgatcaagtttgccatctcatatggccatgatttgtgataccccaaaataattatgatagtcacatcgaatatcactgatcacagatcaccataatacatataataataatgaaaaagtttgaaacattgtgatagttaccaaaaggtgacacagagccatgaaatgagcacatgctgttggaaaaattgtacctaaagacttgcttgatacacagctgcctccacaaatcttctatttgtaaaaaacacagtatttgccaactacaataaagtgaagtgcaataaaacaagatatgcctttattagttaagtacacattgaagatgctcaggaaaaaataaattgcttttgtgattcaaagaatccacataaatctaacaaaagaatgacaaaacatatttctgtttttcagctctaagagatgggggcactggatcaggagcaggatggtagtggtgtgcagctttgaacaagtccagttgccgtggggtttccctccatggcagagggctctccactccgtttctctgcccctgcggcaggcacacctgcagggatgcctgggccctgggtgcagatgggcaatcgtaagcctaatcacccattcaggcacacacttacttgttttccacatgcaaatatggcctttttgcggatgaatttaatacagttgttgcttcctcattttatttaaaacaaaacaaatggccaaccatgtcagttgagggtagcaaatagaaacatgagtattatggtctttgctgtttgtgtcgattacacggctgaaaggaatcccaggcaaatcagtcttttctgtgctcaattttatttttactttatatcaccttttcttactatcgctattggttttaacaaaatttttaaagagggctatcacattcctttctcttaatcattttatcaatatttcaggctccttagttctattttgtggtttctacctttgacatttttagtttctgaacttggggcccattgttcaaagaaaggcattatggagtctccaaaagccattggcaggtggtgtctgtgacttccttagcctggaaataaacaaataaacaagcacaaattagaagtctttgccctattactgcactattagtattgattgcgcaacatcatgcaaaaagtcactttaatttatctggcaggtcctatgtaaacaccaatacagtcaagagggcttggatgggtatttgctttcatttctaatgaaatttcaggcctctagggtaggatatcaaaattggtagatcatttgcaatttattttatcccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagttttgggtaagagtgtgtgtgtgtgtgtgtgtgtgtgtgtgtgtgtgagagagagacagagagagaaagaggtaaagaggaacaaatgaagagggagaggtcagattgtttgacagtagcaacttcataggcacagaatttctgagttggaaggaagtcttatacgtactgaatttgactgctttattttgtagggaaggaaactgatgtgcctagagtagttgagagctttattcaaactcattccactgttattgagtagttaggatattagaccagcaacatatttgggtagaaactttcatataaaaaagcgtaatcataactatccaatcatgtcaactagtaaggctgctcaggtgggataacacatcaaccttctttgggattcttccctcagacatggttttggtgggaggagcatggcaagggaggggcgagctccaaatgcagggctgctctgtcctcggcgacctgagcagacacacgagcagagatcagagacactcttagtgaatgaacctccctattggctatattaaagtaatgctctgaaaaagttccgtgtggagagcaaggccagttagggaacattttgtggatcttttatatgtccttaactatatgattcttttattttta

SEQ ID NO: 109939 - DNA, 2009 bp, Homo sapiens
gggggagaaaaagtcatcagagttgtttgaaggttcatttatgttgatttgtttttattttgaagctaatttgtttcctgcttgtatctgtaactgatgtacttcatgtgagaccgtgttataatatacttgagttctccttggccctctgatttcttttctttttttcttttactgaaaaataaaagatttccttctctcttcagacctacagctttctcatctacatggacaacctatttttaaagaatcttcagagagtcgttgactttgttataactactactatatacgtaatttcagatgatagaattgaaaatttaacttgtttttctagaaagagtttattttccctataacttcaaagagtaatggtggggagtaggacattctgaaaataagaagaaacatgtcaaatgaatttctgacttccagctaggcatatggaataaaggtctttattccagtgacctctgctcattggaaaactttgggctggtagatttcatgattctgacgctgtatgtcctcttgagttacagtgagtgatgaggccaaatcgcagggtggatgatgtgctttttttgggctaataggtgttaaggaggcatgctgtcctttggcgttaagacagatcatttcctcagttgggtaatgtttaaggaatccactaaatccttaaatatatggcacacataaggaatgcagagcttttagacactcagccttaacatgggttattttttagcatggctaatggctaaacttgatttctactgggtttgttcaacctatttctaacttataggtaaaagcctgctttttatcctctccatcctcatcacctttttagttgtgtctctgcttgattcttcttgcattcaggtctatattgtattataaaaagaaagagagagacagagagagagagagagaaggaaaagaagaaggaaaaaaaaaccacacacattgaatgggaaggcaggagagtagagctctgaccccagctctgtcatagccacctgtgtgactatttgcaagcattttcatccattcaacaaatacacaccaggtactggagatacaaaactgtgaaagacacggttcttaccctcaccacttacagtcaggagtagagagttaggtacacaaatagaatgtgaaatcacttctcctttctgggtcttcattttacaaatgcaagagccagaactgggccaggtgatcatcaaggtcccttctgaggctaacatgccatcattcatgcaaaattcattaaacatctgataatcacttacctaagtgaaaattagcaaacatttcccctttctccttagtttgtaggggatgatattgaagacgaatgaggcgatgtctacaaaatgctttaataagcaagttggagaaagagattatgtaagtttgaggcattatgattaatgaaaaatgaaaacaagggctgatgttttcagagagagaacagatggttcctttgttcagaatttgagtataaaaaagagaggaagaaaagatacttgctatattgtttaggccctgaatgtgagtaactttaaaatgccaaaacaatctggttaggaaagtcccatagattcaaaatagctcttacagtgatcaaactataattaatataacaaaaaaaagacagaaaaatactaataagaaatgccacagtgacagctgacacaacctgacaaaaactcctatttttacaacaactctagaaacttgattttttctgttctcaggagttataccacactgtaaaacaaactagtgagaaccgatttaaaactgtttctaccgttccccctacccctcaggttattttagtttcccatgactcataaaggaaatcttcaggattcacaagaaattggcaattcttttccatctttgctgttgagtattgataggaaaacagcatagtttggggcaatttaagtagagaacaaacctccgggggcttggggtggtgtctcagaaggccg

SEQ ID NO: 109940 - DNA, 1188 bp, Homo sapiens
caaagtgctaagattataggtgtgagacaccacacccagcccagccctgctttcacaaaaaacaaaataatgatgaatatattgtactaccctcactgttttcatttgtctgtgaatgctttttattttatcaggaaaaggaaaaatttctgtttcttgactgtaattgttgaaatgtattttcaaagttttttactttatttttggactgataccataaaatcgtgtgaaatgatgtgaggattttctaatggagaaatgacttagaatatcccttggatgtcctatctgctttttaattgttttatcatcccagacatgtttctctattcctgtctattcttttatctgtaaaatgaggttattgaactagatgctgtctacaactttttttttttctttcattaacattaaatctctggtacctgagaacattgggatcaggctgatatgtctaggtgtctatttctttggtctacccttcaagtaggaatgaaaacccatagaatttctgtaattatcagcctcaataactttctaaagcctttaggaagcagataccctgcaatttatctcactaatttgtttgtgattaacactctctgccccttctcatatcccaagctcagtgttttgatatttaattacagggaattctttcctcttcatagatgatatagcaattgtatttcatttctcttatctgaaatctctgctgactttccatgtcttatgaatttaaatagtctaaatagggcatgagatcttaaatattccttccagtttctacattttctattcagcaacaacattttccctggaaaagggtgaaagcctgtgagtcccccacagggcaggagcactgaatacacccacattttcctaccatctgacatagatgagacacaaagtagggactcagatgattatttaactgaatcaactggattccttaattctcacaatattatccttcctaatttgtaaatagggaaatggaggcttagtcacacaaaatatcttgttcgaagttactaatcaattaagtaacttaataatttattgacatctgaggcatttctctctttctacagcctcagaccagaaatgatgggatttcagccttcttttcttagagattggtgagccaagacctggagagagaactctggttgtcttaagtcaccc

SEQ ID NO: 109941 - DNA, 1049 bp, Homo sapiens
aactttttattgtaaatgattttaaacttatttaaaaagttgcaaaataagcatagtccaatatagccatatacttttactcagattcgtctattgttaacattttatcccattggatttatcatcctcccccttcctccctcccttcctctctttctctgtctacacacacacacacacacacacacacacacacacacacacagtctcccccaccccatatatatatatatatattttttttttttccagaagtatttcagagtaggtcacttatatcattgcctctacccctaagtacagtgtgtatttcttaataataaaaaaaataaagatagtctcatcatattcacagtatggtaatcagcttctgtacatttgacactgattcaatacttcagtctactgtctgtacttctcctttgtcaggtggctcagttctgtccttgaagaaaactgctttttcccattcagtgtacagtccagcctaaggtcaggtagtgcatttagttgtcaagtctctttagtctcctttgatttggaacatttccacagcctttctttatcttttatggcattgacacttttgttctccccctttacaattatagtattcctcattttgtattagtcactggtttcttcatgttttgattcaattatgcattccctgaaggaatattacaaagataatgtgtccctctcagggatcacatctggagtcttatgtgtccatctctccgtcattggggatgttaattttgagcaactgatcaaggcattgtccagtttctccacagtataggtattctttcctttgcaattattaagctatccatggggagacactttattcttgctccttatcaaaatattaccctacattttttcctaaaccagcatttactatgattggtgcaaaattaggattccatgttactactctcttcacattcatcattcagcatcctgcgttctactgtatgcgggagccccttccttctcctccctccctcccgctctctctctctcttttcctctttcttttc

SEQ ID NO: 109942 - DNA, 1069 bp, Homo sapiens
gactgaaacccaataagaacatacatatttttgacttcaacacagagctctttaccttttacaagtcatcctctctggtccatttttgtcaaaaattaacgtatttaatagagaaggtgtttaaaacaaaaggagggtttagagattatctgtgctttccctcccctcagtaaaacctgtaatgccccttcttccccaaataaattatgagaatggggctgcataaattttctgtgagcatgtgtgactatgtttcctctggttcctcgccgcatggtaattactctgtgctctctcctgcaaactgcccatgtttcactgcttgtaggtcaaagctgtattgagtaagaagtgaatttgggaagttttgcaagtaaagtgctacctgagtcagtgactgtgtcttaattcacctttttgcttccaggttcttgctcagggccatctgtgcacatggttttcactcaataagtgcctcatgaattttaatgactacacattaaactaaaacaaggtctgcccacctattcttaagaaattaaactctacaaatgatgtattccaaaactgcaaaagagagtgaaagccaaaacagatgaagctgtccttatatgggcaggaaaaactcagtaagattttatcagttcagtaggtgttgcatatggtgatttggaactgtctgccagttccaagatggccttactttattgtatggtcagtacagtttgtatctagtcctcatcaggttaggcctggaactccccaacccctgttaaaaacagcaaatcagggtttctgtggtggaatggggaggaaactggcttgcattaattgatgtataaggtagcccatgataaactcaatgccacttttatacacatctgggagcaagagcttttggttaattggcttgcctatgtttttgctctgccttggatgctacagaaatggaattgtttgttagagtcgttgcatggtgaaggaaaaatcagagccaaggttttgaaggacctaagggagaacattctgtgttctgcaggcatcttcctccttgggacacaaacagctc

SEQ ID NO: 109943 - DNA, 1050 bp, Homo sapiens
ggcagggtactaactatagtttgctgaccttatccactgtgtggattcatcttgggaaaggagcagagaaggtactgagaataccacatctgctgaagactctgctggatgctttctccagacatctcatacagtcttttcaacacccactcaagatataggagctgttccatttcacagacgaggaaacggaggctcagagactttgcattagtctaccaggtcataaagctagtgttcacagaactgagactcaaaaccaggtctgtatacccatgaaattggtgcttttcctctatgcctgacacatgacacatcatatcaaggcatcaccttttcttgaatcttattcatagattctgggcaagcagcctcagcttggtcctatgaaacctttcctgacctcctccacacaccccctacacacactctgtgaacattgtaatggttagttgtatacacagttgtttccagtgctggactgtgagttcttctggatgtcttcctatagtgtttaattcatagctggcttttgatacgtatgtaatgaaaattctggttttctgcaccatactgtgtttccatgctgacactaaaaatctagacatgctttcttagaattaggcaacccatttacctttaaggatgcactgactttggtttttgccttaatatttggccaaaacctgctctttgagttcgacctctgctttgcctttaggagggtaaagtagccaaatacctacctcattaacattgtaggcaactctgaaattttgcaggataatcattgcattgatgcgaacatcacactggttaccgtcataccgtatcagcataaaaatgttggcaatgaatacgtatatttttcaaatttgttgttaataaccagatatgtacttttaaatatagtgagcattttacttataacttggaatggaaaaccttcttaaactactttgtacgctgagactccaccaactaattgaaatataaaggaatatattatattaagagtaagatgctacaatatttaatgatgactgtgaa

SEQ ID NO: 109944 - DNA, 1029 bp, Homo sapiens
gattacaggcatgcaccaccaccaagtccggctaatttttgtatttttggtagagacagggtttcaccatgttggccagactggtcttgaactcttgacctcaagtgatccgcctgccttggcctcacaaagtgctgggattagaggcgtgagccactgtgcctggccacttccacctattattaatgaaacctgtcctatttaacaaaaacgataatgtggggtgtcttgtgcttggagcttggagaaaggaatttgcctctgtttttttaatgacttatggcaaggccagtatgaccagtaagtgggctgtttattattattattattattaatcaccattgtcactgatagaaattgtcactattgtcactgatagaaaccaagatagaaattgtcactattgctatagccccaagaaggacctcatggctgcataacgattgagcaccttatatttacacaatgcttggttgttgttttttaaggcaactgtgactcaacaacagctgtttgagaacagctccatcccagatgaaatcagaggaaccgaagtttaaaaagaaagtgtttctgggctgggcgcggtggttcacgcctgtaatcccagcactttgggaggctgaggcgggcagatggtttgaggtcaggagtttgagagcagcctgaccaacttggtgaaaccctgtctctactaaaaatacaaaaaaattagcagggcgtggtggtgcatgcctgtagtcccagctactcaggaggctgagtcaggagaatcccgtagtcccagctactcaggaggctgtcaggagaatcccttgaacccgggaggcggaggttgcagtgagctgagatagtgtcactgcactccagcctgggccacagagcgagactccatgttaaaaaaagaaatgtttctgagcactaaagacaatttgaacaaggcagaaaagtacaaataggaaaacaataatcttactagattgtttgtttttgagacagcatctccctttgtcatccaggctggaatgc

SEQ ID NO: 109945 - DNA, 1070 bp, Homo sapiens
gcgggtgatgttggagttgattcatcacttaagcgctaatccattcaccagctccagtcagacttcaacacaaatgccaaattattcatcttccctaaatccaaccctattattttctctctcaaaaccttcagttgcttccttttgcatatggaagagagcgtggactcctccatctggcatttaaggctttctatgatctgtcctcccagacattgataggctgtggagatacagtaaggtagttgttatgagccacaccttgcagccaggctgctccagcaccaagcaacactttccccgggaggttgctgcacctccctgctcctcactttcctcatttgtggaataggaatagggtcattgtgagaattaaataagttaatatttgtaaagggtttaacagtgactagctcataatccgtcacgtagaaagttttttcttagctcatttaataagtacctttctaacccatcactgatagcatttttcttttgcaccagacttctttctagtcattgctgggagcgtcctctcattttcctgcctccctgtagctgtcactctcactcctaaactgttggcgttctcattttggcttgcccaaatcttacgcattcttttaagtccatgttcaagtgaatcctcactgattttgttcttcattcatccccttaacagacttttatggagggtctactgtgtgcaaggtgtattatgtaggaagccttccacagttcccagagctaggtgagctctgtcatgtaggcctgtcttgtacatatcaccttcgacattgctgagcagtttgtgttggacatgtttgatctcctcccctagaatataaacagctggagagtaggatgcttattagtaggtgcttattaagctttctttaaaatgagtaagtgcacatgctaccttttatagatctgttaccttctaatgaaggcaagaacaataggaacaaacattagttttgtgtgtgtgtgtgagagagagagagacagagagggagagagaaagagagagagagattttgaatgggaataattatgaggccacatct

SEQ ID NO: 109946 - DNA, 2192 bp, Homo sapiens
tagtggggagaatgtgggctttggagttggattgtctggatttaaatccagagtccaggtcattgtatacaaatgaccttaggccagttgtttaatttttgtgactcagcttcttcttcatgtcagttctatcctggggctaatgataggacgacaaaggaatttttttttttttttttttaagagggaatcttgctgtgttgcccaggctggagtgcaatggtgcaatatctgctcactgcaacctctgcctcctgggctcaagcgattctcctgcctcagcctcccaagtagctgagattacaggcgacaaaggaatttttgaagacaaaatgaaataatgcatgtgaagagcttaaaacaatttgcacatatgaattatttaataaatgtggttcttactactgtttgtaggaagacatttgaatttagtaaagcacataaaagccttttacatatgtatggataagtccgtaaacaaatacacacttattagtgatgcgggtttagaaagagtatatttcttggtggcagaagttccaaagtcaggccaggcatagtggctcacacctgtaatcccagcattttgggaggctgaggcagatggatcacttgaggtcaggagtttgagaacagcctggccaacatagcgaaaccccgtctctactaaaaatacagaaatattagccaagcatgatggttcgtgcctgtaatcccagctacttgggaggctgaggcaggagaatcgcttgaacccaggaggcggaggtttcagtgaactgagatcaccccactgcactccagtctgggcaacagaggaagactctaccaaaaaaaaaaaaaaaaaaaaagctccaaagtcatattgcaaggatgaggacataggtagggaaggggaaaatttgtgaccatttttgcaactttccaaactcctttctcctcccccatctttctttcttccaagaagttaccgtcattagcaatttgccatgtgtctagtttttgtctcacatttatatacctgtaaatatatgtttattttttgctttaaaaacctcaacagttatttgtataaaatttaaattctttgttctttcatgaaatatcatgactacaaacattgaaatagttactccgaattgcagtcacatgttttacttgtatataatcattcttataggcagagggataactgtaaccttttcccttctccttctcaccttgccctttgggagacgtttcttccctttttttgtgtctttctaccttgtccttctcctcccctcctctcttttcccttcccttatattctgttttcttaccgttcgtctccttttctctctccttccctccctccctcccttgcaatactttcctacctttcatactttctttattatatttttagtctcttgtctttagcttaatatggggctcagtggccaggcgtttacataatattgtgggtccttgaaacatcaggtcttggacacctagtctcagctctgaattgtcaggttcctgctgatatactttctgggtccactgttgctttgtatttaatactggaggttgtgataacattgtccagcttcaggaggccatggtagcgcaggagggatgcatgtgttgtgtagttccttgtctggaatgcagggtgacaggaggttggcttgtgtacacatgttcatctccttgggctactggagagggagtctttattttggtggggtgctcctaagagcagtgagctcagagcctctgtcttgagacttgctgtgtgttttcttggcctcccaatgctcctggcataagtgacatccctgcttaggaccctacactcatgatttcaggcaacctttctgccttccttttggcccctgcctctccaccccatgttcatattcttcatcccaggtgcagtgccaccctgctggctacctctgccaggcagcatccttcatgcttagctcaaattccaccttctcagaaacatctgacttcacatttggtgtcagtctctctcctcctccatttcccatcacacagtttgtactttcagagatactttcatacaccaccttgtattcaatgggtggtatctgtttctgagttctgatcagagggcagacatctctgatcctttggaggctagctcagtagctggcatttataggcactctgtaactgtt

SEQ ID NO: 109947 - DNA, 1596 bp, Homo sapiens
gagtgcagtggcgcaaccttggcctcccgggttcaagtgattctccttcctcagcctcccgagtagctgggactataggcgcatgccaccatgcccgactaatttattttgtatttttaatagagacgaggtttcaccatgttggccaagctggtctcgatctcctgacttcaagtggtctgactgccttagcctcccaaagtgctgggattacagacgtgagccaccatgcccggttcaacatgcagttttgtgtactgtttagggacagatgccgaagccacattgcttgggtttggatccatcctaccacataatatcatgtgaccttggacaaacaacttcacttctagtgctgtactttcttcatctataaaatgggcttacatcatagggtccttgtgaggattaacaaagttagaatgcgtagagcatgtagaacaatgcttggcacacagcatgccgtgcttcagtggtagcacttactattccattatactacagccaccgagaaggacaggtacacagtgaatagtttaggactgttcatgttcccggcctcttcactccaagagcatcagcaagtttagtttagaacataggagttgtatttacacagctactaatgaccttggaaaagttcttggcttctctgtccttgacctttgtttatctgaacgagtaaacttcagatgacagagtgtgtggggaatggaatgcatccgcatccttgataagctgccctagtggaatgttgccatgtggctactgagggtcaattcactggtcaaaggtggcctgctggttggtattttttctgtgtcttccgggcaagttctgtctttcctcagtctgcacatgcctgggtctgtcctcagagctctctcccatttccctcttctctagaaagcattgatataatggggccacctcttccttggactgtttctgtagcatcagaaggaggtgggtgggaatttggcataccactttttgaaaggtaatacattctaacatatgtatttcacccaccttcaaagagtaagaatacactgaatgatacttaattttaaagatgtgttgctgaggtgaactctaagacgaacaattcttcagaatcttttactttcttgggcttcttgtcccaaacaacaattatctttataaagcctgtgtgtgtatgtgtgcgtgtgtgtttgtgaaacttcctggaattggtagtgttgattttgagatgtttctttggcttattcaaaatataaacagaaaggctaaagtgtttttcatgtcattaagaatgtctttataagaaaggacattggccgggcgtggtggctctcgcctgtaatcccagcactttggcaggcccaggcgggtggatcacgaggtcaggagatcgagaccatcctggctaacacggtgaaaccccatctctactaaaaatagaaagaaaaaaaaattagccgggcatggtggtgggcgcctgtagtcccagctactcgggaggctgaggcaggataatggtgtgaacccaggaggcggagcttgcagtgagctgagatcatgccactgcactccagcctgggcgacagagcg

SEQ ID NO: 109948 - DNA, 1047 bp, Homo sapiens
tagtcctatgagataagctcataactgggatgttcaatatgactttattaacacagggaatacagctgattatctcttagacattgttaggataaattgtttctatacgtattgaatggactgtggggcatttttggtcacctgcactactacactggatccattctgtgctctggggtgtaagtgtgtgtgtgtgtctgtgcgtgtgtgtaatttcgggaacgggtaacacattcgtattacctctgtttggacacgatttttagtgacagagctaggaataacaggtggaaccttctaagttttgttgcttaaatatcaggccccctcagaattcaggactgatggtagaggatttaccagtttacagggaattcagatattctcttctctttctaggaaagccaaattgttggtcattctgcccccaacatttacagaagcagtttctcggttttatttatccaagattcttatgatgaatagtgttaatatcgcagcacactatgggctgtgatatgcctatatcacagagaaggcaagctgtggtgaagtggaataaatgaaaaactgtctataactctgcttctagatgccccacttaagcaagtaaatgggaatgtgagtgacaatatcatagggataaccttgaaagagtgctagtttttaaacaaaaacaaatcatttggaacgttaggatttaaacagttactgataataaattgcttgtgacccatctgaaaattgatggatcatagtgatagtgaaaatatttaacaactgctatggcccaggcaccgaacaatcgaaaccaactccagtgtaaacagtggtgccatcaagtatgcgctggttgtcagccttgctggtggagtcattgtgtcacgatgaagcaactaagagccagtgctgcacaaagtgttgagagaaacaaacaaaatccagggtgctccccttatgcggagtagagagtagatagagccttgtttcagaacgataaaacttcggtcaaggacttgatcttcccacttattgctgggggctcca

SEQ ID NO: 109949 - DNA, 1021 bp, Homo sapiens
gagtgaagaatgtgtttgctctttaaaattttttacattttttttctgtagtaattggactaattagcttttatatctattctgtgattacctttgttaaattatagtttttttagggaagtcacctatttcaaattcatttgcatggtgtaaaataatttctcatgattgttttcatttcctctgtatttatggttatatttcacattattatttaaagttttatggatttctgctatgtgtatccatctttctggctaaagcatcagagtttaatttattatttatttaaaaaatagcttttgcatttatgtgttggctctaccactttgtaattctttattttctctttaaaatcttcaataataccttctactttttctaggtttattttgttgtttttctcattgtttgaacttggctcttaatttccatatttttatttctgcttttttattcatataaataagatataaattttcctgtaagagatgcttatttgtatgccttaagttttgctaaatagtgtttttaatcttattttttagttatttgactatgcacaggttcttaaaatcccagacccattagaatgtaagctttgtagggacaggaaccttgtctgtttatttattttgggtctaccgttgtgcctgtcatatatttcttaagcacttgctaatgtgcttaagaaatgcttttgtgtgaataaataaatctccagggaattatggaatttgtggctgattcagtcctgtaactctagttcgtttctgcctcatttggatattctctctaggtatctactaatgtgtaggaataagaacatattagacatgcttcaaattacctttttaggtcatgatattaatagatttattttaaaagtctacatagtttttctcaaatcaagtatacctgggtaaaaatgtctttctaaagattagcctgtctgggcgcggtggcttacgcctataatcccagcactttgggaggccgaggcaggcagatcacctgaggt

SEQ ID NO: 109950 - DNA, 1148 bp, Homo sapiens
agtgatgggaaaagtattggccttggagtcagacctgtgtttacttcctggctctgctattttctagttgtatgactctatgcaagtaacttctcatctctgagcattaatttcttcacctgtttgacatagacaatgtctgcctcacaaagttgtgatatgttaatgtatgtgggatacctatctcaggacccaatacttagtctttataaaacactaaatgaattggttttctcatgtatgtcttatggttttgctggtgatggaccaatagtcatcttccatcttcactttagaggtgggggaaaagggcattagagtgattgtgtggtaaaatccactctaattctagctgtgagaaaaagagcggtgaaaatgtggtaagcaattgcttctaaaaagcttggactaaaagcgcttgatggatttgtgctggcttcccggtagactcatctctgtactgcccgcacagcacaattaattgttgttactagagaaggaacaaataaagaaaagagagagagcagacataaaaacatcctttcatctttctgaagacagtcccctttgtcagatcagtggagctgtacctgtgaatcaccttgggaaagcacagtgtgggtaactagaaggaaggtcttgtggctcattttgtacccacttcctgggctggggaaatatctaaactaacctttcttacttgtcaatatctactaccgttcaccatgcatcttcacagatgagggcctctttctcacatcttcactccaaacacattactgtgtagacagccacttattttctgggaagaaaactttgcaaagcagtagcagaataaagtcgagggtaaacagaggccatggaaaagcactagagtttgagtgcagagacatgagtctgagcatgagcagtgaatagctcatgaaacactcaagttgcattctccttatgtggaaataaaataagtcatggttgttctatgcacgtggcacctgaccttgggtccttattgctatgctgctagagtctatgaatcaagatttgccagttgtgatcttgaaatttagtcagattaaaagggaactctgactttgagggtgaatgccccaagtgggcatcttattctcctatggattcagcttgttagg

SEQ ID NO: 109951 - DNA, 2112 bp, Homo sapiens
cagctttcagccttgttttattaaatctactttttctcttttatttgacagtccctttctgtccagggacctgcctaaagtagcaaatcttttttttttttttttttttttttttgagacggagtctcgctctgtcacccaggctggagtgcagtggcacgatcttggtttactgcagcctccgcctcccaggttcaagcaattctcctgtctcagcctcccaagtagctgggactacaggtgcacacccccacgcccagctaatttttttttttttttttaagtagagatggggtttcaccatgttggtcaggctgctctcaaactcctgacctcaggagtccacccgcctcggcctaccaaagtgctgggattacaggtgtgagccaccgtgcctggcctaaagtagtagttcttaatatacgtgtgtgtatgtgcgtgcacacgtgcatacacatgatcctgtgtttggggcagatgtgaggattatggaattttcagaaactcagatgaatttatgaaatagttggaaaatgcagaactccagaaaatgctatcaacaagtttaggaggtttgtagatgctctgaaggccatccatgagttaagcaaaagttttcattctatgtgggaagtatgagatgacatttgagtggcatacatttccttttgctgttggattttccccgtagtcacctattgttatactctgagtgttaggctcgttttgtagcatgacttttggcatgtatgtatctcaaactattgagtgatattttaatattgaaactcttattctacttcattcattcactcatgcattcaaattcaattttaattcagaatttgctaaatgctagacatctcaatacattattgtatataatcctataaaatagaaaattgctaggtgctcagagaggttgagtaatttgcccaaagttttacagctaataaatataaaatctggatttaaatccggatttactccaaaatatgtgaatacctccagagataacattgaagacaaatagagacaatgatgcaagttcataaaccatggaaatttctggtagaaaatggtagatgggccccagaggaatacagagaatgtgtactatgggattttaggaagggacaagatcatacattatgaattacttcatatcataattcgttaactacgtgtttatctggctccttaagaaagaataaaaaaagctagataatcatatgaaacacattatgcataactcagtttttttcttgttcttcaaacttctgtcaggttagtgctctcaatatcttcatttggtaagtgagatgaggagatgaagagtagttagggtcatagtgccctgatcatactgagttttcacctaaataggaatttcagtgctttgggtcatctattttgttcccctcctcccggcctacccccccattatattgagcttgagacttttaacagagataacttctgaccacgcacagatcagcacaaatgcagatgtgagcagctagaatttggatgctgccaaattgtgatgactgccacatgtgtgaagctaaagcttagcacctgatgacccactgtgagtgtgtgggggggccagaagagtgaaaggcaggtcagagatggaagacgcctcggagtttctcaatggcagtaccttcaccttgcagatgcagaaatggaggtggttagaaggggtaagacttactaaaattcacacagcaggttaatggctctctgagaataatggcaaaacaagaacaaggctttataccagcaatctacagtagtatctacttttatttcctacctttccgttggcatatactcacactgataggcttgacaggcagataaacctgtatttgaaggtcagcaggattagttgtgtggccttggataagttacttgatttacttgggtctcaggtttgttgtctgtaatagaaaccataccctttttcttttctttctttcttttttttttgagatggagttttgctcttattgctcaggctggagtgcaccggcatgaccttggctcactgcaacctctgcctcctgggttcaagcgattctcctgcttcagcctctgtag

SEQ ID NO: 109952 - DNA, 1126 bp, Homo sapiens
accaagcattggagagatggttggcacttgagtctcttcttaggactctacaggctctgtctggagtccttgtttctatgaagaccactaagaataaaggtaatacaggtgctgctgctgctgtattaaacagatggaaagaagtagacattcattgtatgtctgttatgtgacaggccttgtgacaggtgttttcacatagtttagcttggtcagtcatcaaaagctagaattcccattcctccatgagggagacagattgtttctaaataggacatttagcagaagctctttcctgtaagctctgaaaggcactcggtagtggatagatgcttccctcctagaacacgggtgtagggctctgcagagtagcatgcatggctcttctaagggatatggattgtagagactgtgaaaataagcagaagttgtgatcaaaattggcgttgggggacttgtggtcacccgagtgtaccagaagactgagctcttctactctcctttccacacatacatctgagtctttggagagctgcaacctgagtgcctcgttcttgagtgtctgtagcattggcttttacttgcacttactacattttactcctgcctcttccctagctagcctcgacctcaacgtgtattatttcctccccccttgtcatttttcttctattacttttgcttcttccccttcctccttctcctgacttaaccttgggtggccgcaggtcttaaggctctgtgatggcagagtcttctgtattggactgtgaagattctggcagggaagacaatacacaaatctgttaaatacacaataaaaatagcttatgatctatgggacttggtattaagcaagatgatattaacgaggtttgattgctgttctgaaatgtggcagctgcgcacacgtattggctgctttttctccccacctttggcagcttgtgagcggtgttgccatgacactccttgggctctgtttagatcagctattttctgaaggagtcgctgaccttccccacaatagaagctgttgatgtggtcacgtcagtgcctcttcgggagctgtgtgactggcgagccctcagttgccacttggaaacggttggaaactgtagatcag

SEQ ID NO: 109953 - DNA, 1038 bp, Homo sapiens
ttttctcagcacattgatgatcccaacttctttttcctactaaaagggcagagtcttagaacataaatattatatatgtggaaaagggcaacatagtttctttcgggaggatttttggccatgctactcactagttcgtggatcacacttaatctctgtgcctccgtgtcttctggagaaaatttaagggtgaaattagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaattttactttgtacggccaaagcgtttcaaccattctggggaggtgggtgaatgcccacaacttgaacttttcattccattgctttccatcctcaagtctctcccttcttctccatacacatgcaactaccaccaccaccatggttctcttcgcatggcctatgtatgtccccagacatggtggagcagaaaagtaaaaagttgtgatttacaaaccaaggtagagactataagaagaacaaaaatgattaaggggcatgagttagtgacactaacaaaaagccttcatgtatcaacataaa

SEQ ID NO: 109954 - DNA, 1052 bp, Homo sapiens
ctcctgacctcaaatgatttgcccattttggcttcccaaagtgttgggattacgggcgtgagccactgtgcctagcccctctaggttttcttaagaaaacctatctattcctcaagtgcttactctgcaaagcctaggtctgccaccaaggaataaaaatatggctaaatgtacttcctttcctcccagagttcactgttcaataggggacacaaacacataaataactagctcttgcaccaagcgaaatgtacagtgcgacaaaggagaggtacagatagtaggctgtgggcccgaaggagggtttccgtgggcgtgagtatgaaggaggggtttcctgaaggagggggtatttgaacaacccttttgaagactaaaaggatgtccgcaaatgaaatttagggtagaaacatgccagaaaaaggcacagtgttttcaatacgctaggcatttcttaaactatttatagctgaggttatgggaaaagagatagtagaaatatgagaatatcttctccaaagattctatgctaatatcctgatccatctgactatgcttatttgactgctttttgtgtttgtcttcttctttactggatatcctttttgccgcttcctttctggaattttctttcctggccattagcctctctctcctacaccgttgccttactctcactgccatactcctttggacatcctccttctcttgtttcctgatacttttacatccccttccatcctttactccttagcttttgtttttatttgcagtgttaaagatagcctctttttatttccctgtagtgattagatcgacgtgtttacaatatgaacacacacgttttctcttcttcaggctctgagtcatcgagttcacaatgccatgtctagtcagtacttctatgtgtgtatagtgcccattgtggccgagtagagataaggtcactgcggaagaaaataaatcgctaaaatctgttagaatacgtcagcttccaggtttgtctgaggatgcagtggaaaccacgttctgtggccagcatgtcagtagct

SEQ ID NO: 109955 - DNA, 1007 bp, Homo sapiens
acacagcttctacacttatggggtttcctttctgggagaatggggctggtgacaattaatgcagaaaacttctattggagatagacatgcaaaaacactcagagatagagttgaggaatttgtagtcattagaggagagagatgttagttttggctgggattggagttaaatggagagaaaataaaggaagactttctggaggaggagggttttgatctggaacctgcacgctcattagaatttgaattcgacctggcagaaaggggaaaagacttcccaggctgagtgaagttttggagctgcacattttattttatttttcatatttgtttcctgctgccctctggccaccattcagaccgtttggaggcctgttattgtaggtgggacctaagttccagcaccagtagatgtgtgagtgaggcttttatagtattgatgtcttgtatttaaaatgaacagaggaagaagccctggagtccattctaataaatgtatttcaaagggggctttcttcttttgtctgagtgagaggcaggaataggaatgacagaggcagcaagtgttggatgtctgtagaagaatcatagagttctctttagagcactaaacagagggctaataaagggctattgagtcctccttatgtttttttcctctctcagatgagttttaagggtaatagaagcgcttttttttttttttctggtgacctcttaatcttacttttctctctttatctcttccttttcctagaagctaatattaaaaccactcttgtcctctgccattaaaaataaatctgggtaggtttcagcaagagagtatttcctagaatgcattatattctgggcagtagaagtgtatgtttaaatacttttcctgtagaaggtcattatgacaacagaggatgccaccagcaaccctgcagtatgtggtgaatgtgtttccacgctgtgtctgtctcgcctctgctctctgccatgtcaagctgattttaagttta

SEQ ID NO: 109956 - DNA, 1050 bp, Homo sapiens
tgagatgattcttcttttgtatgtcaaattttacttggcttctccctcaccctgactcctagtcccaccattttaattttatcatgatttgaataatatcacaagggaatgaagaatttattctttttttcaataggtgaacaaaaaaaagtatgagaaatgattgatgtgtatttcaacattgagaaaacccaaggaattaggaagaaagttctctggcatatcaggaaataggaaatgatctcaccaattgctagaagtggttgctcagtctcttggaaagtgcaccttcagtagatagcacttaagtcatagcatgcgcgcacacacacacacacacacacacacacacacacacacacacacataatctctctgccttattagccatttattctctactgtctttcagtagatgatttcttttaccttgttcctttctaaatattacctccactgggacctaattacaacccctcaaaattcacattacattggaatagatgtgagctcccaatgttatctttaggcattacagaatattagaaactgactgtggttatccattgtgtatgcaggtatataaacctcttttgcccaaatcgttgtcagactgcagtgagaaaagtcaaggaaatatttcttactagcttctgaatgttgtatgaattttccccgaagaatgataataatgcaagctgagactttttatattctaaagtaaacatccaaagccagttttccccttctattaaatgaacctttaactgagctctgaaattgtgaggaaggacatactttgatgcccattattctgttcaatagccatattcagaagagaagtttaattcaaactccagcccatcaaagcattttgcagggttttcaaagcagttattgtaatagagagtaattaaatattactgttttcaactgcttatttataatgtacgaagacattataatgaccccaaagttggtttgcctttagaaaaataaggatacaaaatgctgtgtagaaaagaatatgctatcttaagtctagagagc

SEQ ID NO: 109957 - DNA, 1105 bp, Homo sapiens
ctgacctcaggtgatctgccagcctcggcttcccaaagggctgggattacaggcgtgagccaccgcacctggccctcatttatgttttcaatgtttccctttgtcagcttactaggggcattgttattttgtctcctaacttttggggaaagcttcagtggacctctctctaatctgaacagaatacagacatggccagttatagagcagaaggcaaaggtgtgaggaagtctttgtaggtatgagagttcttataggcctgagcgttatggtgagggcaggtcctatattaagtgggctcataaatggcatatatgagataggtagaagagaagcatataatggcctcgctttagactcctttactgtgaatttgacatgccctccttgtactatgtgtggttcacccactgtcttactctctaggaacactgaagtgatttgtttgcgtgccctgcagcacagtccttggtcccctctcaacatgccaccccacacgtttttgttacctgaaaattctatttgtatcactttctccaaaatggctaggtgcagcctaggtcagaattaatcgctccctttcccgagtttccacatcttattctttgacttatccaaatttctaccacttttgttattgctcctgcttacattctgtcccatattgaacatgtagtatatgccaggctctatgctttctctttattattttattgccttcttatgtaaccctacaaaatgtttttttttttttcttataaagaaatggaagcttaaaggaggtgacattctctatgatttgcttggagtatgtttctgaactaaggctgctgtccatatccagcatgcggtactgcctgtccttctattcacagcacatgtggcagcaaaccccatattacagtgatacatccctgcatcccttataagaatatatataagctttgcttcctcattgaagcaacaagacatggtttctcactcgtccttatgttcctcatagctcatattatgctactgtgtttttagtaggaatggttgcatatggtcaaatgtatgtctgtgtgttcttatgtatgcatatatatttggatggctggcggat

SEQ ID NO: 109958 - DNA, 1083 bp, Homo sapiens
ataacctggacatgcttaatgaaaaaactgtctcgaaaggttacatgtattatatgatttcattttaagacaaagctctagagataaaggacatattcatgattgctaggggacagaaatgggtgggtcgggggggggcaagtactggtcattcctacaaagaggacgcagcaagagtctttgtatgggtggaacagatctgtacctcaattggagtgatgattacatgaatctatacatgggataaagttacatagaactgtatgcacacacaaatcaatgcaggttataaaatggtaaaaactgagtaactcctagttaacaataaggtaacaatgtcagtttgctgggttttcgaatgtattacagctttatgagcattaccatttagggaacctgggtaaaatgtacatggaaactctgtactatttttgcaactttctatgagtccatatttaaaaaaaaattaataatagtaaaataaaggaatgcatatagatatcttaatgtattcttctcttactcaaagtgctatcttacatgccatctgaattgcttgcatgatactttgaaagatcactgctatatgtatccctgccaaaatgtatggcttaaacctgtggttttcaaagctggccagtcatcagaaagacttggagaacatttttcaaaagaaaaaaattaaagcaagtcctaggtcccatcacaattttacagaatcaaaatatctggccatggggcccaggaatctgcattaaaacaaagcaaaataaaaaataaaacagaacttcccgggaattgtgattgatgctcaaccaacgtttgggaaccactcatttatttcattaacttcagggaccagtgccttaatctcctttgaaccttctccaagtcctgagagtgtactcttcctcccgtagttaatgatggtagcttttgaagtcttgagagtctttatcttgtgaacattgtacagattcagagacctagagcatctttcatgttgctattcttttccctcagtgctttcattatagacaccaatcgtttgcatatgttgtcctgggtcattttatttgggat

SEQ ID NO: 109959 - DNA, 1004 bp, Homo sapiens
atgtcttttttagggaaagcattcacaacaccatcagaccctcgaagagattcttaacttacccattaagaaaagtaacatctctgtctaggggtcaccagtctctcaagccagttatattgttgctgcttgaataaacaaaacaggtttttatttctgctcttaccaacattactaggctgtgtttgtagcaaaaactgagtatgtggtggtggtagtaactacagtagaaagtgtaacgtgtacacaattatatcatgatacatggtttttaaacacattttatatatgtatatatttaatttattcacacaacaaatatttgcacatgttgcctgagctgtgcatgtgtaaggcagggcatagaaatgaatagggcatgggttctttctgctgaattagatggtaccccctcaccccccattttactgttgaagagagggaagcttggtggtgaggtggcttgccccagaccatacaggtaaaaagtagtccagagtagattcaggcataacttgtttgaaccaaattgtgttctttagactgcaacatgctttctgttccttagcatgtaactattaaccatgtatttttatttatttttcttttacgtgaatttaaaatgtcatatttgttctgcttctattactgcagtcttgaatgatgattcatcagtgcagtggcctattttagtgaaccacaatagcttgggtagaaagaaaaaagatccaacatacacaggaatggaaagcagccatctttttatagctaaaattgcaaacatctggcaattactctattctacctcccttcaaaaaagaagaatcatcccttcaactggagcctgccactgtgtttaatcaaggcagaaagcaagccttaaggagcaataggttttgattcaaggaggccattgcctaacctagttggccaaagtctcttcagaaaataccccatttagtgctccccataagctactgggttatataatgatagtaatggta

SEQ ID NO: 109960 - DNA, 1051 bp, Homo sapiens
taagtattatatttaaagtttttttttagtagtgactagcacttagtaagcacttactgaatgttatcattaataaatgatcttacaaagcagtagcatttccttctaggatttttttgtagtccttcatgattgatagagaagagacatgcagtctaggatttcacatcagctttttaaatataggaaaccagatgtaaatatgctgcttcggttatttacatctgacattcttgcatgcttgctgacaaaacattaagtaaaaattatgctactctttcccttagatgtcaattcatggtcacattaaagtcacaagatttttcctgaaacttactgctggtaccaattttaccataggttatcttaattagtatcatcacacagtggtgcagtttgacctttggggtttgattccagtcctttgtttattctgactgtgaatggaggagtcaggcagaatgacctttacatatctttacctccttctcccatcttctgctggcatagaaaactttgcataaagaaaggcaacagagcaactgcaaaattgctgggattaaaaagaaaattgtatgataatgagaaatccagtgtactctctctcccttaatatgtgtgtgtgtgtgtgtgtgtgcgcctgtatacatcagatatatggattgatgcagtgtactctctctcccttaatatgtgtgtgtgtgtgtgtgtgcgtgcctgtatacatcagatatatggattgatttctttttgtttataaaaaatattcacttttcaaaatgtatttatactatgctatcattgaattcttacatatcaaccctttgtggttgacactgcagagatgatgagctccattttataaagatggggcagttttatctcaacaactagtgtgttctagatcaaggactgattccagattctcaaagtcctacaacagtaatcttcaccatgctgtgtgtatgcgtgcgtatgtgtttatcagaatatattagaagataatttgcaagcagggattggttaaagttgaatgtttatgtattctttt

SEQ ID NO: 109961 - DNA, 1072 bp, Homo sapiens
ccccaagaggccctggtgtgtgatgttcccttccccgtgtccgtgtgttctcattgttcaactcccacttgtgagtgagaacatgcggtcaacataacttttaaaatccagaatgtcagtactaaaaggagccttttaagtattagaattcaacttaatgaaatgttgctacgtattttctctgttctcatcactgacgtagctgctttggagcatctatatctgatatttagatagtggatggcttcttgcaaacacttacattgctcacgtagtaatgtgaaccaacagattggtggcccgggcagcaacatattttctataatctgtagcatgaagccaactgaggtgtgaccgtggtatttcctgaagtggctttcttttgcttttctgttttgattattatgtggctgtggatttagttcacaccatcactgtgaagaattttcgaaacttaagaatcaagctctgtttatacattttcaacgtaagcccttaattacagtcactcctcgggcccagtgattttacagttacatgtcagattgaggggtttcgtcttgagaatgtcagctggctctgtgaagaagaagaagagcagatacgtgagttacccagaggagtgctgattgagtccaggagtctttctgtttaagagcacgttgaaagagtttgtgtgtctatttgtaaaaccattttggagatgataaaaagcattctgagacacacaaattttttttctgttttcaaaggcaagacagagacatgtggacaggttgatgaagggatcattgtgatcttttctctcagaacttgattttcattacttgaactttgtcttctatgcttttattaccaacacctgtacacaaaggtacacataatacttgcaaaaaagagaagaaactgttttcagactggggctctattaagtgttcattgaccacaatctacaacaacaaaaatgacaattcctgcttgccattgaaaataatgcaattgaaaagaaagggcggaagcaagttcttggctgcatagcttcagtctgatgccatattctagagtgaaaagg

SEQ ID NO: 109962 - DNA, 1127 bp, Homo sapiens
aagcaacaacaatagctctgaggtccttggaaccaggagttttgaaacttttactttactgcacgtctgttgacatgattccatgaatatttctgctctttctcccttatgtataccagatccactgggctgagttaaatataagaccccaagcatggtcaattcttattaatagtccttgaagaggctctctcttgtttttgattgactttctttttctttcttttcttttcctcatcctttctccttcttccattctcccttccacctcacagaagcctaacgggcttggaatagcacttataaatgcatgaatttttagaaatatatactattgttttcatttccacaataatcatgcctaacatttatcagccacttcccatatgctaggctctctttcaagtcctttaaatgtaataactataataatctcacaacaaactccatgagacagggactgttatctagtgtgttttatagattagaaaactgagacacaaagaaagtaactttctaagctcacatacctggtgagtcagtagctgaggcaagatttaaaatcaggcaatctgactgtacatctcactcttcgctactttgtccttgtgcctttagatcatggttctgtgctatcgatctgatcttatttcttactctttttactactgttgttgctcagcatagtcttcccccctcaaaaataagtaacatttatattgctattattattattattattttgagacagagtctcgttctgtcacccaggctggagtgcagtggcacaatctcagctcactgcaacctctgcctcccaggttcaagcaattcttctgcctcagcctcctgagtagctgggattacaggcgtgcaccaccacgcctggctaatttttgtatttttagtagagacagggttttaccatgttggtcaggctggtcttcagctcctgacctcgtgatccgcccacctcggactcccaaaatgctgggattacaggtgtgagccaccacgcccaacctgtattatgaattataatacatagataacgtgtaaatatttaatgtcacatattattcgtgtgagttagatttgtaaatttgattagcgctgagacattggta

SEQ ID NO: 109963 - DNA, 1058 bp, Homo sapiens
aaaaatatcctttgaggtcacaggattgatgctatacaaatagtaattgtattattaatgatagaaatatgaagcatattggtattaaactatgagctgatacatggagcagcagatattgtatttttagttcatttccttaggcaaactcaaatattgtactcacacagttacctcaggcattcacaagttagagttccagtgcaaacagtttgcagcaaatatgaaccacagtggtactattagttttgcatccactaggcacattttccagcttctgaagagataattgaaggagaacttggatatgggctaaattgtgtatatggataaaagattcagcagggatttaagcactttcgacccacatgaaacattaaatattagctgagactcacttgaagatggacttcttgattttgaagagttgtctgcatttttataaaactacatgagcatagtgcattttaactaataaaggaagtgaacacagttgagatgcattatctttcttagccttagggtactgggtgttactattataatttttaaaaatgtatgcttttcaatttttaaacagtttattatggaaatgtttaaacatatacaaagggatgagattactataatgtaccgccaggaatatattatccagcttcagcaataattgactgatggccagtcttgcttcacctatacacctattcctttccctcaccctggattattttgaagatagtctcagatattacgtcagttagtcacttctgcaaattttagtctttagtaggtatgtctaaaacatctctcaaccataaataacatgtcaggagagctcttttgcaagatgtttattgatcttgtgccttttgcatgagtatgggaatggctactgtttatggaaaaggagattaaagaatgcagtgtgggttttttttcgtggccgatttctttctttccttctttttttttttctggaagtaggattggtttggggcatgatgtaggaatgttattgggtaagggtttaaactctatgtggcttctgtggtttggag

SEQ ID NO: 109964 - DNA, 1508 bp, Homo sapiens
tggtcctaaccacaactagagatttctggactcccaggcctctgctctttccattaccttcttgttcatttattttagcaattgcctgaaggcaggatcacaacccatatttctgtatcacccataacctttattttcatttcattttattttttttgagatggagtcttgctctgttgcccaggctggagtgcagtggcgcaatctcggctcactgcaagctccgcctcccgggttcacgccattctcctgcctcagcctcccaagtagctgggactacaggcgcccaccaccacacctggctaattttttgtatttttagtagagacggggtttcactgtgttagtcaggatggtcttgatctcctggcctcgtggtccacctacctcggcctcccaaagtgctgggattacaggcatgagccaccacgcccggcccataacctttattttattgcgagaagatagaatagctacttgattgatatttgtggcttgattgatctattctttcttcgactgtgcaataggaattctctgggaaaggactatgaagtctgtatacttatcacccttttgatgcttttggggttgttgtaagcatgcaaagggttcattgtgcactgcttctgtatactgactcagggtggtggggagaggaaatgggagaggaagttatatacatcttgagcaaatcaagcttttctatttttagtccttgctactgtttggaaagtacagcctctgttcatggcagtctggcatgtgtttccttagtgccatttcgaaagggggaaaaaataaatatgggaattttttttttttgtagtgaaaatagttactcagtgaaatcacataagtttcccgtttttctcttgatgaaacctcaaacccactaggcacagattcctcaacctcaactatgcatgtgaaaggctcatgcagaacaggagaccagagtcagcaaaaccttgtatagcaagataagctgtggtgccccagagaagcgcggatgggtggcggaggtggggaaggcagggaagggaatggtgatgttctttcatatttagtggggaacttggccaactaccagatcgttgccccctggaaaaggctgaaacctgaactaagataaagagacacatagctttgcagctttttgcttaagctgttccttttgcttcagtttctgtccttggtaaaagtttccctgactgctttatagctactcccccaattcaaataaataatttttctttaatagttgtgatggcatttgggagatttttccaatctaaggctatatcattaggacacgataaagagccttttatgctagtaaataaaatgatttgatctgtatttagatggattgctataacatagtggtactcaagtgatcagaaatggtgatgacagagtgtcttggagtcaccttcaggggtccattgaggcagacaaggaccttaaccaaggtggtggccatgaccatggagaaggggaacaag

SEQ ID NO: 109965 - DNA, 1024 bp, Homo sapiens
tgttgcattgtattccctgggtctaaggcagaaatgtgtacgtgctccaataacccttgtttgttgtgctgtggaatcacgttcatttctgattaaggtgaaatcagtagctttctgatacggtctctcactcactttttatcaatggcaacctttttcctaaaaataggaatttctgctgggagtgttttaatataaattgtctgtgctcagcctgaaatatgtgtgattcataccatgtgtttgttcccacatcaacactaagtcccaagatacaattacccctgcccactctctccttcgtcatggggaatgtgtttatcctttagatatcagcaccttgggtaagagccaatctccttatatgccttggtttgcacacctgcattgtctgaccacagctgaccctttgagtctgctcttactctatttttaccttaaagaacactcgtgtttgccaagtacacttgcacattgcagagttccttctatatctttatgctcatgttgtaaatatgttaaatacttgttctccatttaaggccttctcaattctgtcgccatatagctctctctgatttctctattcagctactttctctctttcctctctctcattttgcttttttctcgaacatcttgtgtgtcttacctacatgtagtctgccttctaatatggacatttgtggataaactagtttcttcaatgcaactgtaagctcttggcagagaacccctgatccattctctttccctccctccccttccttctccctctccctcctttcctttctttcttccctccctgcccccctccctccctccctccttcctccttccttcctacctgcttccctcctttcttcctacctgcctccctccctccctccttcctttctacctgactctctccctccctccttccctcccttcctcccttccttcctcccttcctccctccctcactcccttccctcccttccctccttcctttccctcccttccctcccttccttccctccct

SEQ ID NO: 109966 - DNA, 1059 bp, Homo sapiens
agaggactgcgtagagcaggcagtatttgagctaacttggcttaaagtgttacgggaagggcatgggattcaaggtgcaagaataacaagagtgagaaagtcaaggaacgtggaaagtgaatattatttgaagaataagtttgtctaatggggtatgtaaagtgtaaatgggattactgctgaaaaactcaaacttacttagcagtacctaagtagcccttttgatgcccaagggctttcattgttagaaagagaaatttacagggggatagcaacagtgttactggctgcagtgattttggagtaatgactttagcttacagctactttataaaaaaatcctccatgacgctgcatggatttatgcaattaaattacattagtgtttgaaaccaaaatttctaaacattttaaatgtgtttgtcagggagtagttttagaagaacagatgtgaaaagttcagaggtgatcctggagtgaattgcagacaaaatgtgatcatagaatatcagagctttagtgggccttccagctcacttagccaaactcttattctacagatggaaagcttttgcccagagagggaaagaacacactcaaggaggctcatttagagacagtttcagtgattctttgtattttccccgaactatgacacaaaggcccagcttgatgataaccacgaccaggggagagtttggtttcctttagtatcacaattggtttattccaaaaagtctttcttttatggcgtcttctttaaaataagtctcaaacacataacaaagaattaggcatatcaaagacgtacttcaatggtaaacagaaaacttatgacgttgtaacatctttaagctagtatatatctaaacccaacccattaggtaggcatgatttgttagtataagtacagcttagcctctagaagctatgcaggggttggaacgaaattctgtctatttcttagaagacaagagatcaatcatgaactaatgacttttgtgttccttcttttatcagagttagggtacagtattcatcttctagtttctagtacag

SEQ ID NO: 109967 - DNA, 1450 bp, Homo sapiens
cttacgttaatatttcatggtagctggagatttagtaatttgtgaatcaagttgcttttgaattgattaaatgggctttcactatcctcatttagactagtgtgatactgtgaaataataagaaataatatataaatatatttttctactccagtttctgaatcagtgtttgtaaatccttataatttcctaggtgataggggtgctggtagcatcttttgttctaacattattttgttattgaccttggttcctgactcagagctactgaattctgtggaatttcctgagtgatggaaatatctattgttttgatgaggcaactcttggtgggctcctggattttggctggttaccagaatgaccaagcaatgatttgaagcttggaagtttaatcttcacctctcatcctctggggatgagaaaggggctagagattgaatgaataacaaatcatgcctatgttttgaatgttttgaagtctgtataaaaatccctgaagtgcagagaggtttcaggttgttaagcacatctttatgccaggagggtggcataccccaactctatggtaacagaagctcctatacccaggacccttttggatctagccctgtgcacttcatcatctgcctgtccatctttatcctttatcgtatcctctataataaactagtaaatgtaagtaagcatttccctgagtttcatgagtaattctagcatattatcaaacttgggaaggggataatggcaaaccccaatttgtagtcaaatcagacagaagtctgggtaactggtgaccacccctactctgccccaccaccgcagcttgtgattgacatatgaagtggaaacagtcttgtgggacttgaacccttaacctgtgggatctgtaatagtaactccaggtagattgtgtcagaactgaattgagtcataaaacacccatctgataccatagaatcagttgatgtatgaaaaaaaccctcacatttagtgccagaagtaaagtgttctgtccaggcatggtatctcacacctggaatcccagcactttgggaggctgaggcaggttgattgcttgaggtcaggagtttgagaccagcctggtaaacatggcgaaaccccagctctactaaaaacaaacaaacaaacaaacaaacaaaacttagctgggggtggtggcatgcacctgtagtcccagcaactcgagaggctgaggcaggagaattgcttgaacctaggagacagaggttgcagtgagccgagattgtgccactgcactccagcctgggcaacagagcaaaactctgtctcaatcaatcaatcaatcaatcaatcaatagaagtgaagtgttctgtgagtagcatagaggaaagaggtgagtttttcttcttcaactaatatgaaaaatttggagatattttgaaaataagaatagggtggggcata

SEQ ID NO: 109968 - DNA, 1048 bp, Homo sapiens
taataagacatatgggagtctacggaatctagggaaggcagctgagtaagtaacgatatttttaaaaaaattggaaataggggccaatatttgaagactaatgaaattcaggggcatctattctcgttccacaaaagtttagctatctggtattccatctggtgatctattcaatcaattaactcttccatattgggatgtttgtcagagtccagcttacaaattgaggaaatccacagtcacttgtgagctagtttgtatcagttattaaaatttacttatttattgtaaacttcatcaaaccaacaattgttaagcccctactgaatgcaggacactgcagattacaatcaaggggaacacagtttataccctttctcacaccacaagggacttctactgtaagaaaaagatgtgtaaagccataacgacaagaatatgtgataaatatgataatgaatctatgaacaaggctgtatggatgcctagcggaaggtgctccaatattctcctggagaggtcagagggggcttttcagagcatttaagcatatatattacaggaactggaaatgttcagcccagttggagcttagaaaatgtagggcaagtgataagcctggaaaggaaggcacgtagatatgtttctgcaaatgcattccctccttctgtcttcctgtctgccttatatacacaatgatgactcagtaccaggaatctcaggaaacaaacaacacacatgcacaatataaattcctctacaatccctctatttatcctcagtgcaaaacctcaattaactaatagctcatctgaaaactgtcagggctagaaagtcccataacccctcaggataaaatcacaccaaccgtaagttacttaggctctccaaggtcagcctccttttatctagcttccctctttttataaagctgcgggcctgtctctaacaggatcatgtggtaacattcatgatttgcaagagctttactgctacaaagcacatttgcaatacactgtctcttttttttacttggcatttgcgattt

SEQ ID NO: 109969 - DNA, 1054 bp, Homo sapiens
caagaagatggtgaaggcgatatggtgtggtagatggagcatgtgaattctcctagttctgcttctaactcactttttgatttttagcaggcaagctatttcacttctcttgtgccacggtttccattcataaactagggaactggacttcttgtctcctcaccgtctgattaaaaacattccgtggtgattccttttcttggtaagacacatagcttagtccacctcaggtcccaaaaggaggatcaaccttagtgttttacgctctctaatatgacctcttgcggtcgatgttttagaggtatctatcatattgcatggattgagggagtttgacctgttgagctgggcgagttatcaccatgcagcacttcaggtgcttactctctttttatccatgcattggttcattggattcaaacatttcattagacttcctgccttcttttggggggatattttgaatttggggataataagtttagaaatctttgggatgaagaagaggaaagagaaggcagaaaaggagggccatgactataacatttatcagcaactgtgcctcttccagaagaatcaggatggactggatttgaatataaaaagtaggaagagaggcaaggcagaaactgggagaggccgcagatggtagtgattgcagatcctttataaaatgctgcatgtttcaactttcctctgcccaacactatcaagtgagatggatccttggaggtctttgggtccagtcctcaaggaatcaaaattacatctaggtagtaggaataggttctagtgttctataccacgtgggataactatagttagcaataatgtgtgatgtagtttcaaataactagaaggcagatagttaatgttttcaacacaaaggaaatgataaatatttgagatgatgaatgtgctaattaccctgatttgatcaatatacattatatgtatggaatttcactgtgtaccacatgaataggtataattatttttaatttaaaaaaagcagtttctcatgtaagctggatgttgctggatagtttaacag

SEQ ID NO: 109970 - DNA, 1082 bp, Homo sapiens
ggagtgtagaggtggctaacagaacaactctggagccacaatgtgtagattcagataccaacagtagcttatgctgaaacctgggtcaaattacttaagctcacatacctcagtttcctcatctacaaaatgaggataataataggttcttcctcacttatatgtaaagcatttaaataaggactagtagattgtatgtactagctgttattaaattctgccacatttgtttgttctccatacacaccttagccttttgtctatgtctctgttcacattgtttgctggaaacaggatccacccttctcctccaaggccagtgtatgtgtgtccacaaacacacagccatccatgtgttgtgattccacgcacctccgaagatacggctcagagagccaccctctgcttgccagattgagcatagttcatctggaactttcatacacttctctgtcttacttagcatttgcaactatactttatagttattttcaagtttattttgcctcttttgctggtgtgtggacttcttgagtccatggacttcctgtgataaatttctccctactacaaaaagctcagtgccttgtgctgagctgctgtgcttagtaatagataggggagagggtgtttttttatatctatatacatatatatgtacatatatatgtacacataatttgatatacttttgagtgtacatgatgtggttccttatttttgcattaagcctatcacttccgggcattggcaaagatctgaaaattaaaaggaacacaaataagaaatgcatttagtccatttaagcaacatgtgagttcctcttattgagtttcttccctaatttagatctcaagttttgcaaaagaatgacaaattcctttatttaaagaaaaatgaaagcagatctgttaccttctgtcctatgaatgccaattctctatcctggataattagataaataagatatgtataagcgtatggtttatgcacatagacatgaagctctcaatgcctgcatgattttcctgtcatgctcatgtgggttaaagcccaatagatgtattttgaaaactcgaatg

SEQ ID NO: 109971 - DNA, 1143 bp, Homo sapiens
ggacacttatgttgtgctttcccacaaaattgtctagcattttctttaagacatatgcatgaccactgcccaaacgaaataaatcaccctttctcttaaaggatccagactattaaatatgaagaacatcaactaatttgactagcagaatgtaggccttcagtgttaacatagcctttttctgttattgcatttatctgcctttgttctgaagccccagtctagtacctttcttaatgcagatctctttgagcataatgtttccattaaaccagccagtggatctcatttgctccatacatattcatattaggaaatattattgtacaaagtaaaagatgctagtaaaagatatgctggaacaacatttctgacagtatttgttctgtagttaatgctctgggagcctttttccttcaaactctctattcctagttagggcctcatcatttcttgcctggattattgcagtagcttccaggctggcttcctttatgcccttcataagcatatggctgccagattaatatttttttcaacacagccctgatcctgtcattctacaattgagttcctcacagtctacctgatacagagacagaaggaatgtgataatacaaataataatggtactcacaacaacaataaatgactggtctttgatatttaatctctaatatcaattgtcttgagacaacaaggctttttgaattcaatatcagagggtttaactgtgaggtacttggcatgggtctgaattgcatgtatattgtatgactgattgaaagaagattatctgatacacatgagaagtgtggaggtgggagctgacattttgttagaagtgcatgcctggcattttgatatactattgcacctcctcaaatctttttaacagaaacaaactactttgtgatgatagaatagcataatacaggacagcggaaaaatcttagtgctttttgttctggttttgattttgcaactaaatatgtatgataaataggaaattagtgcattggagcatatgcatctgttaaagcagattgactgcttggttatcacactataaacaacatttttgaagaattttaaaatttataatctctgatataatgttaaatgaaaaataagatacaaagc

SEQ ID NO: 109972 - DNA, 1045 bp, Homo sapiens
gatttgctactgtgaattgtgctgctataaacacacgtgtgcaagtatcattttcgaataatgacttcttttcctctgggtagatacccagtagtgggattgctggatcaaatggtaagtagagctctatgatgttttgatactcttctatggcatagacttagtgctcccatgttctaagtgttatgaaaggctgaagataggaatattagaacatggcccccttcctgagttatatagcttagaacaatggtactcaaacttaagaatgtgtaagaattacctaggccatagcacttacacatggaatatcaagagggagaacagactaggagaagacgtttgaattcagctgcccatgtaaagtataaagaattatttttacccagaatcttgaaggggaaggaactgagtcacacagacaagaatgtgcctaaagcaattcagcagttcagagtggaatgaaaaggaccctggttccctgctcttaagccagtgttctttagctggctagaactcagctctctgtttaaaaaatgaatgggttgcagtggagcgctgtgttccaagtaggatttgtaagacttctggaattctgaaaaaattctactggttttctgcctgtttctctgtctatacttgaattcactgaggccaaaaatggtaactttttacccagtagctggcaacattcctggtaattagaaagtgatcagtaaatgctcaatgactatctgaatgattgcatttttcaaaaagaaatctgaagtctaaattttgagccaactaaacatcatatttctttggttttgggtggtttgggaaaaatccaatgtgttctctgaaaggaaaacatatttggagatatgattatttttttctgtaaataaagttactttgttgtaaatataaatatacatgctcattttataaaagaaaatgaaaggagaaaaaagagcaaaatatctgtattgacaccactcataattaccactcataatttttgttttgtttttcttattcacatataggacttttatcatga

SEQ ID NO: 109973 - DNA, 1098 bp, Homo sapiens
taatagtcactcttcatgaaaacattttctacccttcctcctactctgtggcaaaagtgctctctccttggaaattatacctttctgggatccattccttttatccatctacaatcagtggacagacaactccattttgaagaacaaatacgttagaagaagaatttttttctcctatacaatctacagtgtaactgatacacattcaaatcatcgtaatacagtgatcattataaaatgagagtgttttctgcaaagaggaaaaaaaaaactgagcaaacatctagtgactttgttaggagcttaatgtgctctaaatatgatgtccttcaaatattttatttgaaatatttgataggtcttagaaaattttgctcatggaattctctgagaactgtaacacaccacctattcctttttcgctttgctttcggtcacccaaatttttttagaaatatgtgaacgagggtctgtttgtttccactgaagcaaatatagccacttgctcacactggtggcttcttttactgaagtccgtgaatatgttagaaactcttgtatgaaaatacagcaacccaatttgtccctattgagcctactttgtgatttccatgccctgctgcctggtgtgtatacactgagatccactttgttaaagaacaaaactgggtttgttacttttttgtaggcttattattaagtctgagcattctggtgtgaggttaggaacgctggtttcagactctggaaaacagagttctaatcctgaccctctgaagaccttctcactttgggcaaatctttcctgagccttgtttccttgaggaaaatgtagagatgtgtgatattcacatttcttacgccctacagttatgtgaggaatactgtatgtttcagttatgcacagataaattagttatttcttctcaaagaatcctctgttaaaaattattccccaaatagctctttttcgacacttgtctcaaggtggtcacattttaatttctgccactgatacacaaatttcagtgataagaaacccctgaatgacttgagagtttcctgagagatgggatcccacctattttattatctttt

SEQ ID NO: 109974 - DNA, 1032 bp, Homo sapiens
catattttttcatggtcagttataatctgaccaaagaaatgcatttttcttgggatattaaccttcattcattcatcaaatatttgttaaatgccagcttatgggctatgatatgatgaagcataatgaggaagcagcagggaataaaaaggacagtctctactagtatagaagcagacatatgcacatgtgatatgtacagggagggagaagtaaagagcacccactgtgctggaggattcaggcaaagtttcacggaggaacctgacattcagcttgagatgtaagacattcctaggaatcagctagataattcaaagacaatggagaagtgcattggtgtaggtatcattgttgagatgtgagagagcttggcacaatagacatgaaagaaggtcaatgtatctcaaagagaggtagaagaggtggatttgcatccatcattcccctaacctgttgaagatttttgagcaggaaagcaatatgattagatttgcatttgcaataaatcactctggctaccaaatgaaggactcattgaaaaacagtcgtggacattgggagaccagtttggatgtttttagagaattcataatgaaaaatggtggaatcttggcatgggattgtagtagtggaaatggtaaaatgtggacatatttgtgagttatggaattccctatttagagagtaggagcaacaggatttagttcttgaatggaaagtaggcagtctcagaaatgattcccagtgttctcctttgagcaacaactgggtggatgagaaaaccaaatgaaaagcagatcagggtggatgatgaaatctgtttttaatatattgagtctgaaaagcatatgagacattcaagcagacacatgaaatagacagttgaggatttgggcttagtattcagaatacagatgaattctggagacagaaattctaaagtcttcataacatagaaggtatatcaagttgtggccatggtcctggagacaatcgagagacaaaagcagagatctggtgtcaaataaa

SEQ ID NO: 109975 - DNA, 1035 bp, Homo sapiens
gacgctattatgaaggctactatgcagcagggccaggctatgggggcagaaatgactctgaccctacctatggtcaacaaggtcacccaaatacctggaaacgggaaccagggtacactcctcctggagcagggaaccagaaccctcctgggatgtatccagtcactggtcccaagaagacctatatcacagatcctgtttcagccccctgtgcgccaccattgcagccaaaggtaagaaactcagtaacataaggaggagaatacaggggtgcctatcttagtctgccttccccaggaagcgaagcctaaggcaaaagtgtgtgtgttacttttatttcactgacaaatacaatcccagggaaggatgagtgaagccagagaggagagagagactacttagtatgttactaatatggccactgtttagtatcaaatggaattgcttgctcaatctcagagaatcatcttccaaagcccacagacaccatagcatctgaggacaaagtgttctgatggagaaagagaaaataatttatttttcacatccttccctatattggttaaagcttccctctgttgtgcagaaacttcctctacaccttgcatttgcttggacattaaacaggtctgtagtatctcaagcctcagcaagggtagtgatctatgggtgagacatgtggagggcaaaactgagtgaactgctgtcaggctgtggccctgtgaaggcgattataactcccgcaatgttggtaccacagcggttgctgggccagaacaagtggccaaggacccaggaaatgggtgaggccaagcaggtctaagataatgcaaatgccttggacagtttctcctttgagaaggggctgcagtataatgcagcttgtttgtgaccccttgtttattcattttactaatcctccagaaagaatcttattcttcagcctttagcactattaagcaatgtttaaaaactccttatgagtgacagttacttcttatttgatttaattgtccatatgtggaccttttaagt

SEQ ID NO: 109976 - DNA, 1049 bp, Homo sapiens
aaaaagaaacagcgtgatacaactttaaaggaaataagttggaaaaaataagaacctttcctctccacttccataggctagcctacgtaaaccatcagacatagaagcgattttcagaatcataagtcttaaccccttacatttacagatgagaaaactgaggcctgaagagttacagtgactttcagagttatgtggttagtaaatgacctcatgtgaatgcaaaatgtaactcttctattctgcagttcttctctatattggttaaggatagttcaagacagaggaggtcagaagtaagtgacctttaaaaggtgtaataataactattgtcaggatgatcttatttcctatctttagaaccccatcatcagttttgtaaggccactgaataatagaaaatggttccgattctggtgctccctattctgtctcacagctgctcctgtgaaaacactcgttcatgggctctgtgtaattttgactcagtccataatctctctatcctgattttaaaagttatcatcagaatggatgtgctggtatactaagaaatgtctgtgaatattatttatttattttacttatctaatcattttcatagatttggttgtttaaaaataccccaggtctcaaatccctttggaaagttcagcaaatcattttaacaggtaattctggcaatatgtaattctttgtgtttacagagtgagagaaattctatttatcagtgttttttctttgttttgttttacttcagttctaagcaaagcagttattttgcttattgacatattgatatattcctttgggaatctcatttctttcttggccagctacaaacactcatactgtccaatttcaacaagagactatggttattctcttcttcaccaaacaaagaaatttgaaccattattgataaataatttctggtgaatattaaagctttgaaatgttttgcacacacagtgttaggaagtgtcttagagtgaaagacactatttttactactatagtatcaaaagtgccattgtcccacatacaaa

SEQ ID NO: 109977 - DNA, 1006 bp, Homo sapiens
tccttggataaaaatggccaccttctctctgtgtcctcacatggtctttcctctgcttctctgtgtcctagtccctctttttataaggacaactccagtcgtattggattaaggtccaccctagtgctctcattttaacttaatggcctctttaaaggccctttctccaaatacagtcacaatctgatatactaggggttaggacttcaacatattaatttgaagggagacatgactcagctcataacaattatgtaggcaaatgaacatttattttaaatgacagaggaaatgcaacatgttataaattaataaaagctatgaaatacctcaaaaatcacattaataaaagctatgaaatacctcaaaaatcacaaaaatcttgaaaaataacactcttatgaattaaattcctgattactttttcttacatttttagcagcatattcattgattaactaactgtacaacctaatttcataatattttctgcagagagaatacaaagataatttcatgctgagagtttattactaccagtcctgccttacaacaggtccttaagggaatgataagcatgaaagactgttacctacttctacaaggacacctttaagtacatagcctgctaacactataaagcaactatactatcaagtctacataagaaccaggtaacaacatgatggcaagatcaaatgcttatatatcagtattaatcttgaatttatgtgggctaaatgccccacttaaaggacaccgagtgtcaaattggatgaaggagcaaggcccaactctatgctgttttccagagtcccatctcacatgcagtgacacctttaggctcagaataaagggatggagaaagctctatcaagcaaatggaaaacaaaataaagcagaggttgctattctatttcagaaaaaacagactgtaaaccaacaatgattcaaaaggacaaaaaaagggcattacataatgataaagggttcaattcaacaagaa

SEQ ID NO: 109978 - DNA, 1019 bp, Homo sapiens
gctggagtgcaacagcgtgatctcagctcactgcaacctctgcctcccaggttcaagcaattctccctgcctcagcctcccaagtagctgggattacaggcacctgccaccacacctagctaattttttgtatttttagtagagatagagtttcggcatattggccaggctggtctcaaactcctgacctcaggtggtctgcctgccttggcctcctaactgaagttattttttaaattaaactaatacatgcaactggcttaacaaactaataggactaatgagtctaaaacaaacgacataccctccgtgcttctcctctctccactctctcaatcctacttcacgaaagacactcttggctgcttcttcctggcatttgcacagcttcatgtctaaaacagaaatgcatttctatctttggaggcataaatcttagacattatctgtggattaataacacaaaagacacggatatgccatccatataaatgtttgactgtttagagcttcctactctgggaaggattgacccatctccctccaaaattgagaaaagggactttcactggacattatcttcaagtccttgcagtgttccagaaggtgtgacaatctggtcctttggctggctgcattactgacctgctgacctgctgttttaggttgattatatttgcctttgagccaaaagagttacttgatgatactccagagccccatttccacacaacacttaggtttaaaagctgcaaaaatggatttaatgaaataatgatggagtgatttgaagatttttcatgtctttcaggaaacacaaggtgctcttagtgaccacagagctagcagcctcccctgcatctcaactttatgtttccaaatatagtctagatgcttagtaagtgttaaaaaataatagtgcatcttgatgcattctttatggtgtaaaataacctgttaggtagcagggataatttttcttcagcattagatggctgtttatgtatgatatatttctc

SEQ ID NO: 109979 - DNA, 1050 bp, Homo sapiens
atgttgactcaatcctgtccttatgtgaaacaataaaaatattttaaaactttctctcagttatgcgacatagtgcttttctattttttcctaaactggaagctccctaaggggaaaggatgcatctcatagaatctcaaggtgctcagcaggtaatatgcatttgagcaatgtttcttgaattaaacttgctagccttatttatcctgaagtgatataacatcgttgggctgcttcaaactgcctttatcctgatgggttcaactggcacaaacagttattaagatttgggagagtcagaggtcccatagataccatggactttgctgcatctcagttcttccattgcatgcctttggaaatctttcctgctggtgaggttctgtgagggactgtggcctgatagaatttgtttcatttctgtttgtttttattctttagaaaggcagagtagaaaaaacagtttaatgagataacaaatagaggaaaatactttggacttactgtttaaatttaaagattgactttatggtagctattaatagttccaacatcttgttgaatacccaaagcttaattatgtaaagagcttcttatttcctctctcctgccccttttcttctccatccccttgcaaagcaggcacaaaaattaaagctatttagagatatgtgaatcagcatattgcctatatctaatttatctttgtgcaatgcacacattcgtgaatttctcaaagccatgtgactctccagaaatctttaaatatgtaaataatattataacgtcccttagtgaatagcagatgcaatgcattattccaggtgtctgagtaatgcgaagaaaagatcaaattccctgttgtactacctgtgtcacatgttacattaataaacacagtcagcttgcaagaatagtatgttatctgaatttaatgaacttctgaactgaatggaatgcatctaattgacaaactgtcatcaaagagaacagaagacactacaaagtccaaagggaaagaagaaacaagtggggagaaaaacaaacaaa

SEQ ID NO: 109980 - DNA, 1195 bp, Homo sapiens
gcctgccactcacctgctaggaacaggccaaggaccactatcagtccatagcctggggattggggacacctgttacagaatttatactgttaaatgtcacttgatatgcacactaaacctattacaaaccacatattgtcacttgtcataattggacagagctgcaatgaggttttggttttaagtgccaactcacctctaagctttttcagatccttgagctaaaagtgtcctctttctgaaatcctattaccatttattgtatatctttaatgaaagttttagtcttttccttcatattaatgttattcacccatttggcttagcacccctcttagagataaagctctgtgaagatgtgtttcttactggttcatttcggcatgccgctaaatgtgtaaaacctagaagatatcccatagccttgtttgaataaataaagttacacatggtgtttcaagttcacctatttctttgactaccaaaagacttctggttttaataaaacaactgtgaagttcaagtcctgtgtattctaacactttgatttactcaatggcctgatagaaactgtttttaaaaattatatttacccttagcattttcctgagtattgtctttagctattggtggggaagatggatatatgtgtatgtgtgtgtgtgtgtctgtgtgtgtgtgtgtgtgtggagagagagagaagagatacatggacccattgccacaatcttttaattatgtgaaacaaaaaatatttaaataacgttgaggttatccatatcttctgtattatattctgtgttactgatttttttggatcaaatagtgatttttcatgagctaggtataaaaatattaccagggactaaaattaggggaaactgggagtaacttagagtgtagccagttgtttttctactggtgctaccggcattgaaagcaagagagttcctccctgtgtggggatggcctgtacatggcaggacctgagtgtgccaggtctccagcctttacactttggtagcatcttccccacacacccagtgtagtacgccctctagagggatccatttcttcagtgaccacgtctttggagagccactgtctagatttttagtgcacaaaaatggagtgtgattaagggttttctgaggatggtgtattgttttatgttttctgttgctccactcaaatt

SEQ ID NO: 109981 - DNA, 1001 bp, Homo sapiens
ttcattcatgagtagatgaataacataagtgtcctgactcaaggagcttgtaaactaagaattgtaatgttataaactatttatatttctctagtattttacaaattaacaagcaaaattgtgtgattctatttgtagtcaagtgacctcagaagctattcagtcttcaccatttcctaacttatgacttgatctcattctagccagtgacgctctatagtattatatttattatgtcatccttaacggtgtggaagttgaaggaccagaaagattcacacagacttgtctttgttcacaggagtagacccatgcctctagatttaaaaggttcatcaaggcagtataacttagtagaaagaataagaaactgtaagtctggggtgggatctggcctcagtaattctctggctgtgtaaacttaggtaagatgcttaattttaaacacagtatatccttctttgggaaatagaatataccttacggatttctttataacaattatttttcaacaggaaagaaggaaagagaaatgcttgcatggagccatcatttattcaacagtcactcatcaaatacttgttgaatgcttactcggtgccaatcacttgtccacacactggaagtcaggagtaaatacaatcataaaaattcctgccctctgggtgcttacatttctggttgtgttatgctgcagggagaaagaggagattttcaaaggtaatagtacctaataccatctgaaatcctaaaatttctgccttactgtcttccacctaccatccccattggggaaaccttaccttagaggaggccactatatagtggatatataatagtgtttgtattttatatcttttatcactgttttctgcacacagtaaaacagtgataaaagttatcactttcttaagattttgaggttgctgtacattctcatttgtgaacaaaaactttgctctgattacgtaggattcatttaaaatccatggaatcttttg

SEQ ID NO: 109982 - DNA, 1064 bp, Homo sapiens
gtttcctgttgtatcagaaactagtgagataaatattagtaatttttgtcccattgacacatgatggtatatcaggaattctgagctcattttttttttttggctcaataagtgaccttagaaaatccagaatgggatttttaagttgaatatccttctctgacctgtgaaatcactgcatctgtttccctgactttatcacaaggtaacccaagatattgccaatatttacatgtgacaaactctgaaagatgtgcataatgctcccaaaggtcatcatcttcatacctaccttataaagtgcaaatggaattgacctagtctagaataagcaggcgagatgcagagagattatgtgacatagctaggtcatgtgactagtatgcagcaggcttggggcataaatcctagtcctctggctcccgagtccagtgttcattacgctatgtgacatgtcagtattgctgtttgctcggggttaggcttttcctttggaggttagagcttgataactctaaatcgataaacttcttagtatgccacagtaatgctagcagaaagtatttgttgaagcaaaaaatatgttgtttcaaggggtctgctccctgaaagataagtttttttctttatttgtggttttacatctaatttttctaatgtttcaaaaaacattctgtgttcctttaatctacaagttggaatggatacggtgccctaattttcgtgttccctttgagcacaagcaataacacattttaaaggatgataaatagctgtgtaaaatgtagatgggttctataaatacttaccaaaatccctgtagtcagaccctggtagaaggagagaatagtcaaagtgttctctctttccacattcttcttcttcttttaggggtagtttggtagttaagaacacagttgctagacccagacagactcagacttgagtcttgccctacctgtactacctgttagattttagggaactccttaattttcatgggcctctatttgtagaaggatgctaacaatattatgtgtagtttttagaacattcatctagta

SEQ ID NO: 109983 - DNA, 1010 bp, Homo sapiens
cacatcattaaaacattttacttcggattgatggacatttttgtgtgtctaatattttctactatatcttctagagggcaagacctacttctcaatatctttagcatggcacttactaggcactcagcaagtgccctttgaataaatgtattatttgcaatcatctcttcaggtatatgtagtttttgtgttagaagcttgctaggttgcatcttgcaagagaaacaatgtgatccttcacatgtacttgttcttctccgaatgactttctatgcaagaagcactggaggctgagttcatacgttcagcattgtcagcagaattgagtcctgaatgacctgggtcagtcactacattagatgatttgattagaaaaaagaataaagccagttataacttgttttctgcctattacccaggatatttagaatgatggagatgcagaagcatttagagtttttgatgatactcatggtggtatcatgaaaataacaccttgtgtgtttatggcacataattacatgaaactcattttattctcattagagtgtcaccttgaatcctgttctttttggtcttaatgtttagtgattagaacttgggaagcaatttctagaaccagaatggtcgggtacaaatcctagctccttctcatatcagctctgagaacttgggcaggtaatttaacttcatgatgtctcaatttcctaatctgtacagtggggcagccagagtacttatttcattgtattatttgagaagtgggaggacatagtgcatagtgattctataaatattactattgcaaccaccaggctttgcataaggccctaagtcaagaaaactttcaccgtttaacagagatgtttctctctgaaaggcatgttatttgagaaatagttgttgagatgaaaggggggaggcaagatagaggccagcttgatgagggctttgaactcagccctatcaacaagaagaccatagggctgcatagactgaggagaaacact

SEQ ID NO: 109984 - DNA, 1034 bp, Homo sapiens
ttcccacctcactatatcaacggttggggcaaatgttctctagcatttctttcaacagtaataagttcaatgtacaaacatccttaatctaaagtataacaataaagctaaacataaattgatggagattaacaacaatgcatggagaacagtaaaacaaaacatagaaaatccacgaaggtttctagttacatcaaaatacacaaaaagtttattaatgctcttgtcattgccatgtgaggagggtttataatggggtctaaaatacattttttaaaagtgaaaaataaggtctctgtatttaggtcctattaaaaaggaaaagctgacttaccaagtatatatgcttcaaatatcatagcaacaaaatatattgccacaaaaaaaaaactgaacatagatgctaattgcatgaatgaatatatattgaacactctgggaaacagatataaattattacctttcccttcaagaactgtccaagctctactacttagtagcttagaaaacttgaacaagtattattccctctaaaccttcatttttgttttgttttatctgtaatatgggaataataactagcttatactgttgttttaagaaatggatgaaatatttatacaaagcacttagccaagttcttggcatgtagaatatgctcaatacaatactcaaggttctcccatgctcttggggcttatagtttatttaagacataagatatgctcgttaaaaatccattaataatgctcaatttaagtttaagttcctagcaacaatagaacgtatgtcactggtaagtaatcattgccaaatggggatgaataaccatttgagaatttggaaaaatggctaacttttattgagtgcttatgatatggcagcactatattttatttacattataggaattaactcatttcactcttataggaaaacataaccctgtgaaatagatactattatcattttcagattttgaaattaaggcacagaaatattaatttgcctaatgtcaacagctaatacattgc

SEQ ID NO: 109985 - DNA, 1046 bp, Homo sapiens
tgtttggaagttagcgtcttgcatccaacttctaggtctacccctagattatcattattattattacatgatttcaactaacatttatataatgctttttaaagcacttttctacatgttatatcacttgagcaagacagcagtcctacaaaatagacagtgtgtttatttccatttgggatatgaagaaatgaaagatttcagtgattaagggactccccactccccagggctctccactaccctcacaagtcataaagcaggtaagtagcagaattgccctggggcacaggcctacagactttaaattcttttcacttttcaccccattgtgctgttaacaccatgttgctgaattggtcatgggccataagatagatgagttaacatacttcatgttttagctttttaatctgtataaggaacgatgtgattactttgtaaagtgcttagaggatctcaactgagaggtgtaaagtaatttgtatttcatagtttgtgttattatgtgacaagaaaatggtttccaaagtgcttctatcaattacaaactgggaaatgactccaggtaggcagctacctttagtggatcttgttttcacagataaatgacctaattaatgaaaaaccccaaaaccacaatggaagaaaaattagacaataagtggcttagagagaaggttgtattgatttggggggaaaaatgggttttttggttttgtttctctctaactttttgtttagggtatctttgagttgtgggaatagaatgttctctagttaatgaggcatattagatatattttcttttgtggtagtgacttctggtaatgtttgttcagagtagtatatgtttacagcactaaataaataataattctgagcattttatgtgttctatcttagcatacattaattttttattaatttggctagtgtgtttgtttgtttgtctgttttgtgtcagagtttcactcttattgaccaggctggagtgcaatggtgcgatctcggtgcaccacaaactccacctccaaggttcaagc

SEQ ID NO: 109986 - DNA, 1031 bp, Homo sapiens
agtcagttattcaaggacacacaggtaggtctacaatttaggtgctctaacttcatgtctaaggatcttacccttatcaccatcccagaaaagcccaaagtagcttgggtctgaatttccactttgccacagtaaccttgagcaagttttgcttctctttgcaacagtttgctcatttgcaaggtagggatgattataaaagtgtctgtgatagggggttttggaggattaaataagttaataatacatgcaaattacttacagatgtgggctgacacacagttaatgttcagcagtactgagagtattgaaacgttatgatacaggctacttaggttttgtgtatttgaacataaacttcagaccaatttctggtgatgaccacgggtaagatattctgtgttttagttaagatgatttccagttaagatgttgaaatattaaatacttttcttgggtcactgaataattataaaatatattaaaataactttgatatttatttcattcatagaagttctagacaatccagtctagagaagagttatgtaaaattctacaccagaaatagaaccctaaccttgaaagacagggacacttattcatatatgtatgtctaacacaaatgggcctcataattgttgacagccacttattgagcattgaccatgtgccaagcagcatgctgaacacttcacatagctggtcttacttaatgctcacaacaggtaagcattcatatccggatttttcagatgagaaaattgagtcttaggcagttcagtaccttgtccaaggttatacggatatcaagagcctagatcttcataagccaagtctctgttctttttgctcagcaaatacctatttttaatgaggatgcttttctcaactagctactatattctgcaaccagtctgcattttacactgctatcctttctgtgtcattcctaatactcattcatagaattataagatcatagattgttaaggctggaggaaacctgaggagtttcttggttctcagca

SEQ ID NO: 109987 - DNA, 1204 bp, Homo sapiens
tgagatggagtctcactgtgtcccccaggctggagtgcagtggtgcgatctcggctcactgcaacctccgcctcctgggttcaagcaattctcctccctaagccttcagagtagctgggactacaggcgtgcaccaccatgcccgggtaactttttgtattttcagtagagacagggtttcaccatgctggccaggctgatctcgaactcctgaccttgtgatccacccacctcagcctccaaaagtgctaggattacaggcatgagccaccgcgcctggcctgtctaatcttttatttaatgcatctaggctcctcctttcttccttcatggtttcctttttcctacttccctatctcgttttctttccttcttttcatttacagagaaatggtgttagaaatgaatgagaggagtgagcaaagaaagatgagggaaaaatagatgtgttaaggagtatacgcataaagaaaagaggccaggaggaaaagctgttcaccccgactcccatcctaatcttgcgtagtctttcgtttcctgagaatagttaggtcagaagttacagtagaaactttcatggaatacacaaaagggaattaagtaaggaaacttgtgaccgatgctatgggaaaggacatgtttgtcaaagcaataggttcttcctgagttagagaacaattatggttcccccatggaaatgtttatctgacgcaatgagaaccaggtcagacacaattcagaaatgaaatgaataaaattattctaagatctagatgggaggagacataagggattgtgttttgatagtcttaagggtgcacttacatttacatccccaaattccctcttccatgaaccactgtgcactgtacattgccacattaatgctaactgtgccaattagattaactaatattggtcaaaaaagaatatcctggccgggcgcagtggctcacgcctgtaatcccagcgctttgggaggccgaggcgggtcacggtgaaaccccgtctctactaaaaatacaacaattagctgggcgtggtggtgggcacctgtaatcccagctacttgggaggctgagacaggagaatcgcttgaacccgtgaggcggaggttgcagtgagccaagatcacaccactgtgttccagccctagcgacagagtgagactcttatcaaaaaaaaaaaaaaaaaaaagaatatc

SEQ ID NO: 109988 - DNA, 1015 bp, Homo sapiens
atcataaaggtgttataattcagtcattcttccacataagaattattcagaaacttatttctaaattatttttatcaaaaaatgttattctattttttaatttgaaagaatttaagtcttgaaatttattagtgacatgtaaattcctgactgagcattatgaaacttgtttagttcattgctgaatttggtattttgtcagctgggaacactaaatacccccacttaacttgctatttgtgaagctcagagtagcattggggttcctgtacactttggcaattgccccatggctaatttggccaacttccaattcctcagggagcaacaaagagttgtctcattgccacctgctattaactaaatgcttaggattcagtgtcctaggggtgactgggagacatgggaatggattattgtaacagcctgtggaacctccttccctggggaattttgagaacagcaaagaaccatctgtctgggctggttttaggagcagccctgcctgaaggcaggtgcacggattagatgacctgtgaagattgtcatccatcccaatgacttcaatggaaaggatgcatttgctgaatttgaaaagagtccaggaggaacactgataggtttggggagcatatggtcaagagcctgagggtattgagcccttcttgaaattggagacactcggtgtcaccccatgccctgaattccagaatgccataatctacacgtgaacccagcagtcattcacccttgaaaattatgtgcagatgtggttcacattggagtattcacgtcgttgttgatcataagcagaattcctttttaacacatagctcaactgatctatacccagaacatactgttgaccctgattcttctggttaagccggatctgcctgtataatacatcatttactgacccactgacattgagttttcttagcttgtttctcagtggttgttctgtgtttgtttcaggcaattaaatatgttgatgcatgtttcagaagagctc

SEQ ID NO: 109989 - DNA, 1030 bp, Homo sapiens
aggtagaaggagaaattcctcacaatcaggcaacagcgcctactagtgggaagaaactgatacttgaggtagggcacctgggagatagctctgtgcatcttgagagagtgctacactgagagcccaaaggctctcaggtctcatctctcctgacagcttgctatgacatcttaatcaatgaattgcctctctcttaccctttgttatagagtctgtaaatgaagagtttggaatggctactttctaaattttctacacgtcctatgacccttgaaatcctcttaacaatgtattatggatactttgctactaaacggtaaaacagaatcccgagtaagatgaattggcttcctaaggaagtagtgtcaggggagaatagcaccatctttggggccagttccatttatgcaggtaatatggtatggtccagctcaaagatcactggactgggctgagttgcaactctgctacctacttctcaagtcatgtacaaggtcattcctatgttaactcatgtgttgggaagatgataattgtctcatttagcttttagttattataagattcatatgagaatatagaaattatgaagttttatgtgaatctgcaaatttattttcagtctttatatatcacaattttaatttaggctaattataatttttattttcccctttttgttctatattctaaattcgtatctcccatggaggcaggtactgtatggacaaaatcttttattagtcacatattgttttcatccattttgtgctgctatagcagaataactgagactgggtaatttataaagaatgaaaatttattttatcacggttctagaggctggtaagtccaagatcaaggcaccagcaggcttggttttctggtgagggctactctctgtttccaggatggtgctttgtgctacctcctcacatggcagacagtggaagagcaagccagcagaatgccgcatgaagcctctttcacaaagggctttatcccattcatgacagagaagcccgtatgg

SEQ ID NO: 109990 - DNA, 1071 bp, Homo sapiens
taagatctcaccctacatttgaagtgcccagtagtttcaaggaaactttacagaatctctggacttgtcagtcctcttccagaatactgggccctttgagtccatttttatctaccaaaatgtttcttccccctcttatccaacaggtttttaatgatgcaaacaggggaactgtttattataaagcaccttaaagagaaatgaacagtaatgctgactgagctaatcattgttttcttttattacagaacacaaaaactatattttaataatatacctgggtaactaaaaaattctcagtcatgttaccttagcgttttacaatgctacttacttaatctacctgttaaactattctctggtagagtaatttgatgaatgaacacagacttttttcatctattgtaaatttctttgctatccttcagcatgattttaatctttgtttaacacatgttgatgggaaaagtagtgttttttgtttgtttgttatgtaaacccacaaaacagtcatggtttgtccctcagtgcccagagatttcaacataaaagacaccttggtttctttaccaaggtattgggagtcatacttggctttacaaggttcacatttattgaagacgtttttggcctggttggtattttcctataacttggcagctctaacccattgtaaccttggggtctgtagcacagatctgaaagttcatcaagattaaggcttcgtaggattaaatatggctttgcatctgtcttaggttcaattttatttcgttttctttccaaaggtaacttaatacatgtaacatcatttctttccaaaggtagcttaaacacatgtagagccatacagtggtagagttggaaaaaaaatcttaaaatcatttgcgtaattactctctttagcaatgagaatgccaagacatacagaagaggaaagcgacttcgtatgacctatcattagtgtcagaaccaaggctgcattccgttattcacgctccacagtcttagattctttgcagatgctacatggttttcattttcctaaacataaagataaacaaagtaatg

SEQ ID NO: 109991 - DNA, 1044 bp, Homo sapiens
actggagaaggtctaatctgattaaataataggtttctacagtgtgtgggctcaagtttctatctccattccaggcatagtatgggtctctgtgattctgtaggatgccagccccttcttctttggtttgttgttactatactatgcttatgagaaggaaaactatccgggagatatttaatcgcgtacttggaagaactgggtgaattcaaataatggaaattctaaccatttttttttttttacttctttccctcataagaacatttaatcaaggtttttctttaatgagatctattcgtggtgactctaaaatgtaatttaattcttatcagaattcagttaagctttaccaaagacccttgttcaatattgattcgagttcagcacagtcctcaagccctcagatggatgtatcagaactttaatttcttctgaacttttatatgtccaataagctgcatactagaagtgtaaggaggttgaggaaattgggcaaatgaaataaaacaagttggctttgaagatagtttgcattaaggagaatcctagaactatgcgtctctcttggaaccaaaagccttagaacaggaagcatattctgtgtgatccagcaaaattgcctttggttacactgttgaaaactgatgtctaaaaggtattccatacaaaccagagcaaacctagcccttggccatcagtcagtgtgcctgtcttttttttttttttaattgatggaatgagaatattcaagatagtggcttaattatttttgtataaggaccagcatgtttgatactctgagttcaggaatgagaccagtctaatgtaaattaaatttacttctgcctaaattggttgttgatcaacttaagatcctattaaaattaaaaatttacatgattttgagggaaaatgcaccagtaatgtctgcagctttggttcaatgatttttaatattttcctgtggtttattgagtttgttcttaatctttgtgcttaagtagttatgattaaacagtttgattcagtatagcattgtaa

SEQ ID NO: 109992 - DNA, 1070 bp, Homo sapiens
tgtttcttaattttaaataaatggcattctattatttgtattagtgggagacttttccactcaacatcttaagactgtatgtacatatagtcatttacaaatgattgattattcttctagagaacctgaaaaattttaaatattggaataatgaaagtttagtaagctgacaatataaaaatgacaattttaggtttagaatatataacagaaaagtgtcctcatacagaagcaataaaaaatataaaatatctaggtaaaactttaaaacgtataaatgatctaagtgaggaatgctaaaaaagttttgcatgaataattaactcatgagcaaaaagggtattttggggattgaatgtgctttggaaagcctctctcactttaatagacattcgtattatcaccctttattatacaacaatgttttcagtgggggaatgaatagttactacactctcctttgctagtggtatttatttagccctttcaaccaaatatcccccagccctctgctcatcttagttactgctcaccacatccttgcacgttccaaggcagcccttacttggtaaggaaagagaggcacagacctgtaagtggattgcccagaacaacaaagaggcctagctgaacataaccctttcttcccagttcctgttgcaaaccgtattaactgctgttgtcatagaattagaatgctttttaaagtccagcaggaaccttagaaattcaataatgccattttatagctgagaaagctaaatcccaagaaagctgagtgttttgcctgaggttatacgatttattaacggcagaggtgggactagaaaccatgagtcttcatgaggccttcaaagaactactttctttgggaccgacatgaagggtttaaacatttgtggctacaggtccagagagacatccctagaaaatgctgagattagtaagattttggttggagagtgtagaaataggacagcgtttgctttcaccctaaccagaatgaagggtctcagatttccaggttaaatgcctctgaaactttattctagaaccttcccactgcccta

SEQ ID NO: 109993 - DNA, 1001 bp, Homo sapiens
cttccataaagtgctttttgtcaaagtctcttctggaattaactcctcatgcacagatcgataaaccccaccaacttgccaatgtaattaagaagtgacaggttaagcataaccattaattaagttcaaagtaaaagaaaatgaagaagattgtttttgtgaaattgtgctgtcagatttttctcaagggtatttctgagttcctataaaggggaatttaggaaagggaggagaagattgtctccacttccttgggaaaagtgagtgtttaaacacatgtccattgaatatttttaactgaaaagtgaactatttgccagttttaagagacattgagtgagcaccttctgtgtgcaaaagactgtgctccgtgctatgcggaatacagcgcagtgtgagacttgttcacgctctcgtggagccctgaggtgaatgagaagtatcagacatgtgaacaaatataacacaaggcaaagtaatccaacttatctgtgagagattcgggcagttgtgagagctcagaggaaaggccatgccccatcctacagtggggagaggaggggactggcatcgagaaagacctcccagaggatgcagcatttgagcaaagccttgaaagtagagtaggaatggataagggggaaagaatgaatgagaacagttccaatatctcaacatttttttatgttgaattccattatagcttctaggatcaaaggaaaagaaatcagcctcttgttcagtaaagatttgttgagcattcattatatgtgcattattctgcagaaaatttggggctgggagaggtaaaaaaataccttcaggataacaggctttttcacaaaagtatcaaatagtcttagactcattgtcttcctctgatggcatcttaatggaattcaatacaaaggccaaaattcctttgttttgaagccacaagaaaacacagccaatggaaaagccgtgttagtgctgcctgtcctattctgataaggtgaata

SEQ ID NO: 109994 - DNA, 1166 bp, Homo sapiens
ttaagtaaaatagatatctttttagtgagagagtttctaaatacgaacttattcaaaacagtaatgatattctattttagccagctaatactcaactacgatttgcaatttagagagttgtgcttgtatagattgtccctttctgaagtgagtgaattgtaactttaaataagggctgttaacacatcaaaatagtttttaatcagcctcaaaaattccccttatttccaagtatcttatttttactatttcattgatgtttcaagtggaatcaaatattccaactgttttccactggaagaagatgaatttcaggtacaattcagtagcaaagaacacccatgttttcaaaataatggagaaatttttttctcatatgaagttatgattaaatttgtgaattgcacaagcttggaattctgctgcaggatgcctacattctgtattgctttattttggtcatatattacaaatggaatatttcccagctcatttatatacagttcctggttgctgaaattttactggcaagctttgtgaactaattttacttctcaaagatactaggaataaagtgaaaatagggtcttttctctcataggtctaaaagatacttctttcctttaaccattacattctggaggtgtaattaatccaaccctgctgtagataggatctcattataaagattctaggtaaacagtctttctagcagaaatgatctttttggttcagtcttgcagcatttcctaaaattgctagtgtacgtagtaaatagggaggtaagtggggaaatttcctaaaaatgccagtgtacagagtgaattgttaggtaaatgagaaaatcaggcttgatttaccaaccaccccatgtgcacatacaaacaaacacacactcacaccaaagccaggaaccctgcaacaaagttctatttaccctgaggagatataaaactttgtgactgccactaaattatttttttgaaaaataatacagaaatttgtaagcagacacaacagctctagtttatccaccaaataacaatataaatgggacaagcaaagagaaactgtaatttgaagatttttgagtgtgatacttataaaagtgtgtgtgtttgtgtgtagaaatgtattgaatttgagagtaatttatggaaagtgct

SEQ ID NO: 109995 - DNA, 1084 bp, Homo sapiens
cacttttataatccccaccctaaaaaagaaggaacattagcagttaattacttcagaagttttcttcatgacaacctggttgtatgcctttcttttttcctaaaagtgatcactatcctgacttataataatactatatattagattaaaatacttttgttgtatatgctttttttttttttttttgagacagggtctcactctattattcaggctagagtgtagtggcacaatctcagctcattccaacctccgcctccagggttcaagcaaatcttgtgcttcaaccacacaagtagctgggattacaggcttgcaccaccacagagagcaatttttaaaattttgactagagatggagttttgccctgttggccaggctggtcttgaactcctggcctcatgtgatccacctgccttggctaggattacaggcattagccactatgctcaacttgttgtatatgcttttatgcagttttcttttgttctgttatgttcatgaggttcttctaacattttaaatatggccatagtttatcttcttctagaagctttaataattttaggtgttacttttaggtgttttattgttttgagttaatttttatataaggtgatcaaattttgagtaaaggtatttttccccccatagggatgtccaattgttccagcaccatttgttgtaatttaattaatcttatgcagattgtaaatcagatgcatgttacagaccatataaaccatagatgggtctatttctggattctctattctgttccatcagtctgttaatatatgtctgtccattctccagttcacacactgtgtgggcaattatcattttgcagcaaatctagaaatcaggtagtacggtttgttctgctctttcaaaattgtttggctgttctagttagttcacctttgcatataaattttaaaattcgtttgtcagtttttacaaaaatccttctggggttttgattagaattgttgaatgtaggtgtaaatctagggagaaattacatcttaacaataattatgtcttccagttcatgaatatacatgtctgtatttatttaga

SEQ ID NO: 109996 - DNA, 1054 bp, Homo sapiens
tcaatttttattttgttttggtggtttgttgccttcattcttttatattttctctttggagttctaactacatacaggcttaatatttttctataattctttgatgctctgttctcttacttttcactctttctataaatttctattgacctatctttaagtttactaattctttccccagttgagtctgcttatgagcctattcaaagtattcttcttctctgttactatgattttcatttctagcattttcattttattttcataagacagaatgagaaatattctcatatgacagtctctatatctttgagatcatgcaaattttcttcctttttcactagagccttaaacattaatcatagttattttaaattccctatctgatcaatccaacatctgtcttatttctgagtctatttctgtttgttgctttgtctcttgacagtgtgttgttatttttacttcttggtatgccaggtaagtttttgttaaaagccagacatattatataggataataaagataggctaatatatttcacacctgtaaatgaacatgccttttcttttgttaggcctttagtgtggggtgtttgtgtcaatcttgtcagaagttggccttgatttgaattttttgttgttgttgttgctgtgattccccttagtgcaccacagatttcaaatatctctaatgttactttgtctttgtggtgaggagtggttttccaaaaggactttctcagtatttgctccaccctcagatttagatcttctttttgtgcctgtaccacagagacaacttctttttttgtctgtctcccaaattttgcactgttggtgggaatgtaaattagttttgtggttgaacttgattgctgttactttttacttgatgcttttgaggcagagggacattttctgctgttaccttcagttttagagaggcagtgtggctgtgagtctccgaagcaggctgtttcagtgatcctgcctctccccgggactaaaatcacttcttattcttttcccctacctatgatgagttatcactg

SEQ ID NO: 109997 - DNA, 1288 bp, Homo sapiens
tttatatgtgagattgagaggcagcttggtaggatggaaagagtttagactttgtagttctactgccccaggtttgtatcccagctttatttcctaacagtgtagccttgggcaaattgcttaacctctccgaggctcagtttcttcaaataaaaaaatggaataagccttcccttgcagagttgttaatattatatgaacgttatatatgtgaagtgcccaactccttgcaaatacctaatatacaccagcttccttcccaggcttttgctggtcagatctggtttccacttaactttggctgttggaagataagataatttattatgaagataattgtctggtaattgtcatgagaattcagttgatgataattgaatgatttgtttacctttctgtctaaagagttgcaactcatgggggtcgtgtgtgtgtgtgtgtgtgtgtgtgtgtgtgtgtgtgtgtgtgttacttacaatgtttttgccatctcttcctgtatgacagtatttgattagtcaggtcttaaaatgctaaacactttatccttttcttttaatttcaattttagattttgggggtacatatgcaggttcgttacaagattgtattgtgtgatgctgaagtttgggcttctatcgatcccatcatccacactgtgaacataatacctgacaggaagtgtctcagccctttctccccctccttccttccttccttttggattcccaagtgtctgttattcccatctttacatccatgtgtacccaagttttcgctataaagaaaaaaaaaaccctgaatacctattgcatgcctcactgtagaggctacaggattcacaaaacaaggccccataccctgggcattgataaaaggaaggaaaaatgtagctttcaaaaaaatgaaaattgactttgttgaagggtattgtaatagaatcataaaactgagtgaggaaggaatgtattctaactacacaattagggaatactttgtggaggaggtgggttctggattttgaagacggagtatgatctttgacagatggtgttcggtgggaatgaggaaaaagaaaggtgagcttcagccagggattggaggtggaaaaaatgaacacatgggtggcgatgattcaggcagaggggcaggaatgtgaaggaactaagacataaaagtagaaagacagtttaggcctggtttatgagggggtctttgaatggcaaactcacctttggtggtccacgggaaggtttgttagaactgcaggagtgtgcccaaacctata

SEQ ID NO: 109998 - DNA, 1772 bp, Homo sapiens
gagggtctcatctggaaagttctattattagtaccacatggtcagtacattttaagatagacattttaataggcagaaaactgtatacaaggagagatgtgcaatgcagaataactatcaaatgatatctagatatcttagattgctactctaggccatccatggtcttaccccatgggttcctctaactcccttcatcctcccttaacattagctgtaggttttctcatcactgtctttgctcacgttattttctctgccttgaattccctccctcaagctccccacaccagcaccaccagcatgtaccctgttctttaagactcaactcaaatacctctgcctcaaaaacatattgccctaattgtcctggctgaaagtgacagtcatctctggaccccccccactctcatctctgcacctctctatgtcatccttaatcactttctgacttgtgttcttacatagttgaatatgccttatctctactacttgatattaaacttcataatgatgataagatcctatcttatcttctcctgtctcttccctgatcaggcctagggtagttcctcccacactgtactgttaagagaatacataatgaaaaagtaaatgaataaatggcagaaaccttatgtggaatgctggtgcaaacagttcctttgactgggggcttttaaaaagagactgattgtataggagatctgagcaattttcatattaatggaatggattattagagctggcatgaacatcaaaagaatctagccacaaccacctctcaggtcatcttcattttcaaatggggaatctaagatttagataggaccattccagatcacatagtgagtgattaatagacctaggactcatacctcatctgacatccaacaccacatgttcttttgaaataaggctggaataatagtgagacacacatattagacacatgattgtgagaagacagttttccaccccacagcacatgaccccatacgtttaagtccctgcctatacaaatagtacagacaaagtaacagcaactttagagggaaacatgactatttccatcatatggtgattctacagagcagaatcagaaacctgggtaaagagaaaagtcctactcagtttcattcttgttaaaagacttaatgactggagttcaaactggcggagtcattggcagcattaaagaagtggggttgaagctgggcaacatttccacaacagggagtggaacagagagacagaaaatattgggagtcttgtgccccatcagtagaaggagatgaaggccagagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactgtgtcctaggcaccactttagttcttgagtggtcagcagtaaagaaaacagacaaaaaaataataccctggtggag

SEQ ID NO: 109999 - DNA, 1041 bp, Homo sapiens
gcattcattcagcacacggagtaagtggatgagatctctcctgtcctgttcctgaggcaaccgctcaggaactctggacacctctggtccttccgaatcctcccaaatatggtgcatccggaacccacttgaaacacactgtgtgttaacctgccagttgagaagttctagactggagaattgttttgcatggttaaatagaaaaaaaaaacttattttatataaagtacttacctggactttattaattcattaactaactgatatttgtggagcattaattttatgcaagcatactgttgtagatgcttgggatccaacgacgagttttctcttgtcctataggagtttaggagacaaactgtcttaagatcttaacatgttttctctatttatttgcatgtaacttgcagatagcaagcctgaatgtcttctttctatttgaaatacagtgtgtgtctaccgatatacagattccatataatgtgatgtagcagagagagtctccattggacagagaattaggagacctttattgtaactcccaatctgtcactagctgtgttctctatctataccttagtttcttgaatccagcagttggactagaatcatggttttcagatagtacaggttccatcccttcatgcccttcagccagaagtgattttgggctctttaatatgtgctttttttgataaattgtttccctgaagaaaggattatgggtgaatggccaagtaaaagaaggtgaaaattcctgggctagtgtaatctctaaagacttttcaagactgaatgtcttctaactctctctttttttctttttgttcttatctcaacaagacctaaactatctagatcatgagatgtcactccttatctttccaagagtctttcctgtttcacgatattgtttttgtacctaaaaaaggtaaagatgaatataagatcacattttaattttataaaatgaaaatgttgttaacatttccaaatggcagtaatcactttatagtcttctgaatcttcaattactta

SEQ ID NO: 110000 - DNA, 1042 bp, Homo sapiens
accatgaaaaaactgagtcacagtctgtttttctttttttaaatctcttcagttcttatccaggtccatttcaaataatatgtcatttcataccttcacaaataccatctccaatttccagaagatacagagagatacatggcttatattttcagccaattaacctgtcatagaaaaaaaattgttaggtaccattgatcatattgagaaatactaagaaattaataagtattaaaagtatttaccagcagcctcaaaaacatatgcatatgcatatttatatgtatatgtatgtgtatgtgtgttagtatacactcaccctttaacagtgctaaaatcctttaaagaataaagaatttgatagctctttaacttttaatttttaagcaaaagtttaacacaataaaaaatgtaggaaatgcagacttggccacttttaagttttgtgtaatgtatatttaaacgcactaacctctgcccttttgaaaagctatgtatttgagtcttcttatgtcagttcctagaagtcaaggcaaatttccaagaaagaagctctaaaaggtgggaacaaggcaaagataccaacctcagactatttttctaggacctaaggagtgcatacaaaagtctagaaacaaaagtcagaaacaaataggggctggacaggactttgttctctcctccagttagcctatcccaagcacagggtttgcattcagaatctatctaaagatgaatttcataccgcgcaccatgcaggaaagagatgctagatgctcttcatgcccaagcaattcacacgctcactctctcacctcgccaaatatcacaatatttaccaccgattgatggaagaacctccacagtccctgagtctaactccctcaccttacggatgaggaagcaggtataccgactctcagtttccacctcttccttttacctctgcgtcccacctcagtgtcgacgcgcagtatctaaccagaactctctcttcactttcaggaaatttgccccgcgatgttctgtgtgcaaggagcct

SEQ ID NO: 110001 - DNA, 1040 bp, Homo sapiens
tgtctcacttttcatctggttgaatggcttttcttagtgtggtatttgctgtcacatagtttttcctgggtgagtctgccaactcacaggtgcttttaggcttgaaatctccatcctatcatttccgttttgcctgtgactgtaaagagtagccattcttttcccatgtattgaagaggatattcttctcttgctttatactactcacgtccttggggagggaaatgcacaatttttttttgttaggctgtaaagaatttaagctgtaaattacataagttagaacaagcccaaatttaatttgcaaccatcagaattcagaatctatagtgaccagtgatcaaggctaattggaaaagagttatcggcccatagctaataagtagtgacagacaaccaagcttcaatatttttctaaagaaattacaggtgggatatgctagaaaaggcattttggggttatgtttaaaaaaacattattgtcccacaatattaccttaagatttttcttttccgcactacctgaacattgtaatacagacaaacttgatttcttctagaagataacattttcaatactgtcccacttctcatcttaaaaatattgtcatgtttattctaatatccaacacaactatcaaaattgcctttttctctagaggatgaaggctgtgaaaaaaccgttcaaattctcttctttttcttttttattaccaggtccattttgcctgacaattgcaaatcagagcatacaaaataaaactgtgcagttttgtttggtttactttcaaaagagtagaaagcttgaaaagattctgaaaccacagtttcattattctcataatccttctgcaactgaaattacatattgcaggagacattttcatatcatcaatgtgacatttacaccacactttcaaagacaatcactgaaacaaaaattgtctttatgagctaaaaatatgcagaatctctgcctagaatctttattcaaacttttattagccagtgaaacacttgcttgccaactgccaagccat

SEQ ID NO: 110002 - DNA, 1122 bp, Homo sapiens
agaagcctctctcccatgaaccacgatgtacgttccacagaggcagaaaccgccgtaggttagcaatgcattttagtctttctctccattcacatttactgagagcacaccacgtgcatgttgctgcaacaggcatttccgatagagccgatccatgagctaacaatgtctgaaaacaaatgttatggaactgttggcatttctgagatttggcctttgccatttgatagactttgcttcccaggatgctgtcattttgtgattttttataattacaaggaatttggtaccatgttgttttcaaaaaacctcctagaaagtctccatgtatgctctagaagttgctctacgtaacagttcagcaagcaagtgttccttctcttgagctgcgtccctcaggaagctgtacctttagggtgtgctttccactttttatttcctctcatttcactcctttcattgtttgctatatcctaaaatatgtgaagtgagagaaaaaatatcatttcttctcattaaatctcctgcattaaatctaagaatcctttaaaataatcacacctgataagtgttttatgcatttccctccctggagtgttatcatccatcaagccagtatcatcatccacctgcttattccttgggactaatgagagccaagttaaatagcaaatgacttctcaccccttcctagtcctcatgcctgaggaataagggcgacattaatgggagcgggagagtggtggctttggttgagatgcacgttcacagactagaaaagtgcctcacctccatggtgtatatgtgccaccttttcttaatccagtctatcattgttggacatttgggttggttccaagtctttgctattgtgaatagtgccgcaataaacataagtgtgcatgtgtctttatagcagcatgatttataatcctttgggtatatacccagtaatgggatggctgggtcaaatggtatttctagttctagatccctgaggaatctccacactgacttccacaatggttgaactagttcacagtcccaccaacagtgtaaaagtgttcttatttctccacatcctctccagcacctgttgtttcctgactttttaatgattgc

SEQ ID NO: 110003 - DNA, 1052 bp, Homo sapiens
cctaaaaatagtagtgtatgttatttgatggcttttgtttccatagttccatcactgacaaaactgtcaatactgttgatggagcagcagcatagcctagagtgatgcattcttacccagaggtggcaataggagagggtccatgtaaataggacgaggtagacagtgcatgattgtaggagaagggttgaagggaggacatgattccaaaaaagatcgttctcaatgtgtcgtctgactcaaccagctggcagattacacttgccaagtcgttccctttccttctaagtcagttggctccatattcacttgaatatgcctctgtttgggcaaagcaagatacctccacttaacctttatccaaggaagctcttggtgtcctcttggtcataaagttgtctcctacctaacccagttttaccaaatggaagtaaaaggggacaaactatggaagatggactccatgccattgcagtcagccaccattctcttttccatataaggagccccattacataagctacgggtgaggttggaacagctatgtttcataatttcaagagtgtgaccaccctgctctagtcatcatcattggatgaatccagttgactctttggcaaaagggtgatacttttcactaaaaatgcctactcttcctgttgatgttccttttctgtttttaccttgtccaatttccacactagtcattttttttattttttagaggatcagattttagcgctggaaaatgagttcaaaaatttcagtgtaatgtcataaggatgttgggatacagagattttttttttccttggaaacaaatggactgggaagaaacacagcatggctttgctctgagtttcaatctgatgattatgaccatggaagatagtcttatgtaaaggttaaatggtgtttacaagtggatagataaggcggagatggtgagaagccgggttttctctatgctaaatgtgtctactaagagcagcacttcctactagctaagcacaatcatagccccaccgtgatgagctgctagtctgaataac

SEQ ID NO: 110004 - DNA, 1038 bp, Homo sapiens
atatggtagattctagtcctagacccctgttttacagctagaattatgccaaaaagttgaaaagtaaagctggatgaaaccttagagaagactccgccatcttataactcagatggtgaaatgagacccagaaagaatagtcttcccaaaggctcacggtcagttattataggagcctcatttggaatttgagtcatccaattctcaatccactgttcttaccactacccaacactacctttgtttaactgtctttcttgcataaaaagggacttataggtgagagattctatagtgccattgggagctgctgcctgaatctccgtgtaatttcaaagagtttcctaactcagaccctgtcccatttcactgtatccttaagaggctgagaaacggggcattcagattctttccccatgctgactcttcattctgtttacacatgggccggccagatgctagagaaaaaaaaacaaacatttgcagctgttatcaggggtaggatagagcacatgaggttcccaagttttgatccaacacatcagaacacacttgatttttactctggcttggagtttactgccttcagcttcttctacaaagcctgaatgttgccatttcatgtcaaaacctgcactgagagatgccgatggcttcttgagctaacttcagcccatcaccgcagtggtctagatgaccaaggaagtgactgcttcattacagcttgaggggaccctctttcttcatcccccactttcactttttttttttttttaaatgaaaaggccgatggttctcccaagtagccagaggccagcaggagcactaagtaagagacagcaagaagtgttcttagtgagaacaatgtggactttggagttatgtaaaacccaattttaatcctggcccagccattgactggcagtttgattttgagttatttaagttggaaccttatttttcttgcttatttattgaactattaattgaaaaagtgattctagtcctagacccctatttgacagctagagaaatgag

SEQ ID NO: 110005 - DNA, 1054 bp, Homo sapiens
attattatttatatccactgaatgcctactcttctgaagcacttgagataacatgaaacatatggcaagtccttgtcatcaggatggagacaagacatacttaaatagaaataattacagaagcatcaattgtgggtttgtgagtatatatatatatatatatatatatatatattttttaatttctaggtaatgtcacatggattttttccttttcttcctcacacaacttcttgaggcaacccaagcaaggatcatcattgctattattataaatgaggcttttgacaggaggggggcaatggagtggcttgctgaagtttcaaaaatgaaagacagacccaggtcatctgtcttcttactattaaaatgtgcaaaattaatggtaatagaaacgataatgagcatccagacatctatggatatagggataaagggacagtcatcagcatccagacatctgtggatatagggataaagggatatgatttagtctcatcatgtaagaataaataaataaatgtcactgaataaatgctattgaatattttgacaatttttcggttctgaaaactacatttaaactctctcaggtattctgaatatgaagttttcacagtggacttttggaatggaaagaaataccttattttttggcataagaagtggcattcactccaggggaaatgtggctaaaaataacatcagcatccttaatctccattgcctgagaggagcctgtgttgacagacactgggagggccagtcttctttggtttccctcgcttctgtttgtctaactagcccttccttaaatgccaagtcagaaaagtgactgcattgaatcttcccagctattgaaatgaatggcaattatcttggctttctcaaggcaggctttggtcaaaacatattcatatgtgttttggagaaggatgagtggcataggatccagtagtttcttcctgtgtctgtcacagtgacactaagatttctgcatgtatttctgtaatatcctgggccattacggtgtaagaagtttgccgatggctgt

SEQ ID NO: 110006 - DNA, 1024 bp, Homo sapiens
aaatcagacaatgataaggagtcataggctccaagaaagttagacattactagctcaatgatgggaaaacccatttctgtcctaataataaagggcattttgcagaaaacacggtgaaggatgatgctgaagtgcccgtttgcatatattgacagcaagaccagtgtcaagtatcataaataaattgccagagagaaagtaggaagtttccattgaagtgggcagctgcaatgagcttcgatctcaagatttctaaaagcattgaagaatttacatcacttcaactattattttctgttgaacatgagaacaggtaaccttttatgtctagtttatatccagcagatgcttgtgatttctacctttctggcacaaaagtcctcatgattacacggcttcctcctctgccaatcaatgctaatggcaagagaaatgagaagcagtcattttataagcattatgtctggaaatgttcctttcgttgatagcagtttcttaacgccagtatggttagatgctatggcaacttaaaattgtgtttccataatatagtggacattgatgtcaaactgatctgcctgggtttgactttggccgaattatttggtctatctttgccttatttttatgatctgtaaaatggggataataaaacccatcttgtcaggcctttggtaagtgtcaatcatatgccatgacatttgtcaagaggcttatgcatagggattttaacctctattacaattaacaacagcaatgagaattgttccattgcatgcccagatggatactaaattagaaaaagaaagatccaggttgaaataataacagcttttttttaatatagaactttaagtcgtcaaaatgcttgttattgtatatgcaaatgtatacacatgtaacattttttttttgcaataattctgaggtaatcagggcaggtgttgctaatgttttacatcatgagtctcaaaggggctacatatttactacagccaagcagctaataaatagtagaactggg

SEQ ID NO: 110007 - DNA, 1046 bp, Homo sapiens
gggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagccggcccgcccgcctttctgtctcctctctccctccgtactggacggccccggtccatttccgggctccggatatttggtatcgattggggccggggacgcggagcaggtggccgcggcggggcagctgggccgccagcttggtgcctcggggaccgtctcccgctgctttggtcaccagcccctgcccgcccgacccgctccgttctccggcctgcgagccctgccggccggactttgcgccgcgtccggcgctgctgctgcgctcggggccccgctcggcgccggcggtgaccgggaagcccgcgttaaaggggcaaccgggaccctggcccggtatggctgaagtcagcatcgaccagtccaagctgcctggagtcaaggaaggtaagggccccggagggagagcgcgcgggaccctcccctctcccagcccgaggttctctcaggtcaggggcgttgccatttcggctcccgcggccctcgcccggtgcccgccctgcgttggccttgcccggacgtgaaaggaattgaattcaggttctagtgtgggacgttgggcaagtctccgacgttccaagcccgttttttctcaagggggtggttggggggggggggggctagcagcagccccagcaagtaggtggctgtgcccgtgttctcgtgcatcgcaaagcctcagtggacgctgagagccgggtgaatctgacttactccgcttctaaaaaatcgaggcccagcctggctggcttgaaggctgggaagtggagaggggttgacattcagttccgtgtggagcctttgttttgaaacatgactctttccctccttctctccctacttttcctaggccggcgtctggctggctgactttcccaccttcctcaa

SEQ ID NO: 110008 - DNA, 1051 bp, Homo sapiens
gaaaaaaaaattacactccggtaaatttctggggactttcaaaatcaaatgtaggtagaaatcttatgtaaagtaagagtatgccgtatgccagctctgagtaagggtctgtggggctttcagaagttcatgagtatccaacagatttaaccaccttaaaatgtttccttacgttttttttttagcttatattattggtcctgtttaaaacttattacagatatttgtgtgaatgaagtatcatttcatctttttagaaacttgtatcagaggtacctaggctaatttatcaccaaatttttcatcttgcctgatgagcatttccagtcctgatacagctcctcagtgaccaaataccaggggagtctcccctggacttttttggcttttgtttttccaatgagtcataaaggcttagtcattttccattaactttaggagttttaactgcatatagtaaaactatgaatgacttataaggatatctttccctcttcaccgcttccccatcagcaacaaattctgttttgtttattgactatggaggagtccatgattgactttaagtattatattcactaatttttgagtagcatcttcccaccaaatactttgaaaatattaggtttttcttttatattatgaaggtctgtgtaaatatcgaatacaagagttgacaaatactgtgaaagactctttttgtctagatgggagtcctgacgtagaagaaagagaaagataggggctcacttaatggtccacgttcttcccatctgtacatctggagtttgccttaatatctgggccggtagctcttttggaaagggctattcactctcaatgtctgcatttatagatcactttctggcttttcctagaaaatattttcaattctgtcagtgattgctggattctaagttaacatgtttgcttctgttgttttcccagcattctctggtcagacttcattatttcaaattggtctttggtggatccacaaatcattccttctttttatagtttccccattgaagctccatagagctaatct

SEQ ID NO: 110009 - DNA, 1076 bp, Homo sapiens
tatctataattttaataaagtgatagatcagcatctttttatgaacagtgactgaaatttagaagtatttgaggaaactaggaagcccagtctgccatttaggaccattattattggaaataggattacagattcttgatactcttgacagtttggtgctctaaccaataaggtgactttagcaggtcagatatttgtaagaagtttgcagaggatcctgagttatgctattctggtgtttgtaaaactttttgtgaaaaaggcagctttctatctgtgatgtttattgcaggataattaacccggaaaatgtctttctgttactagaatttctgaaggtttttctcctttcttcttattttttggatatcaaccttgagttgtgtttttccattcaccttatacttaatttattaacattttgtaattcttgggatgatttggcagtttgcaactacaggggagttctaaggatgtggggcagttttctcaaaccagtaattctggagactagctccagattgtgcaaattcctgctagcacctcagcacatactgctttatctgctttaaatgccacataaatcctaagcaccccgttgcattgtttagctgaacaaatacatccgtatgtatacacacatttttcttgattctgagctctaatcttaacagtgccactcatttaactatgcgatcttgggcatattattacaaatctcagccatcatttctttgtaagttgagtgatctgtttaattgtggcccaaagaaaccaagaattgaccacctgcctgtatatatcacttttctaggtattctaggatcctattaggcaacatatcctttcattataataaagctgaaattccaggtgaaggaatttactgttgtttgaggtagtattgatagacatgtagctccatagccttgtttcagataagctggaggatgtggatgaatgaatatgctggatggatgtgggtggaaaaattcaacatttcgtgttatgtcctgtgcactagtcgtcattgttctcaggatccatctttttcacaagcatttatttgaaagtca

SEQ ID NO: 110010 - DNA, 1867 bp, Homo sapiens
cattattcacaattctctgttagaaaggccagttctgaggttgatgcagatgtttaaaatcctgaattaggttaataacagtataatgagctttttcagaaattatcaagacaaaccactcaaatataaatcaggagtagagagtgatattttataggtcctaaaggagagaagaaccgggtattatatttctgcctgagacttcaaggttttgaaattgttcctggatgaaataagtaagctagaagggaagtctttcagttcactccctggcaattttaatagctgtacatcttgggaaggatgaaatgctgcagttttcattgaactggaaccttttattcagtctggatacccgggctgccgtaagtcaggattaccgcttgtttactactgctttctcagtttcgctttcccaggagtctgtataattagctgactgaaccagagatggtacttcttggaaatatggtttgaaatcattaaactcagatgaagcttcacttatttattttctgtaccaggagatacatcttctgtgtcacttgtgacctttaacacttcatttgggtttgccttctctacggtgcttctactttcttcccacttattatcacatccaatgtagttattagtcaattaattctatacagattttacattaatttgggaggttcaggtagaggcttgaatgaagacagaggcttttgaaaactaagtccgtgattttgtgtatgattcttaattattacaatgagtgaaggaaaagaagaaatataaatagcaattggtctgagtagatttttgtttattttcatttctttggtttgaatagataagaatactatgatattagacctgtaatgtgaagttactaagtgtacacttttttatagcttataacatggcatgacagagaatgatttgtggttattagtggtagaggcaggaccgtcaaacaggccccagtggggtgaagtgataggtggtatagaagaggtgtggagttttccattgttgggtgtgatgatcagattccagttctaccacatattttcgttgtgatcttgagaaaatgatgcaacttccctggaccttagttttctcatctgtaaatgtgaccgtgtcagcctctttgcatctttatcttgaagataaagtgagaaaaataatgtacttctcatatagtgagtattcaataaattgtatttattacttttaggaaatacattattttttattttccttattcatgttttcacctttgctttttagtgaacaacaagactgtgaaattgctcaggaaattcaggagaagctggctattgaggcagagagacgacgcattcaggagaagaaggatgaggtataacttagttactgcccctctccctcatggagaaaggggtgctcagctttagagcaaaaactttctgtaggtcacgggctcaatgaagggtttctgaatgggaagcagaatgcctcttatttgggctgcattttcctctgtggaccatgatttatagcctcttgattatgtaaatggtaaaagtcttgagagataatggataatttcacatatgatgtgagttagtttcctatgactgccgttacaaattactctgcaaacttggcttaacagaaatttattgtcttagagttctggaggctagaagtctaaaatctgaagtgttggcagggtcacgctacctcttgggaaggatccttccttgcctcttcctagctcctgactcctggcaatctttggcattccttggcttgtatctgcatcacttcagtctctgcctccattgtcacatggctttattctctgtctgtatctttgtgtcttcttgtcttcctgcaa

SEQ ID NO: 110011 - DNA, 1076 bp, Homo sapiens
caaatttgaaattgtataaaaacatttgtcaaatttatatcaactcaaatgatatatattatttattaatgaatccatgtttttctttcaaagccacttattgaagtcatattagtgattttttaagttgtggtctttggagtcataggactgtggttcaagtcctgtcccctcctaagaacaatattaattttaatgaagttacgtactaaataaaatggagattataaaagtaaatccttcatttggatttgagaagatcaaataatgcaattttggtgaagtacttatttatacatatatcggtgttatatgtgtataatgtaatattttgtgtatcttattttgaaagccaaacatggaggcactcatataaaatgcagatatatatgtgtataaatatgtgtgtgtgtgtgtatatatatattatgtatatgccaatacataatacctatgtatgttttggcagtgagggagtaagttatatttgccaaataacttggtctcaagaaacatacaggtctcagtcctcaactgtatgaggttttaaagcattcagatagattcctcacattatctttttctttccaagatttaaagctgtcacagcaaatttattattagagaataaactttttcagtcagctctgtaaaaatgtagtaacagctctgtaataattcctgcagcatatttcctaaaagtaaaactatgaatatctattaactatttagaaggaattaaaaatcataatatcacaaattcatgtcaaaacccaattctttttgtttattttgagctggaaggtggacttcacttgtgcaactctgagtgagcacatttttattaacaccgtaaaccattgttccccggatgtggtcatcatttaagtggctggtctgtattatataaatttacagcagtagtcacttgattctcatgttgtcacgatagtcttaaaataatagtttatttaaaagagcagataatttgtttttatcaccgggtaattcttctgttttgcttttgattttatgtaaaataaaacttacccataaatgatgaagataaatacttc

SEQ ID NO: 110012 - DNA, 1971 bp, Homo sapiens
gtggatcattcctctgaactcaagagaaactagcaatattctgatagttttattggcatttccagtaagaatatttgaaagcctctgtctgaaattacaaagcttaatttttttgttttacaagattcctcaacctctactttttactctatactagtttcaaattggtttataaatagaacttaatgtttaatggctataattttgttattggcaaatattaaagtgttgttagctctacctaatcgtgatcaagctcttctttcacatttgtttcactttagtttcttaccattttggctatgtacccagaattctttaggtatgcatgaactgtttcagtaatgctcatcccctcttctcaatttaagttgaaaaagcaattttctccatttttaaagtacgttaaactggagcccagactcccccctgtgtagtgagttcataactctcattaaattaatctgcatttttatttttcacatccctctgcctccactcagaccaaccagggtcaaggagggccagggaattgggttctggattctcaagaccttgtagactccaaagagatggaaagactgtgaagcacaagaaagagaaaccagaacatccactggagaacttggaagagccagaacaacattgttcatcgaagagatccctgtcatcctctagctcgggcaaagggagggacaatccccatattaacaatgagcagcatgaaaggaaacggtccactcaggagaggcctcggagacctctgcttcccacgatcagtggtgaagtgtttctgagcactgaatgtgatgactgggagactaagattaaccatcagactcgaaattgggaaaaacagtctcgacaccaagatcgactttcacccaagtcctcacaaaaagcagggcttcactgcaaggaagttgtatatgggagggaccatgggcaaggtgagcacagaaaaaggagacacaggcccaggactcctccattctcagagagtgaggagcagctccacctccatgacgcaggtaatagaggacagtctcgatggaagtcctggtatcatgtatataactacaaaccaatgaatttaataagtaccttaagcaacctttctttctctctagttcatgctcatgactttgaaataaatcctagagcaacatattataaaaggtatacacttaatctcaggtctgtaagaagaaggaaaatatttgtaacttttcccttctgtgagaatgcactgatttcttggagagttattccatgcccaggttgtattagaggtacccattccagatatagttcttcatttaccgagactgtgtatcagagattctgataccaaatcaaaactcctgaatttctggttttacttcagtgaacccagaagagctgatgagcctgtcttgatagtgtttgtctaactaaaaggccgatagagccggaaatactgtattttttagacctcatctttctcatttgtaaaatgaggagttggataggcagtcttttaagaaagtatttttcaaataatatgcctcagttcattttcatcagaatcagctgttaactaacaatggaaatgtctgggtttcacatgtattatcatctctggagtgaggcctggcagtttggacatgttttagacctggaggtggattcttaggaacttaaaagtttaaagtcattgcattaagttactttttatgctgtaactttctccagctctaactctacagttggtgttctaaagtaccaatacaggtaagttcttggtacctatataagaatgaggtaaatattatagataaacctcaaatttctggcacccctgaggcttaactctgaagtccatcattgacgcagtaatggctctattttctataaactgctgaggtgatgttttccatgtgtctgtaacactaggaatcatagtaccaaggagccagtcaagctctatct

SEQ ID NO: 110013 - DNA, 1034 bp, Homo sapiens
aagcacaattcttaaagttgttaggacaggccaaacttacattaataatgaagaaactagcaggatgacacggagctggttctaagagcatttgcagagcagcattaatagaatcagttgaaagggactgcaaaataaaattttaaattaagtataagataactttctacagggcaatgggtacttaacctttcggagttacttctctattggactataaattcttaatggctcatcattttctgcaggttaacttctaaactcacagggccataaaatatctgcactgttctgctgtgaattgttagtcagatatactgtggcattccctaaatgtcagactggcttattacaaatactcttacatgatatcaaaaagaatctatcattttaccttattccaagctcagaataaatttatcttgactgtcagtactttcaacaattttattctgtaaatttatttaaggctgaagttttgtgttcatttaaggatgttcttgtgttctccatctgaaggatgatgaacagaaaaagacaaggaaatgtgaaattaagatatatatggaacttgaaaataccactcacctgattttttgaaagctagtttctagagtctgtttaggatactgagatgagggaagctagtctgttaatttccttcagttaattacatttaaaaaatttttggacatctttgtttaatgacggccttacactgcactgtgagttctttttctatatccttacaaaaatttttgtcaccttgggtccagaggacactgcagagaatgggcatcctgacagtgcagaaatttagtattccaggctgtggagattttctacttaatgagatttacagattccagtgatacatcaagggtttaaataaaccatttcccctctaaatatttggaactgagagatattacctcagattctgactcttactaagtcatcattctctttttaactgccagaggttacagtcttatcaccctgtcaaaacaattagactattcaatggaatattg

SEQ ID NO: 110014 - DNA, 1029 bp, Homo sapiens
gtattatcacatgactgccaggtgctgctgttcctgctccctcggaagtagtaagtatgcaggctgagataaatagaaagaagcctctactctcctccagccttgacagcttagcctcttttaaactctgactctgtaatttgcttttctttaaattatttttgttttcaatgacttttttttcactttgtatttttccagggcctcacttgcaacttcttacataaatttctgctgttgcagaaactatgtgagaggggactttttaccaggcaggcttgcttagatatctttgtttaaatgtatgcattatctacattgccacttccattcctagggcaaaaatatttttaatgcaccccacactgtattctggagtagaggtagtattgtcattgttagctactaaagaaaaatctcctttatcttaaatttcttaacttttcagaaaacatcctcggttgttttattacattgagtttttttttttttttaaaggaatgaagccaagagtgatgaaagaagctgtatctactccatcacgaatggcccacagggatcaggaatggtatgatgctgaaattgccagaaaactgcaagaagaagaacttttggtgagcaaattttaaggcaaaagtttagatatattgatgggtattttttttgtgaatctagtccatcttgaaattatattaatagtcctctatcaattgagaaacctttttttatgagtggaaaaatcatgacaataggaatagagtatccacttttgcttagtgagtaagcattagcagcaaagtccataactccatttctccatctccatgattgttctccataaccctgctgtaggatttgataaaaagagctcctgctctggctggtgaaagcataccaactgattatcaacctcaggaacatgagtcacaattattttcaaaaaccagcttattttgtacaagatactgaaaatgcacaacatagattccaattaaattctttgtttttgtattttcgatatcataggct

SEQ ID NO: 110015 - DNA, 2322 bp, Homo sapiens
acaaaaggcattattttaaaagtaaggttagttggacattataaacatcttcatcaacacatcccacctcaacttccatcagttggtggcattttcactgttcccgatttaacgaagtagctcatatttttctttctcaaactacatgtatcaccttttggggagtaccttactgtctttgacatacatttgatgcataatactaaactaacacattgattctgtatatatgtcacaatcaagaataaagtactattagaaatgtatagaaataaagttattttacttgggcagggagaaaaagctgtttgagtttcaaaggtttttccttaattgtgtttccttttttcttcccctccccaggttttcattacaaacattaaaaacctaggaatctgccttgaaaatggactcactatagcaaatattactgggtgatacagaatgaattctacacttactttttttctcctgtgtttgcattcctgggatttatcctcaagtgcatttctgaccataagtaattttaattcatttcaaatgttttggttattcatgatcacttgggcagtataagaaaatgtagcttctgaatattggccacctctatgctgcatatacttcttgggatatagtatctaagacctttgtaaactgccattttgttaggtatggagtttggtatctagggagtaggccttatttagcaattcaaattttatggagatgaatgatcaaagtgaaacaatgtttggatgcaacgcagaataaaagaatataagaaatagctttttgttgcattaatgtatgatattttgaaggacagagcctttgctttttgtattctttaagaaaagcacaaccataaagtattttaaaaaaagaaacacttggagcaattgaaatatgttattctgactagatggactgtagaggttttgcatttctcagccctcctggggagattggcctagatagcattctttaacacttcctctgcttttgcctcagtagcaaggctttcctaagctcctgggcaatggaacatttattagtatttattgacaaaaatttagttctctgaaattttaactcatatatatgaaaaactttgtattccatctcttctttttcatttacttgtagagccaaggaaatggaattgaaagatgattgcataagtaatgatgccatccttctctctggctgtagactgaggcttttctcttgcttcaagtcagagcagtatttgttgataacctctcaataatgtttggtttacatgccagtaattaaattaattcaacatgaagttgaatttgatgaagtggtcatctatccaagtatttggtttttgttttgttttgttttgttttttgagttggagtctcgccctgtcacacaggctggagtgcagtggtgcaatcttggctcactgcaacctccgccacctgggctggagcaattcccctgcctcagcctcccaagtagctggaattacaggcatgtgtcaccacacccggctaatttttgtatttttagtaaagagcgggtttcaccatgttggccaggctggtctcgaacccctgacctcaagtgatccacctgccttggcctcccaaggtgctgggattacaggcttaagccaccatgtccagccagccaagtatttggttttaaacatttgtattcctttgtgcaagggattgtattcctctgtacaagacctttaagcacctcttcaagaaatttagtctttgtgtagctgctaaccttactgcaatatttattttcccttattttcccatactacttagttgacaaatggcaatcaagctcacttgttctccctctctctgtctcccccccatgtacacatatatatatcccttcagcttgacttgctattatttttcattgtataaatatgaaattcttggcatttcaatatggcatttgtttagggaaaaaatatgtaggtcactagagaaaaatgttaatttttttcccactgtgaattgccttctgtttgccttatcttttcagatagtctttaaagttgggcaatattcaggcagctatttagaacagtttctcagagtggatttgggtctctcatttgagaaagatttgtagtttcaatgaagtttgtatattataggaatttaagtaaaatcatctgagttaagttttgggcaaatgttaatcagaaagataatctacatccctactttatgtagtcattttggagaaatggaggaaaaggaaaataacaggactttttatagctgtgataaaatgggtaaagaaaaacctccattt

SEQ ID NO: 110016 - DNA, 2052 bp, Homo sapiens
tttttactttgtcatttttatataaatgtgaaagcattttgttgttgttgttgttgttcctgctgctagaacacatgcagtttaatttttaggcccacagtgtattatgctttaatgttgtgatgtaaactaatacttctggcctgggaaaacctttctgtttctgtatctttgtcctttggaggccaggcctcattaacaccagtattgttgaataagcacaatatatgacggagccttatcataaggctgcttgacatagacacccactctcctccacattttataaatcattgtttggaagtaaagttagataagagtcaaattaaatgttttgacttgaaaaatatttgacttttgcgttcaaaccactgttagacgtaagtattttattagacataagtattttattttgggactagacagttgctttacatgtatttaagggaacattgtgattttcagaaagtggctttacatactattgaattgctatttcccaagttactttacaaccagcagcagcataccaataaattacaaaagcagaaaatgaaaattaaccctaggtgttctgatgatagagaaatagctaaattagaaaagaaagatatggatagatgcttttaggaggaaaacctttttagaatggcaatgaccacttggatctaggtcaacatattccaaaatgtgtgaccttgggctttgtgtttactgaactcactctagaaaattctggacctgattcattaaccccgcttttcttctctaatgtgtcctgaagctgagctagatgatgagtaaattctttgctgactgttgctcatcactttctctcaaagttagaacttttcagtataaaaataattagcttttaactgattattaattttctttaatagtttctgtcaaaacttgtctaaaatttgtgttgtgccaaattggaaatacccactataatatggtgcattcagtttactccacaagtggttaacattttaagtcctagattttttatgtcttgcctttgtataagcatcgctttggggaataccaagatgattcattattcagtgattattttcttgaaagataactatgatgattggctgtaaaatcttcaccctaataaaggagtgagatctctgtgtaaacagctttctgaaggactgataatagaatagaacttgcagccaaaggctttttcccttttgagaagacggtatttgtgtaaggagtgctaaggtagacttcattgtacatagagtgccatattctgttgaaacgatcataacaaaatcaaaacctcatgcttcagcaaaaaggaaaaaagatttttaaattactttgtctattacttactgctcatagagaagtgactatataaaatggtccaattttctcatttctggtggtgcctgtgagtcttaaagccatatctgcttatcttactgttgatagaatactttttttctttttagcccatgataagtaatatgggcaggtagaagcaaactggagactgtcctgttaatgctgcatggggcacaatgtctttcaaattattggtggaagaatctcttttatccatggcgagaggtaagaatattaaagagtcaggatattgttgctcctggtatttaacaactgtcattagaaatgctgaaatttaattgtagagaagtcaagaaagaaagagtaaactgagaaaatcttactactacagagtcacttttacaatgagacctgcactttatgccagcactgtttgtgaggagcagtactgccttaaattagtttgactctgactgatgtcagtgtacgttacttcctttatgtgactgacagtcagctttccattgagatataacattcacagatgatccccaagtatccttgtcatcagaagctttggaccttttctgccactgacttgtggctgatctgtaacacaataaatacataattttatttcatgttgtctgtccacctctgaataagcagtggcatgaccaaaaagactggtagaaggagagaatttcttggccaaat

SEQ ID NO: 110017 - DNA, 1320 bp, Homo sapiens
ttgtatttctggtcaaattggtcttggaaatccctatggtctctaatttcagctcttgctgtaaactgcaagccaaatgctctttctcagaaagagctatatttttctcttcttacaggcaacccaatatttatttcataaagtgttataaatattgagaagatacactggggagatagcatataaaaatgatgctccaaaatgagaattctatatggggctttccctaagaagaatccatcccagcacatattttgaaaaggtgctgaattaaaaagtacaagagtttgctcatataaatcaagttgcccaggaaacctgaggtgatgctatcatttgtctcataatttagaaacgtgatctcttgagagagagactacgcattgcctgggcactttcagattccttaggaagtgcccctttgatatttggaatgtggatatatttataaaacaaatggattgttattccaaatccacatggatttataaccaagccccagaagaataggcagctttgaaatagctagttcgtggaattgaacagaaccttgatggaatgcagttgcctgtgtgaggacagaaaacaaagaggctgcctcagaccacatgcctatctagagattaagtgaatttgtgagggacattttgtggatgccttaaagatgaccagtggtgggttctgatgggaatatatacactcatctggactaggccaatggaagcagtctctttcagttcacctccgtacagcacaagttgttcctgctcatgacctcattgaggaaaatgagaattgtggtgctggtgactttcatgtgtcttgggaggttgaggtgttcaacatcgttaaggcactcccaaaacgcaaacctccttttttaaatgccaattgtacatctacattaattcatctatgcaaacttgtgttttcatggtttgttttttacactatatttctcattaggttctttaaacatcaggtttaatattgatattatgaataatttttaaaccaaagtattctataagtctgtgtgctttgttttcctggatggtttgaccaaggtaaacatcagtcttgtccttctctcttaataaagtcatccatttgttaagtcagtggtctctgtctcatgtttttgttttgtttctttacagcattcaaggacagggaaacttacgagagtcttattataattattattatttacaaaatgaccctaataggtctgtttagtaacagtgaaattttttcttactccatttccatacactttctgtaaatatgtataacatgataatgatgcctggtgtattg

SEQ ID NO: 110018 - DNA, 1268 bp, Homo sapiens
ggtcatcagtgggttttacttggtgcctgcttgctcctacaagggtaagaaggacaatgaatggcggctgtcctttgccaggagcgaggtgcagttgaagaagtgcatctccagcagcctcatgcaggcctatcaggcctgcaaagccatcatcattaaactgctgtcccggcccaaggctattagcccctatcacctgcggagcatgatgctctgggcctgcgacagacttcctgccaactacttggctcaagaagactatgcagcccactttttgctgggcctcatcgatgacctgcaacactgtctggtcaacaagatgtgccccaattatttcatccctcagtgcaacatgctggaacatctgtctgaggagacagtcatgcttcacgcccggaagctgtcctctgtgcgctcagacccggcagagcacttgcgcaccgccattgagcatgtcaaggcagccaaccggctgacactggagctccagaggcgaggtagcaccaccagcatcccctctccacagtctgacggaggggaccccaaccagcctgatgaccgtttggcaaaaaaactgcagcagctagtgactgagaacccgggaaagtcaatctctgtctttatcaatcctgacgatgtcacaaggccccatttcagaattgatgacaaatttttctgagtgttagctgacttttttttttcctgattcttaaactctgataatgtgtcgtgtggtttgtgatgctatctttctgttttttacatatccagcctagattggatttgttaagaacaaattttaagtttcctggttctgcaggatggtgcaggctctgaaacagtatattactatttcatattctgcctctgatttcgttgtttactttttgtagttattgtcatgctctttagtttgttggagttttttttctttttaaggagatcttaagccatagatgaaaatgcccatgaatcctcttgcttttttctgtttcatacttggtgcaaatttgttcatgggtatggggaaacaaatctctttctgatgcttaacgattctatcctattatttttattattttgtttttgtcttttttcttatgagctttcaccactactgatatttgagaatcatatgaacctgggaactacttggcatgttagctggatttatttattttggccagtgaccagagtagtttccccccttttccaccaaacaatgtaaactttgaaagtgataatactacaaattgtgttttggagca

SEQ ID NO: 110019 - DNA, 1409 bp, Homo sapiens
gctagtacagtttggcatcagtgtctttgctgctaaggcactggcaatattatcctcccttgtttctgtgccattagtacaatggcaacacagtaaaaaagtcagacaagactgggcgtggtagctcatgcctgtaatcccagcacttgggggaagccgaggtaggagaattgcttgaggccaggaattttagaccagcctgggcaacatagcaagaccctgtctcttaaaaaaaaagtcaaacagtgtgttagtattattataaagagagttatgaactcattacccctgaaagtgtctccagcccacactgagaaccgctggtacaaagaagagtgtaagcgcaaagagcctggggaaagaaaaccgcttaggcaatagataaaaaaggccgaacttcatatgatggcaggagagatggagaacagggaaggaagtgagaaaccctggcagaggttccatggaaaagatttggcagtagaagggcagcaaagagttgaaatgtactgaggttttcagtctgcataactgagtggatggcaattccattaactgagatgatgactgggggaagaggggccctgttttattattgaaaacgatactgcttttcacactgagagagaaaaatctatcataattcttgcatttggaaaagggtggattctagcactagtgagaaagtactgttggccaggtctctgcagcagcctgagatttgatttagtactgataatgagttttggttcttggaacatcagagcattctgtttcatgcataagactcttatgtctgtgtttcctgtaatagtgttgtttttttcttctttatttccaggaatggtgcaaaagctggaccaaaagcttccagtggctaatgaatacctgttgctctctggaggtgtccgggaaggcgtggtggacctggacttagatgagcttaatgtctatgcccggggtactgactatgatatggactttaccctcttggtgccagccctcaagctgcatgaccgtaatcagcctgtgacactcgacatgcgccactcagccttgtgccactcttggctgagccttcggctctttgatgaggggacaatcagtaaatggaaagactgctgcaccattgtagatcacatcaatggtgccaccaactacttcttctcacctaccaaagtggctgactggttctatgactctatcagcattgtcctatcagaaatacagaagaaaccccagcgagggatgccaaaggtagaaaaggtggaaaaaaatgggaccatcatctccatcattctgggtgtagggagtagtcgcatgttgtatgatattgtccctgtggtatctttcaaaggttggcctgcagtggcccagagctggctcatggagaaccacttttgggatgggaa

SEQ ID NO: 110020 - DNA, 1043 bp, Homo sapiens
ccacaaggaggttatagatgtcacctaagataggatctttcatttgtgacgccttttcgtgagttactgtgccagatgcttcacggttgacccttgaacaacacaggtttgagctgcacaggtccacttataggtggctatttttcaatcaaatacagattgaaaatatactatttgcaggatatgaaacccacttatacagaggaccaacttgttgtgtaagtggattccacaaggtcagctatgggacttgagtatggacacatttcagcatatgtaggagctcctgggaccaagggacgattgtgtattgttgtcttgtttaggaagaaagatacaccatgaacacagcccacaatgacagtagatgtcgaaagtgctaatttagttcaggtcaagaccctccactaggatgtacaggttgttcattccatggggtacctgggtgagaggacaagaaagagctagaatccagcctgccctctgcctgccaccctgtgtgtcgtgccacacgatggcattcactcagaggaagcagccttgactagcagcagtcttggtacagccaggggagagaatacttcattcatttcccttcatctaacatgttttgtgtgccttgcatgtgctagaggctttaaatagattatcttgtttaattaaatctttaaaataactccgtggaatctgtgtttatttgctcttccagtttatgtgtggtaggaaaagggaagaacatatggggaacatgagctaaatatctacgatgcgcttagacacttcatagcaatcctgtaagggtgggtttttatatgcgtttacttacttttcatcaatttgtttgttttttaatagataaggaattggaaactcagagaggttaagtaatttgttagcctcacttgaatagtaaatgacaagcccaggatccaagcccaagcctatgttgagtccagtgttcttgcgtacatatcagtgtcaaaatggggaaatactaagaaagactcctttggagtgacatcttttaaatcagccctgttact

SEQ ID NO: 110021 - DNA, 1004 bp, Homo sapiens
gtcataggtggctatagaagtctacgttatagttgtctgtcttaagtagtaggttcttgggatgggcagccacctcggaagacatctatactgagactccatccctgctgaagattctgattgatcctctcttgggataggaaaggtactgcctccacaggcagcattgctagaaaattctgccggatggatgactttacaacattacactgaaaacttctctctatatgttctgcttagtgaaaccatgtaggcaaattccatttcttctgtactagcacagcttatcagatatttgaagatggctctcatagcctttttgaattttccatttttcaggctaaataattttcactcctcttcttcctcttgtgcattttggctaggaccttattcatttcattcagtgctattatctcaatttctaatcatatgttgattcgtgtgtgattatctgattagtgtgggagctgttcatgcagcatatcacagattcccagttctcccagcatgtggtagaatcgtgctttctttcatgggtgagggtgggaccatgtgactagttttgaccaatgatttgtgtatgaaaatgatgtatgtcatttgcatgccagagcatttaactgccaaaaagagaatgcccagagccttcttttcctccagcagagtgactgtgaagttccttctagacatggcttgctctacccatctgggtcctaagttaaggaaagaaaagcgcccccaatccctcccgccccactcacccttgatggtcatctagtgtgaatgaaaaataaaacttggttgttttgagtcactgagatattagctttgttactcagcataacttcacctgtcctgattgatagaattaacatttggctttctcactaaatcatcagcattatgcagtgggggtggtgtatgtttctcttcacctttgtctcttcagtgtctagcacagcactggctcataggagacgctcatacttactgtgtgaata

SEQ ID NO: 110022 - DNA, 1049 bp, Homo sapiens
ttaaattttttttttactctgttaatctgtcagttttattaaaaaactttatttgaataaaacaggttaacatgagtactggagttctaaattaaccttttacacacatgaatatatgtcttacagtccaagctagccataagtattctttttcctgtcaagctctgagtagacttattttggagaagggtgtttttttttaaatggagttccactcttgtttcccagactggagtacaatggcgtgatcttgtctcactgcaacctctgcctcccaggttcaagcgattctcttgcctcagcctcccgagtagctgggattacaggcatgcgccaccacacccggctaattttttgtagttttggtagaaatggggtttctccgtgttggtcaggctggtcttgaactcccaacctcaggtgatccacctgcctcggcctcccaaagtgctgagattacaggcatgagccaccgtgcccagccagagaaatgtgttttgtgaagcagcgagtagacgcagttaggaattctctagttgcaagtcattatagagattgtcagacatttactcaatgtttttaaagcaaattggattcatttttgtatgacatgaattaaaattaaacctaaacaatttctttgcaggtgattttgattttattttaaatgtgtttggttaacaccacctgtaaataaactagaacataggatctttggtgtgaaaataatttagatgtgtatttaaaaggtagatttaactttaaatgaatattatactggcttataaatgtatcagatatggcgtattttattatattttatcatatccgtttagtagaaactatggagattgaatgtcaactgaatgttgccattagggtgatggccagactgtcctgtaaggatataggtttacacgttttcaggtgatctcatcacctctgcgtggtaatacttgactgataccagggtgtcggagtgctcgtttaagaatcaggagaccttgccctaattatcttagttctaacactgactagctgcgtggcct

SEQ ID NO: 110023 - DNA, 1038 bp, Homo sapiens
atagaattgattcccgttctctgtgtttaaatccctccaccatttgctacacgtgccttgactcaattttcctttcctgactatagtcatccagtattaagtggccagttaaacttaccttcctacaagccctgtgtaccattttgtgttatggatgttgtactcaaagggcatagtttggtctgaaagtaagtatgcaaggttctagtatatggagaatatgataaatgttaaacctctgtatggggagaaaaaagcacatagtgttttaagtcctagagattcctctactgcctagggcagaattactatcctcgtgaatagtgtaggagcctgaggaccagaaaaactggagtcaagactagtggtgaaaatgggaaactgtagacagtttcccagcaccagcctggagctgttgctgctagaccacaccacattccccttgtgtaggttatttaataaattcatttcacaacccataaagcacagtaggaaacaatgcaattactgaaccattggaacacagctgccaacatcttgtttattcagaattgtccaaacacttccatgtgggggcgggactgatgcaatttgctggttcaacagttgacattgataaattggagtttcatttcctctaccttctgttggaggtgctaatgagcattgaaaggctggagaaacacagaagggagagaagggagaatcttgcctcatctacatactaagtaattgagcctggaagatgtagacttgacaccattaggtaataggtggacacatttgaagtcactaataagggccaaatgcaattagtgttgtgaaaattttaattatttaaattccacttgcagattgtgtgggctggaagcttcatttaataggagagaatgtttgcttttcctaatattcttttatgttttctgatttttttctttttatttcatgggcactatgccaacattccttggcttctggaaaatgagggaattggactagatgatctctgaggcctcttccatactccattgtttgact

SEQ ID NO: 110024 - DNA, 1027 bp, Homo sapiens
caagagattgagaccatcctggccaacatggtgaaaccctgtctctactaaaaatacaaaaattagctgggcatggtggcatgcgcctgtagtcccagctactcgggaggctgaggcaggagaatcgcttgaaccagggaggcagaggttgcagtgagctgagatcgtgccactgcactccagcctgcgtcagagcaagactctgtctcaaaaaaaaaaaaaaaaaaaagaacaatcctctcaaacatctgtacctgtggtagaaagtaattgtctgcgcaattcaaggaacatttcagtctatcccagaaagaaattctgccagcattgcatttgtgttcccagtttgtcttgctctcacggtagaacagctggcacttctttgtggtgtttggtttccttgtttttgttccttggctgagatgtgaaggacttgggaggggctaagaaacctcaggaaggtcggaaaagtagtggcagaagacacaaaaaggagtggccccacaggagaaacagcatgtgcaaagaggaggcatgatagaaaagcagtggaatggggatgagaaaatctggatttttgtcttttttctttcttcttcttttttttttttttttttgatataactggggaaaattacttcctcagtcctcatgtccttatttgcatcataactggatttgggtttttttgtttgttttgttttgtttggttttttttttttgagatgcagtctcgctttgtcgtctgggctggagtgcaatggcatgatcttggctcactgcaacttccacttcctgggttcaagcgattctcctacatcagcctcctgagtagctgggactataggtgtgagccaccatgcccggcctcataactggatttgagtcagagaatctgagggacctcagtgttgctgaactcgattcattcattcacacaaattggcagagtacctgccatgtaccatgtacctgcagtgtgattggtcctgcaattcaaagatgaatgaactgagatcgttgacct

SEQ ID NO: 110025 - DNA, 1320 bp, Homo sapiens
tgaggttactgggagttagggcttcaacataagaatttgtgagtccacaacttagcccataacaagcacccaggctgcttttgtgtgttagaggtctgggtgacgcaatggcttggggtgggtgccagacacccttgggtttccgtagcaaaagtaaaatagagtgaactccctaaagacatttggtccattttctgctttttcagaaacatgctctgagattatctctgttagggagtcacagaatgctaccttcaaggaatgccctctatttaatattaaaggaagctgaggtccagggagggatacagctatgtctataattagatctcttgatttataacccagttccatccactcagaaacaaaccagagcatataaccatactctctgacctcactattgcctcactccaacacctcagagacacccagcttagaagtggtgggactttttttcatctccagagagggaggatatgatggtgcttcactgggaatgtgctaagaacattctgaaaatagtgacatcctgtaatcaaaagctttttgtctgagggaaggccttttttttttttttcccccaatctttcttcttcttgatcttccaaaggaggtcaggtttttcaccatgaattctaggatcaaggctagtaaatctgtaagttggcagagttttgttatatttaagcaaaggtagaacagagacaatagtagaagtgattcatctaaattttttagtttaattccagagttaagactgaaaatgattcttgatgtcttaataaatagttttagaccaacagacggttaaaatgttttaagaaattagatcaaattgtcatcatttttttctggaatctataagtgatttgggaatcagggcctagcatttttctggattaagtggaataaaatttgcaaatgtgcttgtatgtttttaagactttttttttttttttttttttgagacagagtctcgctgtgtcgcccaggctggagtgcagtggtgcgatttcagctcactgcaagctccacctcccaggttcacgccattctcttgcctcaacctcccgagtagctgggactacaggtgcccgccaccacacccagctaatttttttgtatttttttgtagagacggtgtttcaccgtgctagccaggatggtcttgatctcctgacctcgtgagctgcccgcctcagcctcccaaagtgctgggattacaggcttaagccaccgcacccagcttttttttttttttttttttaaagacactttctaaagatccctggccaaataaaatgtgaacaatcggcc

SEQ ID NO: 110026 - DNA, 1033 bp, Homo sapiens
ctcttgacccactgcccacggagcttttctgaaaccctctcacccctctgcctggttcacttctactcatgtctacagcatattacactctaccacttcttacaaactcatccttccttcaaaacatgttcctttgacaaagaacccctaacctttagggatttcttgctcttccaaaccctagcaactcctagcgaagcctaatgtattattagttacctattgctgtgtaacagattactccacactgtaaaacaacaaatacatattatctcccatagtttccgagggtcaggaatctgggagtggcttagcaggtggctctggctcagagttgctcataaggttgtgttcaagctatcggccagagccgcagcctttggaacacttgactgggctggagtatccacttccaagctcgcctgtgaggctcttggcaggagatctcacttcttcttcactttgtcctccccatagcgctactcaacatcatgtcagatggcttttctaaagtgagtgatgagagaaagacagacagacaaaagactaagattgaagctgcaatgccttttataacccaatcttggatgtaaaaaccatcacgcttatttgttacactgactgctacctttgatacaaggtgagaggtgactacttaagggtgtgaatacccgaaggtggggttgttaggggccacctggcaggctggctgctacacctgccttatattgttttagcatgcatgtgttctgttttgccagctagcctggcactgtttaagtttgcaggctggtctcattgactgtgtggttcccttacttcatccaaagtgcttttcatgtagataattattttgttttcaaaataatgtgttgccctctcctccttttttaagagatagaggtaactggtgcctggaaggattggttatctaagtcagtcaactactatgtgacagaacatgtgaattcactcctaggtctttaaatctaaaacccatgttctgtccactatacaaatggtatgctgattt

SEQ ID NO: 110027 - DNA, 1098 bp, Homo sapiens
tcatcaaagttaagcccaaattgaattctgtttgaatgtttttttgatggtccttcatatttatattgatttttaacctgtccttctcatctaggatatttttaccccatgtaaaatggatgcaactgtttgtttttcagatcatgtccaaataatcatttttgtctctagttccccagggaagagtgttatgcagacagttttaggatgttttagccagttaataaagtaagttgtcaggtaggccgaggagttactgagtttgtagtgtctggacaactgatctgctgctgtgttgaattgggaattgttgtttgtcctgcaagaactttgattttggagcattatggtgaagggtgtttcattgttgtgactgtagaacaaaggaagttaaagcatctactgtgtgtcaccggccatctcatttaatcctcatgtttcatgtgagttgatcatattttacaatgaggaaaattcgccttttgagagacaccatttccaagacccctaactgctagttcgtggcacagctcaagtaaggaccccgtttcaacctgctgaagagcccattctctttccactgtctctggttgtttttagggagggaataaggtgatatttgtcaagcatgtcccaaatgattgggtgtgacagatttagtgtttcttaatctctagataattaaatggagaaactatgcctttacatgtttatgaattcattttcaacatttaatcagcaaagtaatgttgggtctctgagacccaatcatctgaatcttgtttgacaaataatcgtgtgagtgtctgggggattaatgaaggcttagattccttacagctcccttgacctggagaccatgaagtctcagggatgactctttccaaggtattccagagcctctgcttccctatggtgatgagtcttcccccaactgggctctaattgctgcctgtagataaaggagtccagggaaccctcaaatcagaccacttgggagattttaaattaattggcatttaatcaagatgtttgcagggatgaaggtgcccatgcgtgcagctgccattgtttgtgcttacacctcacatcttgaaa

SEQ ID NO: 110028 - DNA, 1050 bp, Homo sapiens
ggatgcaagaaacttagtctgttttttcttttcactatgaagtaaagagactgttttccttgtttgaggcaattgcttatttctccttctgtttttcccccgtttaaaatgtcctgctacaaaatgacctctagaacctgtatatgaagcaggttgcaaggtggttcagctgagtgctagaatatatttaagaatactttactgactgtcagttcaagcaaaaaacaaagcaaacaaaaacctgctgctttgaaataagggctatttgcttcctatggctttctttcgcctcacaacctgtctttccagtttattagcttttgtagcaattacatcgattgaagagtgaccatacaaataggtctgcattttggaaatgggtgctgtgcatgctgagtggtgtctctgagtgtgaatcctggtgaaaggatgaaggaggcatctcgccccatattttctctccctgaactggtctgtctcagttctgctttctgatcatttcccctgttggcagaacctgcccttgaccctcagccacagtgagtcagtgtacactggcacgactccagatgcctgggggataaaactttgcccaagtttgccaatcattcctcgaagctgcccagttgttctagtctttgttgatgtttcctagaaaattttggctccacatttgtcatggttacttagtttatttgacagcatgtcttgctttgtgttggatactttagaggatacagcagtaagacttgggcactgtcttggagtagctcaaagaagaggaagataaataataataaccttttaaaaatcggccaggcatgctggcttacgcctgtgatcccagcactttgggaggccgagtcagggggatcacttgaggtcaggagttcaagaccagcctggcaaacatggcaaaaccctgtctttactaaaaaaaaaatacaaaaattagcgggatatggcggtgcatgcccttaatcccatctactctggaggctgaggcaggagaatcgcttgaatccgggagacggaggtttcagtgagcca

SEQ ID NO: 110029 - DNA, 1041 bp, Homo sapiens
ccgacctaaggccgcttttatcatatgtgattttgccagatccattgacttatgaactgaattcctcgtgcagcatgtttccacctttgtcccatgtcacagatgagatggtctcagaaggaggagtcttcttccctatctgcatggaaggcagagtcaggattgatcatatgccttcctaacccacaaccaggtttttttttttctctttagcctaatttttgtaattccacagggattatgtacacgtggagtagtcacgcttatggcaggaactgggtccagaagttcggcaagatgcgcacgctgaaagggatagaagaatggtttctctttgagtctccagcagctctaggctgtgctcggctccttctggcctgggttggagatgcctgtttagaaatctgtagctgtttctcctctggcatctaatgaattctggctgactttgaatgttcccttgacacgactgcagttctttaaagcccatcttccacatggaattggcaggttcatttaattgtttgggagccagataaaaatgctttgttctttgttcttacattatgccatttcagaatatctcttctcccacaaattgccgagactgttcaatttgagccttcaattgcttctctctgagcagatctttcaattattttgcagggcctgttgtttttgattaggcagttagaatatcagctgggtttcttaatctatttattcatatttctgcttgcctttcttttttctacctttaagtctcttttattgtgaaaagcatgcagtcatagcagctgtaatgaagtgcaagtacttttttcttgtttgctggctgtagtatgtgatcattttttcctttgcttatgttttagggtgataataatgtcctcatcattgttattatttttctttttaaatcagttactatgcttagatctcaaacagacagaagataattagtagataagagaaaaaccaaaaatgctgtgatttggccaggcacagtggctcacacctgtaatcccaacactttcggag

SEQ ID NO: 110030 - DNA, 1550 bp, Homo sapiens
gtagctgggattacaggtgcccaccaccacgcctggctaatttttttttgtatttttagtagagacagggtttcactatgttggtcagggtggtctcaaactcctgatcttgtgatctgcctgcatcggtctcccaaagtgctgggattacagacgtgagccactgcgcccgtccttattgtttgtttctgaagtggtttagtagccactggtgaggcaagaaatcctgccatttctcttgctggagtagtcctgggagctggtagaatcctggggagctgaggatctgccagtccattcctcttctcagagtgagctcatcctctccttgtctactccttgtcagaggtttggcatttgaggaatttggccttgggcaaggtgctgaagctgactgctttgtggttttaagggaaagcttaaaagattttctcgctatgggtattctctgcaataaaaatccattttaattgtttatgacattaatcaatgaaagatttatctgctttgggagaaatttctctagaacagttgaaagcttctgcctaaaagttgattaagagagatttttcttctttggcctccaacggatacccccttctctgcccctccctgcttccaacctgccacttaatggtgtcttctgtgaagccctctgtgtacagcctctccaatcactttttaatttccaggggaaatcgtaatctcactaatcacctagaaaggaatgtggagatgggagtatgaaggacgcagttcaggccttgaggcccagcgggcgtttgttttagtcaccgcatttgctcaaatgctttgtgcccgtggttaatgctggggagtattggtggaccctgcctctctgtctctcagagtccccttggagaccttcactcttcacttcaaggctgtgtgtgctgcccagctctggtgctggtgacatcagtggaaagagagccacaggtgctgtctggtccctcggaatctcttctctttattataaagtaccgctggaggcagagaaagagatttttgagctttccttctagcccacaaagctcagttttatttggagcttttaaccttgagccttagccagcccctgatgtgtggattttagaatcagtgtgaattttagggagatagggaaggcctgcagaagtttgaccactgcttcttgagcacctcttgctgtctttttctttttgaggagggtgggggctcctttagaattatgctggcatggtgattcttttttcttcttcttctttttttgagagacagagtgtccctccatagcccaggctggagtgcagtggcacagtcttgactcactgcaaaccccacatcccgggttcaagcaattctcctgcctcagcctccccagtagctgggattacaggcatgcaccaccacgtccagctaatttttgtatttttagtagacaccaggtttcacgacgttggccaggctgatctcgaaatcctgacctcaagcgatccgctcgccttggcctcccaaagtgctgggattatagccatgagccactgcag

SEQ ID NO: 110031 - DNA, 1313 bp, Homo sapiens
atatttccagcaaaggtaaaattcaaaaacgtaagggttagaaaagcaagttgtagaatgactagtacatgacaccatttattgaatgttaaacaatagtataaattgcttatgaatcacacatatggtagaagtatgaaatgtgctttagagtgacacactcgtatttcaggatagtagtcatctctctaaatgacagcagagtggaatggaataactgtatctgtagctttcttttttaaattattattcaaaagcccgaaggaaatgtagcaaagtgtcaagatttgctaaaggtggctgatggataaatgagtactcgtggtattaattctgttgtgtgtttggaaatactacaagggaaataccttaagaaaactagtcaacgtacgtgaaaatattttgtaaactcaagtactcaagaatgttagcaagtatgatttttatttatactcccatctcatcacaaaacaatggagactttgtcaaaaattataaaaatagaccaggtgcggtgactcacgcctgtaatcccagcactttgggaggccaaggcgagtggatcacgaggtcaggagttcaagaccagcctgaccgagatggtgaaaccctgtctctactaaaaatacaaaaattagccgggcatggaggtgggcgcctgtaatcccagctacttgggaggctgaggcagagaattgcttgaacccgggaggcggaggttgcagtcagccgagatcgcgccactgtactgcagcctgggcgacagagtgagacttcatctccaaagaaaaaaaaattataaaaataattgaactagtggggtttaaagacgtaaggaaaataattaaaaagagccatttgtgatgtgtgtgggattgtccaaaatttgaatacgctttctgttcatcactttagactcaggtgaagttccaaagagttaataatggtgggccatggtcatttttgtttttattggaatttatagttctcctgcttccaaggaagatttgaggtggcagagtcccagcttgctgtggccttgtggccctgaaagtatcttctactcagagagcctgcacattgccctgtcatttgtgcctgtccctctctaggcagcactacttcagagccatctgagacgaatggtggttttaaagatgattgagaaggagcttcttggagcttcttagaggactgttgtgtgtttaattaccttttcccgtaggctgtaggaaaactccccacttcggagttttcctgctgtgcatgtggaggcaactgatcagttctcattataataatccttgcctaga

SEQ ID NO: 110032 - DNA, 1065 bp, Homo sapiens
cttgctagattctccccttgcaaatgcttgcagcctacgcgtcccctgttgccttgttcctcagtatgggacccgtgaaccagcaccagcacctgggagcttgtttgaagtgcagcatttcaggccccacccaagccttactgaagagaaactgcatctccacaaggtcccagggtgactcagatgcacattcaagtttgagaagcagtgtcccttctagaactgcaaaaggtaaagcagatcttagggctgctagcgttcaaaaaataggatgctttttatttttacgtaagagcaaagcaacctgttagtaaagggaaaaaatattttttgttgggctaagccattatttaaaactttattttggaacttcaaacatataaaaatagagactggtataatgaacccccatatacctttgttttttctgtaacctctaccccaccgtggattattttagatcaaacctagacgtataatttatccctaaatatatctttttcctttttttgaatattgtggtaaaatacacatagcataaaattacgatcttcacagtttctaagtgtacagtttagtagtgttaagtacgttcacatttttgtgcaatcaatttcaagaactcttttcatcttgtaaaactgaaactgtataaatattaagcaacgtcttttttccttttgaacataccattttcactcttcaagaaaagttaacaatagttgggtgtggtggcgtgttcctgcagtcctggaggctgaggtaagagggttgcttgaatccagcagtttgaggctgcagtgagctacgatgacatcactgcacttcaccctgggaaacagaacgagactttgtctcttaaaaagtaaagttcattgatatcgtcaaatgtctggttagtgttcacatttcccagagtggacaaagaaaccgaagaatttggttcagcgtcttctcgaaatgaattggtagccctgtttgtatagtgaagaatctagggacagtggcgaaagtggggattttttttttttcctttccttaacttacagcttgacaggattttaa

SEQ ID NO: 110033 - DNA, 1041 bp, Homo sapiens
tctttgtttatttggtgtcttgagtttccaagatatgctcaaattatgatttccctaagtatattgccttgaaaataccaggaaaaaaaccttcttagtctttttatttatgttgggaatttctcctggcatctgtgatcagtgcaaatagatcatctacacaatgatgagaatttctgtttgcatattaccattagctagttttatatactaaaaatggacctacatacctgttctgtgagggaagcagggacatgctccactatttattgcaaggagatatttttccagaaacaccagaaggatgtcaagaaaaggttgctcttggttcttgtttctgttattctgggaataaataaaggtaaaaagaattgttttttctgcctagctgtagtttcagaaatggcattagacatgtgttatttctggaaatctgtccttcacagtgaagtcatttctggtgtctaccgttggattttttttttcctaactgactaagcaacacttttattattttattttgttaaacgaagtgttgactctggatgtgggtgttcaggaccttaattcttttctgttggaggtcattggactgagttcagtcccagcagtgataagagttataatgttttcttgttatgttgcacgctttagaaatagttcacaaaacacttttcacatctttatactctgcatacatggatttttcttgtttgttaggtattttggcttgggcttgagagtcaccctggaacaagcctctggaaactgtatttacacatttaaaaacaaaaaaaatcttcctgtgataaactctagggccagcagaggtaggtaggacctggcctgggcaagtgtcttgtaatttccctagaggctgcagcctcagggaaatgctgctggagctaggtacaataagactttttaaaaagaataacactatcaagtaaaaattaagtattaattgcaaagttagagcttcagagcaaatcaacttcctgtaataagcagcccattgaattcttttctgccaagagctcc

SEQ ID NO: 110034 - DNA, 1194 bp, Homo sapiens
tagaaacattagggtaattatagagctacgttctgcttttcagttgctataatattagcctgggtctgctcgtaccagctgtattaataagcaatgactatggccgggcgcggtggctcacgtctgtaatcccagcactttgggaggccgaggcaggcagatcacctgaggtcaggagttcgagaccggcctggccaacatggtgaaaccccgtctctactaaaaaaatacaaaaagtagccaggtgtggtggcaggtgcctgtaatcccagctactcaggaggctgaggcaggagaatctcttgaacctgggaggcagaggttgcagtgagctgagatcatgccagcctaggcatcaacagcgaaactctatcccaaataaaaataaaaaaagcaatgactgaagtttagcaaactcctaaattaagactttttctgagcctttctctgtagcatgtatttgctactagaggcaggcaaggtcataacctagggtgagctttgggttattaattcaaagacccagtgtctaaatcctcatctgtaaaatggggacaaaattatctgaactcccagtcactggatgtggggaccagtgagcctgctgggtgtgaaagcacgttgggagctgaagatggaccctgcctcacgggcagtgggggttgttatgtagcacgattcctgaagtgtgggccaaaggagctgccagtgccacatgaatttgtgagtggtcgtcatgggtgtgtgtcatggaatagaagtgttaatatttaatatctgggctaataattgtaatcattgtttgacacaagagaatgtacaagatgattttaccctatgaagtaaatgagtttgtttttctccattctacaaaccaagcagtaaaagtgcaggtgggttaaataataggcctaaagtcgaatcaaccatcggaatgtaatttgttaaaactttgccttttgttcacagcttttagagtttttcttttctcatggatcacatttttgggaagggcttcccatcacctctataccagtaataacagctgacatttattgaagcttggtctgtgccgacacattttacagatgagaaaactgagctagaaatgttaagtagtttaccagaggtcatgtagctggtgtggaagacccatttaagttttgctatcttaataacagtaataaaagcatt

SEQ ID NO: 110035 - DNA, 1018 bp, Homo sapiens
aatccttttgcctcagcctccacagtagctgggactataggcacagaccactatacccagctaatttttaaatatgtagtagagatagggtctctctatgttgcccagactgttttcaaactcctggcctcaagcgatcctcccaccgtgggcctcccaaagtgctgagattacagacatgagccaccccccagccagaggtggctctttaaagatgtgggggacgggaatcatgcactggtttcgaaagggagaaaagtgcttggacacgggggaatgcctggactggaccctgagaaatgggcagtgaagcccacctgaggctaagtgctaagtgctgagaattgttaaggatgtttcccagatgtttgaggaaatgcgatgttttcccatacagtcaaggggtgttggcagccttcttctgtcacttactgtgtcatcttcagctaatcacctcctctttctggccctcactttccccaactataaattgaggaaattaggcttcccttcctggtctgtgattttaggactccgtaagtagagttgcctcttactgatatcaaaacctgtgttaggtagctatacttttgaaatgatgggttagatgtagagatttgcagtggtggtcggtttgagggcagtgatttatatttcaaggaaatgtttggaacgcagtttcggttctcattcgaagaagtaaagacgtcatgtcacttgacacatggggaaacccacatcgctggctgtggctctcagaagagtgactcattaaactccaggggtgctttgacctgcgttgggaggttggtaacttggcccctgctgcttttggtggtgcaaaagctctgggcagctggctgggctgaatgtaactgcgtcttggaaggcaccaaggcggccctgagcagtttacattgactgtggaagccaaatattgtcgtgcaaattaagtaggacaccaaaaggaaaattcatcttaatcttctttaaatacttactgctcatttgccaaggt

SEQ ID NO: 110036 - DNA, 1035 bp, Homo sapiens
aaactccttagcctgttctacaaggttcttggaaacccagctccagcccacatctctagcttcctctcctataaccacttccgttttaccatgtatttcttgtatgcctgctatgagataggcaccatgtgaggtactggccttgcattatatgttaaggtaaagacacaaacattctgaacatgtttagagggcctcagtgctctttttcctgttgcctcttcatccacacactgaactctcagaagctcttactctcatttcaaccacgttggcctttcagttctttgaaaatagcacatcctcctgcccacagaggcctttgatggaaagccccatctctctcatcccacttaactcttactgatccgtgagatctcagctctgtcaaatctccacttcttggggaggccttttgggccagcctagaacaggtcaaatttttccctggccttctagcgtcacaggtttcttagttgcaccagtcggttatgaatttgcaattgtttgtgcttaatgtctggtattttacactgccatagaaactcaatgatggccttttgtgtatctgtttctgtcttttttttaattgcctgaaaagcagatcaacaaatattgctggtatcgttggctattttaccttcgttcttgaacttgggcaattgggtggttcaccattcatgatgaggcactaagatggctgtgtgtgttctgagctttaagtatataccttgatgtgttttgggaacttatctttccttcctagtctcccacctctttgtagcatataatcatgaaattataagactgacatcttttgaaattgtctagtccagttattcccaaccttttctaaatatgagaatttcttttttctcaattaagaaaagtatgagatagtgatgcacacctgtagtcccagctgcttgggaggttgaggcaggaggatgcttaagtttaggagtttaagaccagcctgggcaatatagtgagatcccatctccaaaaaaaaaaaaaatacgtgagattcatgtg

SEQ ID NO: 110037 - DNA, 1033 bp, Homo sapiens
acagattcttataattttaatgctgccaggaaactcgaaaattaggtggcttgacttcctccctcctccgttttatagacatggaaactgagggccaaaaagaaaaggggacttgatcatcctgaatgctgcctttacttttgggcggaatggaggttatgtaaatgttgggtaattaatgctttaagaaagatacttgtacctgagacagttggcttcatagcatttgtgctccagggaggattctgctgactttgaagacaggggaagtcactccaagagggctgtgcttcaaggtagggaaaatttcccctgttacaaagccaccttgtagtttgaagttctcttaattgctattagaggaaggatgctaaataaatagcctcataggcaaggtgtatttttggtctgtcgtgtttgctttggtcttttgatttgttcttcatctctttctctctggtttctttcctctaaaaagtgtgaccttttcttatgcctgtgctgtttccacagctttgaatagcatgatgaatattttgatctctgaacaactaatatctgtaatcaaggctggcgggctggactctggactataggaccggcctgtggctgggaggagttgccgctgcatgggctgaaacacctcctcaggatctgaaagaaccagcataacgttcactccctgtggctggtcttagagcttaggaggatttagggtgttgtaataggattcaaagaattagagaggagttaagctagtgggaatctttctgagatcagctcatccaccccatcattttactgatggagaaacttaacccctagtgaacagtgacttgctcaaggtcaaacagtgatggtagtgatgagaatgatgaaattgagaaactcttcctcactgttggctaggcgatgttccaagtacttagaattattaatccatttaatcctcacaacagtcctgtaaggagagtactgttacctgtccgcactttatagataagaaacctaaagccaggaaatcaccttgctc

SEQ ID NO: 110038 - DNA, 1075 bp, Homo sapiens
cccagggactggacggtaaggaagatgagtgtggtgggtggctcagtaaatgccgactcctcagtatgagtcagggatgccaggaaggcagggtacattggtaaatggagatcacctctcatccctgttttctgatggggccactgcccttcaacacctgcccgttgttcttccactgccgtggttctggaacttcagtgtgtatcagtgtcctgcttgttgaaacacagatggccaggccccacttccacagtttctgactctgtaactctggaatggagcctgagaatttgcatttctgatgagtttccaggtgatgcagctgctgctggttgagggaccgcactttaagaaccgcagccaagggcccggggccgagggtctgggctgatagaactttagatgttgtggatttttatgaaaaatctccagattttaagtattgagaataaatcaaattttaaagaaacaccatggggtttaaaactgtaggtcaaacagaacactgcctatcaacttatcgcctctgatctgaatactttcaggaaagttcttttgcagcctgctctgaaaactgagacccagagaagggtggcagttcatccacagcatacagctagtttggggcagaatcgtgactagaacccggtgtcctgctgtgtgtttgtccttgcatactgtcttctgaatacattttctctttgaatgggaaaacgtttgaaaataataataaccacactaaaatattgcgaaccgtgttccaggtgtggttttaattactttatgtatgttagctaaatcagtcctaacaccaacactatgaggaaggtacttgtaataggctgtttttgcattgctgtaaagacatccctgagactggtaatttaaaccgaggtttaattggctcacagttctgcaggtggtataggaagcatagtgctggcatctgctcagcctctggtgaagcctcagagagtttccagtcatgatggaagtaaaatggcagcaggcacttcacatggcgaatgcaggagcaagcaaaagtgggggaaaaggtgcccccatacttttaaat

SEQ ID NO: 110039 - DNA, 1722 bp, Homo sapiens
aaagtaatagtggagttcttccacctgggacagagacaaaaaggcatagtgagtgagacaagggtgtttactatgtcacaggttttaataggactttactgtatcatttaatcatcaccattacactttgaggttaaaaaaaaaaaactgtggtgaaccctagaattagaaaaatataggaattcatccaagtttaccagcaagtgagtggcataggtgggacttaacctgggtcaggatgaatacaaaaccctggcttttaacaaggacaatattctgcactcaggaccaagagacccagattttacctctgaatctccagttattaacatttgctgtgtgacgttgggcaagtcactcagactttaagcctcagtttctaaatatataagttgggcttaatcattatatgtacttcatgtgttcaggtgcattcaattctgaatctgaaagtttttatatagtaagagaaaagggaatttctgagttcttgtaccagctctgttttgtactatgtggtatgtgttttaccctaagtctcctaacctatgttgggcctaattctgcccgttttccaatgatagaaaatgcaaaggaaaaagtaaaatcactcctaaacttgaatcaccattaatattttgatgcacatttcttctaaacatctgtgttatacatatgcttatacccagacatatgtgtacatttacataacagggatggtatgggatccatgctcttttattaggagtaaatttatcaatatgctgtcctctacattttaaagaggagctataagttgaaacttgtagaatgatgttttcctagcttctttcattcatctctttttattccaaagaagatgcatttctagaacttagagcacattctgttatttatgtatatatgtatgaatgacaggtctcactctgttgcccaggctggagtgcaatgatgccatcacggctcactgtagccttgacctcttgggctcaagcgatcctcctacctcagcatcccaagtacctgggaccacaggagagcacagccatgcctagttaatttttaaattttttttttttttttttttttgtagagatggtggtcttgttgcccaggctggtcttgaactcttgggctcaagtgattctcccaccttggcctcccaaagtgttgggattacaggcatgagctaccacgccccacctctattctattatttaataattgggagtaatgaattctcacattggtgacctccgaggattttacctaccttatttgccatcttctgaggattttacctacctttccatgccgcctcctgtctctgcatgttctacattgtcatgtaacatacaccccaatttctcactttctttctttgcttaggctcttaggctcttttctctctctctctctctttctttttttttttttttttttttttttttgagacagagtcttgctctgtcactcaggctggagagcagtggccgatctcaatcttggctcactgcaacctccgcttcccgggttccagtgattctcctgcctcagcctctggagtagctgggattacaggtgcgtgccaccatgcctagctaattttttgtatttttagtagagatggggtttcgccatgttggccaggctggtcttgaactcctgacctcgagtgatgcacccacctcggccttccaaagtgctgggattacaggcgtg

SEQ ID NO: 110040 - DNA, 2343 bp, Homo sapiens
gacagctgtcataatcaatgacctgtcaacaccaagacactccactgtcttatcaaagtagggttctgcacaggctgtggggttgatctgagcttgctggtggtcactgtggtctctggggtctgtcctgatgctctctgtttgtacagagattctgatttttttttggaggcaggtgttagctgcaattgtctagattcacttcttattcctctgtaccttggtcttttaggagaatgattggtgttattatctagttaatatttgagagcccagactgtgcgaaaggctggcagtgcataataaacaccatttatcaaaattcagggaaattgccagagttcattaatgttttaataatatttggtattagcataatgtctctgccagctcttttgttatcttcattccctggtgaggttcgatagagactggtttgtgtccccattgaacagatgcagaaaagggggtatgcagatgctggagaaggcaggaaagaaacaagccgtcacctaacctacagaccaagtggtcggtaccatggcatgatttttacggtagttaatcatttactaatcatcttctcagggccaggaacttcacatagacttttgaggaggtattgctttcccattacatagatgaagatattgaaatttagtggggtgaagaaagtggatatccagggtcacaaagctaatagatggtagagatgctactgaaactcaggtcagccttactctaaaacatgttcctcttctcctacttgagactattaagaatagatgcataaaatccagaggaaaggctttgttttaaaaaatcacttctttcaggattttgtttcgattttagctataagttttagcgtaatataagtagatttctggaacagtctgagttcaagtattctataataagatctcctatttgaatttttgattgagaaaatcatagtaattataataaaatgttaaaatctatagtttcattcccagtctgcctcttgttggctttgtggtcttagtattttctctctctttttttgagacaggatcttgctccgttgcccagcctggagtgcaatagtatgatcatggctcaccgcagcctcaaagtcctaggcgtaagctatcttcctgtctcagcctccctagtggctaggactagagatgtgtaccaccgtgcccagctaattttttattttttaaaatttttgtgtagatggagtctcactatgttgcccaggctggtctcaaaatcctggcctcaagtgatccttctggcttggcctcccaaagtgctggtattacaggcatgagccaccatgcctggccagttttttcatttattaaacatggataacagtaagcattgtttttcagaactgttatgtcagaatgtgaaattactttgctaactaaaaaagaatatatacgtgagtttattatttaaataaatgtttgtttatttatttatttgagacagggtctcgctctgtcacctaggctagagtgcagtggtacagtctcagctcactgcaacctctacttcctgggctccaagtgatcctcccaccccagcctcccaagtagctaggagtgcaggcgtgtaacaccacgcctggctagttttttgtatttttggtagagacagggtttcgccatgttgcccaggctggtctcacacccctgagttcaagcaatcctcctgctttgacctcccagagtgctgggataaaaatatactttcttagaagatccagtgaacttaaattggaattatttctgcagcttgacatctgaaagaactatgcagtacaattagggtagcccaggaggattttggctcataccatgtgctgaccattgtgctagctactttgcctaagtccattagctcatgtaatcttttttccacaactttgtaagcataagtatcatgcctattttggaagtgaaataggtgttgttaccctttttaaagatgaaatggtgaggctcaaagaaagaagtcaagaacttaggccaagatcattcagagttggagactgaatccagttattcctgactcagaagctcatgttccttttactgtagtagcaatcagtttccatcacttttgggtgagacatactatactcagtagcctgcctagtctgtaggagcaaagataatttctttttttcttttttcttttttttttgagatacagttttgcccttgttgcccaggctggagtgcagtggcatgatcttggctcactgcaacctctgcctcctgggttcaagtgattctcctgcctcagcctcccgagtagctgggattacaggcgcccgctacc

SEQ ID NO: 110041 - DNA, 1015 bp, Homo sapiens
aagaaaggcaacacaccccaaaaatatgaacatgaattcattaggaaatcatttattcacctcgtctctttcccaattaaaaaattatagcatcagtgtgaaatttcattaataaagtcacacttaatttcattaagaaatttcacacatttctcttgtgtgatttactctcattgctctcttgtttgtatgatttggagttgggattgggagtagagaggacatcattttcttaaatttctagaatcgtggattttatgattgatgggttttcagcatatttatagaccccatcaactgaggatgcttcttcttctagcacttgacaataaaaatcacctttgcctgactcatgtcttcttgccattcagatcttatttcaaatgtcacatctcggagaggcatctcttaaccatctcatctaaaacagatggtcaaacactttcctgcattatcctatttgtgtacctcaaaacgctgatactatttgactgattggttgatcttctctcattccactcacatggaaactcagggaaagcagtaaatgtgcctttttgttgcccatctccagcacctggaatgatgtctggcccagagtaggtagtcaacaacatttattaaatgagtgaaccatgtctatttccacatcaaattcttactgttttcactgtatactttgtttcatacctgtgatcattacagtccttatccgggctgagatgagctcttccaagacaggttttgtctcttccttcaatcgattctccaagatcagcagccccagaaatatcaggtctgattctaccgtctccctgaaaatacatatatagatgtattgaacagaaataacacatattacagctttttttttgagacggagtctcgctctgtcatccaggctggaggacagtggttcaagtcattctcctgcctcagcttcccaagtaactgggattataggtgcccaccaccacgcccggctaatttttgtatttttaatagatacggggtt

SEQ ID NO: 110042 - DNA, 1420 bp, Homo sapiens
tgtatttcaccttgcactctctagtttccttcgtgctccctcaatatccaactcttaataaattcatggctcccggtgagcattcatcaattctcattccacgcctttagcccttcccgttcccgcccaactctcgctccctcccctggccaaatctctaacctgcaaggctaattccgaattccaaatcggaagcaagagggcggggccccgtgagaggcgatggattgctccagtccgttcccgacgcactgtgcgcatgcgctggtcctccgcggaccgttcgtgctgcccgcctagaaagggtgaagtggttgtttccgtgacggactgagtacgggtgcctgtcaggctcttgcggaagtccatgcgccattgggagggcctcggccgcggctctgtgcccttgctgctgagggccacttcctgggtcattcctggaccgggagccgggctggggctcacacgggggctcccgcgtggccgtctcggcgcctgcgtgacctccccgccggcgggatgtggcgactacgtcgggccgctgtggcctggtaagtgcaggctctaatctggccccgttaattctggggcctcttgagagtggggctgtcttatctctatctccaaaaatgtgcaggtgactctcaggccaggccgacggcagttggagaattcccagatgttcttgaggacccagaatgacaggagccctggctgggcttacgttcggagccggcttcaatactggcccttttctctggccctacccaacccgaaaattctggacgcctctcaatcttggcccgtctctattgtccttttgtctctgccctttacacccttgtgtcttcagtgttctgtctgtctctggttgcctcttttgccttttttctgtcctctccctgccaggtttggctctgtccatgagtcacctctctccacatttctcctaactctcggtgtcttctttttcttccatttccacgccatgtgtacattgcatcttcaggtacctgggctcttctatcggggaaaggggcgtccgtctctttccctagcccgctgatagaagtcagaactagagcaatgacgcacacggtgtcagagacggtgattcgagatgccctttcaatagcagcttttttctgtgtttcgggagggagacttactttttgatgcaaggtcgtgaacgtggcaccacctttctaatctcaatcattgttgccctggggtggtttaattctaaatagaaaatcatagaaatcttttcatttctgtgcgttactatatgcattgtaatgagattaaattggattttataggaaattttgttctagtatcattagataccttcaagcttagctcattgttgcaggcatttgataggaagtaagatgcatcaagcaaaattggaaaaacg

SEQ ID NO: 110043 - DNA, 1056 bp, Homo sapiens
ttatctctaccttttgtagccaagttctttaaaagtctgttagtatccagggtaatttcttttcttagttggccactgccctccctttttcaataggtggatgagaaaaaagtatattggatcgctatgattgccagtaattcatggtgatctttaagaaatatattttcatcaaatttttttaaaacctttgtcagatttcttagtttaggtgtatgtggaggtggaattaatctatacttgcacttattcacagaatttataaagataaaactgttctatgttgacgaatccatttgcaaaaaaagcacactttcaaattgttcttctaatattaatgaggagagctttcaaattgatgtatttgccagtaccacagcgtagtggctgagagcctgtattctggagctggactgcctgggctggaacccgggctcctccacttccttgctgtgtaccttagtttctcatctgtaaatggtgttgataatagtagctgttttgtagggttgtcatgaggattaaacaagttaatactttagccctttataagaatagtatctgacatattttcttagtttcatactctatatgttttgatcttttccagagaaaattagaaaagcccttcctagttcagaagaccttgtaaagttagcaccagactttgacaagattgttgaaagccttagcttattgaaggacttttttacctcaggtaaggaagaagctgtttgatctaatttaaaaatttaagaaccatggaggaaaaatacatggattatttgtttattcccatttttttaaaattaaaatatttagtaccaatgaaaaacaggacattttttaaaaagataaacacaaagttttgttacacaatggttttaatctttgtgtagcccagtaaaatgacagttcctaagcacttaaacatacttggcttttagtgaggggaaaaaatgtatcacttgttcttgacaagtagatgagacttcctatgtatttgcttttcataagtggttggaccaatttggtggttttaaaacaaatttaagt

SEQ ID NO: 110044 - DNA, 1056 bp, Homo sapiens
cttgattgttcatgctactgggggaaaaaaaaataagtagaaattagcctaatagttgtggcttattttgagtgaaggccttagcccttaaggcaattaaatttactgtggagagaagagctaatctaatggggagaaggagcctttgttacaggtgtggtagtgtggttctttgagtgacaagatttctgtttgccagattggttaggagaagtctgtgtgtctgctttctctcttatggcctaggatcactgtggtgaatgaaaaacctgtctcagggcctgactcagataattcccttaaaacccggctaaggtcatagatgaataatcagtaattgaacagaagctctgcaatagaaaagaagccagataattatttttggaaatttaattatatttacagattttattttatacagtagacatggaattaaatttattacattatgttctaatttactctttgcttgttttgatttgcttgtttgacaatacatgtccttgtaaactatttccttttaactttttctcaatttatggtgcttattttccccattaaagacttaccaattttttttttaactatttgttacacatactgaatctagagttgtaattaagctactttcattactggttaagtcaaattatagcaaatgctactataaaaatttactatccaaaaatgtgtctcaagccccaactgatggtttcaaattctgttattaataatatgcagcattgtgtttgcaaagcttggctgttacttgtgatgcttgagaatgatgagtcactcagctaaactgagtgattttgagacttgtgtacaaattgatggttgaatgtaagcatgcaaagagagaccttagcttagcagtaccctttttgaaatcactctgacatcaagtttgaaaatgtgggcaataatcagaggtggtaaggtggccaggctttagctgaatacttttttaactggttcagtctgagggctgaaagccccagatttaaacagtatttagaatttgaagcagtcaagtattagtttaatggttgt

SEQ ID NO: 110045 - DNA, 1082 bp, Homo sapiens
gtttgcaccacttactaaggagtctgtcacataatgcatgcttgggtactgctagctattattttatagcatcttaattaaaatctaaaataatgtgaagaaagggaagaatttgaatttttgttaagtggccctgtaatgtgaagacttaaaattttgatataataggaaatactcccttctagaatgtatttaagaactacttctttaaattcttacgttttcactatttcaaaataattttttcaatgtgagtagcaaggaattttccaagtgaaattcttaattatgatagaaaattacaatgatttccactgtttgtaagagataatagtcattgtttattttattcctaatgttttcgtagatgcttttaaaatgtaatacattttaaataggagatatgacttcaagattttggaagattttaatttagacttaatactatttgataacccatcttttgcttatatagttacacttattattttattgcagttgaagtatcagagaatcttggaacgattagaaaaggagaacaaagaattgagaaaattagtattgcagaaagatgacaaaggcattcatcatagaaagcttaaggtattctaagtttgtcttgtttattctcaaaattttaccgcttaacgttgtgtgttcatcagtaccagtttctaaggagctgtaaagtattctgtcatccttttctttctaacctaatgtgcttggaggatggaggatctcttcctatattaagacattttataagttgtagtctccaaatacttgttttatactatgcccataaaatctttacacttttaagagttatttcgtgtgaatcagtttatttttctgaaatatctagtttatctctaggcttaacttttacataaaattttatataaaatcagaattgttaattgatggacatgtaagtgacttatcatcattgctttacttgtatgccagtgaatgattagaccactttcttcagtttttaaaaaattaacacttttcttctaaggagagctttcttaggcatttcaaagaactttcgaaaaagtgtgtgctggtattgt

SEQ ID NO: 110046 - DNA, 1010 bp, Homo sapiens
atattaaagaagaaggtgggaggggaggaaggagtaaaagaagacaatccagcttggttagaatttagatatttgaagaaagtatggaaaaataataatagctaccatttattgagtgcttcatgcctggcactgtatcatattgtcccataatctcaccaacctttttgaaaaaattaagttgtttacttaaggtcgcataactactaggcagcagagcaggaattcaaactaaggtctgtctgactttaaagaactacacatcattccgggttttcgatacgtgtgttttaataatacattttcaatgtagtaaaattaaatgtatttttttcaaatagcaatggaaaaacattttaaatgcttttgtgcagatttatttaactatatacatgtatagcattattttgctttctaaattgtatattacgcttttaaaacttatgtaaactatatctcacattaatttttcccacttttaaaaatagattcagcagataattgaaggaaagctcttcccaatgaaagctttaggttattttgctgttgtaacaggaaaaggtatgcaaagatggattataataacttatttttagtttctgttgttttcaaataataaagagtaattttcttgatgaaaatttgaccatcattcttccccagggaacagctctgaaagcattgaagctataagagaatatgaagaagagttttttcagaattcaaagctcctaaagtaggtatcttgttaaaacatttaaacattttacagtaagagagtagcttaaattgaactgttttcacttaaaacatcaggttttataactattagtttaacatcggatttctagaatttttcccaaatagtgaactgtatctaataaacaagtccttagctactttttggcagaattgagagcagtttatcacatggtacaatacatactggcatgcttccttggacgtgggcactgaaagacaacatagatatctgcctcttactttatttt

SEQ ID NO: 110047 - DNA, 1037 bp, Homo sapiens
ctggtatgaaaggtaagagtggctgttagcaagcacattcgcagacttggtggtagtattgttgtcctttttgtcattttaatatactttagctcttgttatttttttttaataggacaagcatgctaaaggcacaccaagtgactacaagaaatttaagccttgcagtatcagactgcttttggaaaatggtacgagagtctgttgaacaacaggctgatagtttcaaaggtaagttggattttttaaagaagcaagcaaattaagacattttattagctggcaatctttggcatccatacgattctgtacttctttcctttaacagttgcttggtagttcatttacaattagacagtatctggaaaatagaagaatacaaaccttcagttgttatacaagaacaagatttttcctttcagaggaaacatctctagaaacacatttgcagagttcaaacagatgagaacatttgctagtgcttggaagtacacaataaactatagagaattctagattcaccctgttgaggatgaaggagcagatgtgttgggaagcagagccctctgaacttcctttacttggcaccatttcctgaatcccacactttcctgctcagtgtcttttatcggaagagaatatatttgctttctcttttcccatatgtaaatcctacctgatcctacctatttatgccagttagtccctctgcaatcttgtattactttcatttccattttacagaagaggaaacagaagacagttacttacccaaataacttatcctattacccagtgtcacacaacatgggtaataggcccaggatttggctgttggtggtacaactgcagagtccattctctcagcagctctatggtactaaactacttcagctgtgtgctaatggatttaacatggagaaactagaatcagggagaatagttttgaaagctattgcaaaaatgaaattctgagacgttgagatcccagagtactaaggggtcataggcgcactctcagaaattcagttaataca

SEQ ID NO: 110048 - DNA, 1056 bp, Homo sapiens
cagaagattaaactaggaattattaaaaaacaaaacaaaacaaaacaaaaaactaccttaaagaatctatttctgctaccatgtatcttggctttatcacttaatagctgtgtgatcctttgcctagttgcttaactttcctatgtgttttttcatctataaaatggtgacaataatgttgcctacctcacagcattgttataaggattaagtaagtaattatatgtaaaatacttagacaatgcccagcccatggtaactgctcagggaatggacctgctgttattatggtcctcatcatctgaattgatccatcatgtacatcaccccataaacagcgattgttcaagctaagagtcagtgtgtcctgtgcttgtgtgtgaggttgctcacaaaattgaagtcaatgttaaaagtaattttgtttttcatacctatcttaaaggcagtgtcagtttctaattattcggatgtgatttcacccctttcctatcttgctccagtgttaacttccttatctctgttctcaatttcttcaagcccctttctaagaactccagcagcctccctgcctaagttgcacgttgctgagccctggcagttcttgacacatttacccctgaagaagttagagagctgctgctaccccttcagtagctctcattactggcactaacattttttctgcgccctgtcccatgataggatattttcacatcctaaggttcaagcagtggaagtggttatgaaagcatcaatttttctttccactgctgctttctgtccctcagcactaggtgtcatggaaagaatgtagatctggtgagaaggtcaggaaacatggatcttaatactcaccccaccactcactccgtatttttggacagtcactttcttttttaaaatgagagagggctaaaatccagcattaaaaagcccacatagttataagtagattttgttcttcattatttttgacactgtgctcttcctttcaccgttcagatcattaggagttagctataatacaaagctgaatactcttcggctatgttt

SEQ ID NO: 110049 - DNA, 1068 bp, Homo sapiens
tctcaaggatagtaagtggagacacggcttattgagttctgagttcacagtggtgaaggagtcatccaactttagtgaacatttgtagaaatagattgaacatttcaaagtctttgtcattaatactatagtcgaatattatttgtggaatttttttagtcaactgctttgtaactactaaaaccaatgaataaaatggacacatgatgcttatatgcatttatattctataaagctataatgcagaatattttagtgtgttcgctactgtacttataggaattttataagcaattatacttttaggtatcttaaacacatatataattaaactcttacacatgtgccatatcagtcatgtgggttttttcctttatttcaactgccttcatattgatatagcactttgaaatagttaagaaagcaagaccattattagttataatttgtgtgtgtgtaagtgataaaattcttgattaattaatttttttttctagctgaaaatgcaattgaaaacatggtgggtccagactggaaaaagaggtggttatactggaagaatcggacccaagaacaggtagaaataaacaagtctctagtcttatgatgatataattttgttcattttaattcaggcattaaaatataacctttttgtggctctagaccagtctcaggaatattaaatgttttatatcatactttctaaaatataatgaatctttagaataaagaataaactacataagaaagttttttttaagtgaagtagccatgttgttaaaagacaagagatgaaacatgccccttttgtggttgattacattgttcatttcaattccctgtttgaggtaaaaaggaagattaaagttatgaacaggccaggcacggtgtctcattcctgtaatcacaaccctttgggaggccaagtcagaggaatcgcttgagttaaggagttcgagaccagcctgggcaacatagcaagacctcctctttactaaaagtcaaaaaaaattagccaggtgtggtggcgcatacctgttatcccagctactagtgaggctgagg

SEQ ID NO: 110050 - DNA, 1197 bp, Homo sapiens
aaaatagtaaggttttcagaggatgtacaatgaatatgattggcgggaaaagatacaatttttcttgccttattttattatcttatctatatctaccattaaagtccctacccctcacctccacccctgttcattcctttccgattcttatagcttcttttcctatctagcattcagtcttataccactgtctcattccttgttcattccttaaatgaaagaatctaaatagaatatagaatctaactacataaattaatgaaataatgaagatgaaaaagatttagcatccaatccattttcttttcttgtttgctttgttccttgaattcatttagagaaaggagatcaagtaatggaaaaatagaggagacaaagggaataaaaattgaccaaatgagatgtccctatttctttattttatattttcattttcattttaaatacagttaattgtataatctatatcctatttttttcctagtttcccacatttcttgtttcataagttctctatcagatgtgagtctcaactttcctcaaaataatgaagagacagtcttctttttctctgtgtttctttactatttttttttttggtaatgacttttgtgaaaaatgagccattaagagactgaagcaaagctgaggaagcagacagttagtgattgggtcatgcatgtgttcagggtgcgttggttatctctgctctacagatgggccgagagaaggaggtctgtcagaagagaatttctagagatccatccaaggtttctgactttgatagaggaagatgcattgattagaaagagctgctgtaagggagataaactgcaaaagaaaaatggtatctggccttcaagacttagtgatattaggcctaaagtctctagaacagttggtggcagaacttgcctcagcaactgactggtggtaaatgtgctttggccaaacactctctgaaagaagtgattcctgctcgtaagttatttttgtcaggaacttaaacccataggggaatcccttcaagagaaagaaaggaatttgctttaaagtcagtgcaaagggtctgtaagcctagaagaggaatctggaaaccctttacagaagagccttctccccacaggatttcagggcagcatgtgtgagacccaggctgactgtagaacagaggccataatttggaatatagaaggg

SEQ ID NO: 110051 - DNA, 1850 bp, Homo sapiens
gtagctcatgcctgtaatctcagcatgttgagaggccgaggcaggaaaaccgcttgaggcctgtagtttgagaccagcctgggcaacattgtgagactctatctctacaaacaataaaataaattagccgggcatggtggcacacatctgtagttctagctacttgggaggctgagatgggaggatcacttgagccctaggattttgaggctacaatgagctatgatcatactactgcactctagcctaggtgacagagtaagaccttgtctctttaaaaaaaaaagacaaaaattattatttgcttttaaaataaatcataattggaaaagatgggtgataaaacataccaggagtttattttcattgcatgaaactctgttgggaatggactcctaggtatcacttagttttttgggaaatctgcacttccattaaagtgtatagcttaagaatatgacattctctgagactatataggtttcatgctgataaaactactgtataacagagattttctatgactatgaaaagtattagcaatagttctaacatgataaaaaatttactctccatatatataggttaattttatcatctttattcatttataaaaacgatgctcctcaggttttttaactttctttaaacagttaggcgattagagaaaaatgttaaagaggtattggaagattttgctgaagatggtgagaagaagattaaattgcttactggtaaacgcgttcaactggcggaagacctcagtgagtagttcttactgccctctaccttactacctttccacctttcccatttccatttgtttgttgatccatttaatctcaaacttacagaaaagttacaaggaactgggctgagcacggtggctcacgcttgtaatcccagcactttgggaggccaagatgggtggaaaacaaggtcagaagatcaagaccatcctggctaacacagtgaaaccccgtctctactaaaaatacaaaaaacttagccaggtgtggtggtgggtgcctatagtcccagctacttgggaggctgaggcaggagaatggtgtgaacccgggaggcggagcttgcggtgagccaagatcctgccactgcactccagcctgagcgacagggcgagattctgtctcaaaaaaaaaaaaaaaaaaaaagttacaaggaatttttttcttctctgaagtatttgagagtaagttgctgaccttaagtcctatcacttccaagtaggttcatgtatagttcttagaaacagattttctcatagcaaccgaacattgataaattacaatatctaattctcagacccctttcaagtttcacccgttgtcccagtattatccctccatataacaagatgttccaggctcaatacctgacccagcttcctttttttgaagaatggtgtttagaaatggagacctagaaattatatatgctgttattggaatatcactgttccctggtttctcagtggaaagagctaggaactaagtgttgtgaatgtttgtgtgtgtgcaggtgaatatacacacactgacatctgtattcctaaatcatgtgtatatttatttattaaaaactgtgagttgatgctgatacttcccattttaatccagcattacaaggtttgttctagtgttctccctttcgatatttgtcacttgctttcctgatagaaaacgggcttctagtatccttaatatattttcatattttggtcagtcctcctatacgtaacccaacttgaatgaagatatgtccttttccattgcagaaatgttctttttccccagctcggactcaacactacacaccaggccaccaca

SEQ ID NO: 110052 - DNA, 1348 bp, Homo sapiens
gtcaagccaagttctatgttctactgctggttttcctgagaaagcagtcatataactcccttgaaatgatttactacttttgtacatataaaattataatggtgttaatgtaccaaataatgtccttggaagcaagggttttgccagtaactcagctgcatcagtcaccctcaaggagatgagccatgactttgttcattagttggaaaagagtctggagagtgccttttcgttactgtttatctttggtctgacacttgggaatagggtcatggatacttcagccagaaaactttccaaatttaagttattaatgtattataaggatcaaagtttctagtatagcctgttcaattagaacatagtgtgttggttgattggatttggagaaagggaggcaatcaaatttttactacagtttcagcctgttacagaatattgtatagagtgttaaaatgttgatgcattcatatttttgccagttttaagcttgtacgattttaaatcatttccttaccttggagacttcccccccacctttttttttttttttgagatggagtctcgctgtgtcgcccaggctagagtgcagtggcacgatctcggctcactgcaaggtggttctcccacctctgcctcccgagtagctggggctacaggcgcccgccaccatgcctggcttattttttgtatttttagtagagacggggtttccccatgttagccaggatggtctcgatctcctgacctcatgatccgcccgcctcggcctcccaaagtgctggaattataggcatgagccaccatgcccagccctgactgccctttaagatgagtacataagtagtagtagtacatttttctttcacatcctggagaagatatactgtgttcactattgaaatgaaaccataaagctagagttaggaagattgaagaaatgaaaaaggagctcacatgattttgtctcaggagaggctcttccaggattctttggagatatggtagattccatagctggagcagggaaaggacaggatgagcctgtgggtgtagaaaggaagggagtgcttgaaagatgatgaggagatgtcagcaggtcacagaaaccctctgaaggaggctccaactggccaggctggggacaatttgggccccaaaataatgacagtaacaaattgtaactcattgaatgaaataggaatccatacattggtaattatataaataagggaataaaaccatgatgcaaaaagggatgtttatgtcatcacgcaaaatatgttcacagaaaatatgtactaattaaaagagggaaaagagtaactttacagtggatgaagcctgg

SEQ ID NO: 110053 - DNA, 1047 bp, Homo sapiens
gataatgatgaagataatcattattaccacaggtacttcctataatataagcatctttcaaattgtatgagaactttcatagaacatctgagtaaatgaacagtacagtgtgcatgaaaccactaagcaaaccaagggaagttaattttctttatatgaattgtaaacatgtctctagatatcctttatcagattccaccatgcgtaagtagtgtctaagttgccccatatttagagtttttcaatgaggttgtgttcctacttagaatcctaaagttcagctataacagatatattaataaaatctgtggaatctttaattgagcataatggtggctgttattttaacttgaggctttttgttgagctggattggaagtgcaacttattagaaattacagtgtatttattcctatttcttgttctttatgtgagagaagatatactttagtagactgaatacttcagagctgtatctcatttaccaataaaatgtgaaaacagtggtaaattccttcacttgggctaccattgtacaggcctattttaatggtatagtttgatatccttaatgttaaaagcaatatagcttaaagaggctggtaaattagaattttccaatatcctcagctttttttcctctcacagttaatttgctctgctgactccctacgcgaggtggcaacagctggcccttttactggagcttgtggggattagagagtcgggctcgcagcagcgtgctcggcctcttgcctctgttgactgttctttattgtttgatgcctgagcatctcccagacagcgagcaattgtttctggaaacttaaagtttgtttctcttgggagtagacaatgcttttggggcttgtctttgtgtttcttcactttcccagtctcctcttatccttcatcctgtgctttctcttgataattagaaaggagcaaagataccacctttttatttaggtctgcatgagattctaaaacttagaagtataggctatagatgaaagtttcttttttcagtaagccacctcagtaaca

SEQ ID NO: 110054 - DNA, 1029 bp, Homo sapiens
aacagcatacgccagggcctgttggggcgtggggggcgaggggagggaacttagaggacttaagtgcagcagaccaccatggcacacgtatacctgtgtagcctgcacattctgcacatagagcccgcttttgtttttgtttttgtttttaagaagaaataacggggaaaaaaaaggtttcaaaactcataaagaaagagaaagagagggagggagggagggaagaaaatgcttccatgtaactgcatcatttggtactttggagtccatatcctacttgaaactctaggatctggccctcacatttatgtagtgctttattttacagtttacaaaacttctgcttgtccatgtgtgtctgtaaagtcatatgaggcattatgcccattgttcagatagagaaattaacgttcattgacataaatggttaagcccattatgtaaatatttatggcaaagctggggctaatcatatgtgttacagataggactttttttaaagaattgtttaggtattctgttcatcattagtctctgggtttgtgtttgtggtaaccatagacaaccaagttcatataatttggcttcttttttatgtgatttttgatacgtgttaaggatctataacaatgaatttgcctcctaaagaggtacataatgttttcattcctccaaaaagataattctaggtttataaatctatgtatgctcagtgccagttgaattttgtgattgttcaatagaaaagaaattgtgacttaaaggtgattttccagtttaatggaataaatgaaattagtttagaagttatttttatttttctgagcctgattctcactcagttgtgataaacagcacctctgtaagataaactcggtgataaaccgagaacttctgaaatcagcctaacatgaatacctgttcttcttgtgctaagtttcataatgctttatcctaatacaccatttttttaagaaatggaacttgtatttcatttttgctttcatctcacctaattcataattttat

SEQ ID NO: 110055 - DNA, 1085 bp, Homo sapiens
acgggcgctttaaccatcagctgcctctcgaatggaagaacagtggtaatggattaacatcctattttgttgtactaaagtgacaaatcggaataatataattggtatggccattaggttcagtccttgaagataagaaacttgttctctgtttgttgtcttatttgtggtggcactcgtttaatggattaactgaggttgctcaatgttcagtttcttttccagaaatacaatgctaggtgttttgaaataaaacttatatagcaattgtttaaagttatcaattgtatataaaatcacagtagcctgctaaatcattgtatgtgtctgtagtattctattcccagaaactatttgaccatgataattcagtttatattcaccacatgaaagaaaaatgggtaacagaagaacccttaaaacaggttaatttggattgtaacgttcagtgaaagaaatttcaacccttcatagccagcgaagaaatttgccttggaagccaagtcagtaccagcttacctatttgattcagttgctgttttctcactctctatatccatttgaaattgatttattttagatgttgtatacttacgttaggctttctgttaatagtggtttttctcctgttgacagagccaccggattatgacacaggatgaggaagattaaggataatcaattgactaatttcatttagaatattatcaaacatttcaactaggtatcagaaaaaggctttctttcataagactattttaaatagaaattatttcaacaattaaagtaatgttgaccatccccctctcagctgaataaagaaaaatttagttcaatttattgcaatttaattacaatactaccttcacaacattttcatgtgttttaaataaatattttttaattggctaaaggacattcaagcaaagaaatgctttctttacttaaaatgtctatctcatttgctgccttttcactaagcctttactttgttaataaaagtgtccattgtgtgatgtttttgattttacagtttgctaaatcttattttcttggagttgctttttggtaacagccccattgct

SEQ ID NO: 110056 - DNA, 1815 bp, Homo sapiens
tacacatctatttctaaagaataaaacaggaccatatttatttacttctgtcaactatagaaagaaagaccttcagctgtatttccacagatttctcccaaggaaaaggctaatattagtcactactgttatcacatccctttgtataagttttaaaaagagatggagggagatcttcatttctttgaggagatcagtattgtaacgtatgtgaatagatgataacaattaatattactaaaagtcccacatgagagtcctgacgccctctccatgccccacagtaatgtggcttctttcatgggtttttttttcttctttttagctgatctcatcctaagcatgctttatttttccttgaaagctaggtatttatcaactgcagatgttattgaaagaaaataaaattcagtctcaagagtaaaccctgtgtcttgtgtctgtagttcaaaagtcagaaatgattctaatttaaacaaaaagatactaaatatacagaagttaaattcgaactagccacagaatcatttgtttttatgtcagaatttgcaaagagtggagtggacaaagctctgtatggaagactgaacaactgtaaatagatgatatccaaacttaatttggctaggacttcaattttaaaaatcagtgtacctaggcagtgcacagcacgaaataagtggcccttgcagcttccccgtttaacccactgtgctatagttgcgggtggaacagtcaacctttctagtagtttatgatattgccctctttgtattcccattttctacagttttttccgcagacttctttctgcaaattattcagcctccaaatgcaaatgaatgatataaaaataagtagggaacatggcagagagtggtgcttcccagcctcacaatgtgggaatttgacataggatgagagtcagagtataggtttaaaagataaaatctttagttaataattttgtatttatttattctagatgtatgtatctgaggaaagaaatctggtatttttgctttccaataaaggggatcaaagtaatggtttttctctcagttctctaagctggtctatgttatagctctagcagtatggaaatgtgctttaaaatatgcttaccttttgaatgatcatggctatatgttgttgagatatttgaaacttaccttgttttcacttgtgcactgtgaatgaactttgtattatttttttaaaaccttcacattacgtgtagatattattgcaacttatattttgcctgagcttgatcaaaggtcatttgtgtagatgagtaattaaaaaatatttaaatcacattataattctattattggagagcatcttttaaatttttttctgttttaacgagggaaagagaaacctgtatacctagggtcattatttgaccccatagtataaccagattcatggtctaacaagctctcagtgtggcttttctctgaatgcttgaatttcacatgccttgcatttcacagttgtactccatggtcaaccggtgctttttttcacatcgtggtacttgtcaaaacattttgttattttccttggtaaaatatataaaaaaggttttctaatttcactttgctgccaaggctgtcattttcattaatgctgccaacatgttcatatgaggcttactaagaagttataactaagctttagaactggaagagactttaatttcatctaccatctgattataaactcctgttactcactttgttattcctccagaactttgctcataaatgatacctactaattgtcgatcattggatatgtcaagtt

SEQ ID NO: 110057 - DNA, 1108 bp, Homo sapiens
agggcttactccaggccgcaggcctcctggaggagttaattgctgttcttcgtttctgacctggaaaggcccaggtgacagttcccattagccaggcttggcctgcctgatgacaaaagatggcaggaggccctcccctcccactttgttcagaagatacatcgaggtcaagtgtcccagcgcccccacccagctgccagctgaaacaggtggaatcgacctggaaatttatgttttttccctccccctcttctgcactttcttttttccttcttgaatatgttgaaagagtgaatcatttttgtctttattagatttcaccaagaattctagcgcctttcctagaaatgagaaggaagttttttcttctggttattttctgttacattttaacataatttggctgttctctgagggagatcaagtgacaacatttcttgaatcatttatcatagaaatatcctttaatgaatagcctcttcgaatgtcagaactgggcacaagcatctgatccaagtcttgtcttttccagacaaggatgctggggccgaagggaaaaggaatgaagttatccaagacaacagtgagtgagtggccacgctgagatttaccaagccagaacgcttcccaacagcctgagggtcggcacaacttcttgtttactattagaatactaccacttactgaatatttacctgttctagacatctttttttttttacaattgatttttgtatgttgatcttgtatattataaactcgctaaactcatgttttattacagtttagtataatttttattgttatttttatttttgagacagggtcttgttctgttgcccaggctggagtgcagcggcacgatctcagctcactgcaacctccacctcccgggttcaagcaattctgcctcaacctctcaagtagttgcgattacaggcacgtgtcatcatgcctggctgatttttgtatttttagtagggactgggtttcaccatattgcccaggctggtctcgaactcctgaccccaggtgatcctcctgccttggcctcccaaagtgctgggattacaggcgtgagccaccatgcctgaccaagctttttttt

SEQ ID NO: 110058 - DNA, 1022 bp, Homo sapiens
gataggtttttgcaagtacattcagtgcttacaggtttcacatggagcccaattttctgttaacctagaaagagagattcagcagaaggtgatgagtatagtggaaaacagtggttccatgcagtccaacaccacgtttatttcctgggtgtaagagagaaaattagtagaataagtctgcccaatgctgaacatctccctttttgggagtttgcagtcagaaaagattgtgtttagtaataaagcaaccatttctttttttatagtacatgttggccagtttctagttaatccctataaactttctcagttaaatcattcagtcagccaaggttgagtgacacatgacttccttgctttaagcaaaggggtcttgttaaagaatattacaatggtttaagagaaattggatcctaccactctgcatcatcaggaagactaatcttgcaaagaattaaaaacacatggggatttctgtgtctgatcctgacatagtaactggtacataacttgccttcacttaaaacaactacaaatggggaaaaacacatgaggcaaatgttttcagacacggagcaataggcaataggggaatgtgatttgggagacaagtgaactatatgacgtgagttccatggtcaccccagtttttttcccaaggaaattctcctgctgcaataaaaagagctaaggaggcagagattgaagctttgggatatagacatggctgaaatttgtggggtgggatatcagaaaagaagatactgcacagaaaatcaggccactgaagtctgcatggggatggactgtgggtctgtggctgagaactcagctgcccatacacaaggcctagcaagggtcacatgctgcaggactgggagctgaacagagaaaccagaagtcctgctttgctgagagacgttggacttctgtcccaagcagaacattttgaagattcagttgagattctaaaaaggttatgccttgagatgaagaaccatgctgtatagtaagggccagct

SEQ ID NO: 110059 - DNA, 1034 bp, Homo sapiens
cctccccagccccaccccccattccccatggaaggtttctctggagctgtagggaacttacctagcacagaatgcattatttggctctggtgtctgagaggccatagccaaggtgggggcttgccctacccaccctgggggattcaaacatcagacctgtctctccttttaatgagaacatttaaatcccaaaggcttcaagccacttcacaccagtcctcatcttacagaaggcccagtctgtgcaactacttttcagcatctcagtcctacccctcaaatcaaaaaatgaaatcttaaccctaggaggggatttctgttggttgggatagtgaactgttggtgtcctagctgattcaggtcatattcagcacaggcatttagcctagatatttacctggaatagaagccagctcagtaaatgcccaggtttgctgcaggtacgtttaaaaccctgcaaaggatgcttcaagttgatgcagtccagcaccctgtgttttaacggaggcagagaattgtggagaagtttgctgggcagggagcagggactctgctctgactctgccgccaactcccttgggaactgcggaaaggcacttgccctttcggacctctgctctcccatctgttaaacaatctgtaaatctcatgtctaaggtcccttccggttttgacattccatcattcaacgtgctgagaatgccaggggcagactgcgtgaaagagaaagtctatcgctttgggcaaatctatttttaggaacataacccaagaagataattagatgtacacatgaaaataaggtatttatgagattacaaaagactggttaaataaaatatagtatatctatatgacacaatcctatgaaaccattaaaaataacaccatagaatagtatagtcatggaaagacattcgtaatattttgttttgcaaaaatccagggcttttaaacaagacttcacacaggataatagttttgcaaaaatatatccaaaaaatatgcctagaaagagatctgaggggatctac

SEQ ID NO: 110060 - DNA, 1034 bp, Homo sapiens
gcgaggtcttgcacatcttttgtctaacttacttctgaatattttatgtattttgatgccattgcaaatgacattttgaaattttactttctaattgtttgtggttagtatgtcataatagaattgacatgtgtgtatttaaccttgtagcttgttctgttgctaaattccctacctagttctaacagtggctttatgtatctcttagtatttaatgtatgtatatatattcacatgatctgcagataaagaaacttttacttctttctgtccaatctttaccctttttattccaccttattgaactagcaaggggtgccagtacagttgctaaacaggcagttaaattactgatgatttacctcagcattgtggaaggtgtgttaaggtttcttttagcatgggtctatttcttatcctatggcacagtcctttttcctaaggcatggaatttgcggtgtgaggtgctcacctaagtgtctcccctctgcttggctggcattccaaagtctcccaaccctcaggacctctggtgtttctattcaggtttcatccccattatatctgttctctaataggcctagtggagttttaccctgtgcatgtagagtcctgttctcagccaagaaccctggaggactgcctgatacaaacttccggcaaccttcttgcacagatacttctcctcgggtaccttgccctgcagattccaccactcccgcactcccaagctccaatctctgcctcctccactaaacatgctcaccgtcctctgcttgtgcgccccctccttgcacggtgacctggtaactgtccacggatggaaagccagatggcatgcagggctcacttcatgggcttcccttctttcgaggatcacacctctgctgtccattattctatgcctgaaaataattgcttcagatattttgtcctgtttaatcattgcttgtggtggaaggcacatccaataccagtttactccatcatggccaaaagtagatttttacccataggtacttttgttaaaccgg

SEQ ID NO: 110061 - DNA, 1027 bp, Homo sapiens
aacatacagggttgcttattcagctttacatcctgaagacaagctgcctccctgcctcctactttcgtaccctagctctttggaccatatgtacttccttggactgggtccttccttcctgacatggatatcatggttacttgcagccctgagtaagtaaccaagactattgctaagtcttctggtcctcttctgacttcctagacgcagtcattctccttgattttctttttcttacttcagtccttgcctcttcccgttccacgtatttactccttcttagaaatccctactcttggagctgaaggtaactgcccatcccagtgtttacaccttctccatgacagactcatgtggattatggatattgaggggagtgggctttaggtccctttaaagtgtcttagttcttttaatttcccaagttcttttgggaaatgagttgacaggatgatacattccaacaagcattgtttttctcaaacatgattgtaaagccctggtccatttccacattttactcattttgatcattctttttttttttttccctttagatggagttttgctcttgtttcccaggctggagtgcagtggcacgatcttggctcactgcaacctctgcctcccgggttcaagcaactctcctgcctcagcctcctgagtaactgggattacaggtgcctgccatcacgcccagctgatttttgtatttttagtagagttggggtttcaccatgttggccaggctggtctcaaactcctgacctcaggtgatccgcccgcctcggcctcccaaagtgctgggattacagtcgtgagccaccacgcccagcctgatcattcttttcagactccaacataaagtcatttttctggttcctcttatttcaaatttaaaatgctaatgcctgaggaaaactgtttgaatcttgcatgcgatcctacaaggttctgtgtgttagtccacgcctccacgttaactgagcagtgactacccgaaaggcactggggtggacatcgagga

SEQ ID NO: 110062 - DNA, 1102 bp, Homo sapiens
tgacagagcaagaccctgtctcaaaataaataaatacatacatacataaataaataagtttaatttaaaaataaatttatttctgtagagatgggtctcactcttttgcccaggctggtcttgaactcctggcctcaagtgattctcccaagttgaccccccaaagtgctggaattataggcataagccactgcacccagcccattagtgtttattactagactgtgagttcctggagagcactggtatactcatttgcttcttacttgcttctgcccaggctggtttagtatcctactcatagaaggttcttagtaaccgcatttggtgaataaatggaggagagtgggaaggctgtgatcgaataggtatctcttgtctcctctttaccccttgataaatttcacaatcaagcaagctaaaaatggagatgtgtgtctccaccagacaaggtctggaccactctctgccaagacagcacgaagagcaggacactgccagcaaccaggtgggttgagacagagtaacccaagctgctagcccgtcaaatctctccagactgggaacaggattagtcctggggcttgggtctagcattgagtcaacaagcggaagtcatgttgccctagttattggggagagggctgtgagggccaggaaccaggcaggtcactgcatagtccatcttgaattcagtgaggcattccatagggccaatgacacaggagacatttgacaccatagggtataatatcaactctaggcagccgtcagggccagtgcccaggggatcagggctgtgtctttttctttgttattttttgtttgtttgtttagagctagtttttaaaaagtttaattgaaaaagtaatacatgcacatgatctaaaaattaaaatgattcaaaaacgtatacagtgaacgttctgcctcccaccatcaacttctcaactcatctccttccgcaggtgcagccgtcattaaaagtttcttttcccagagatgctacatgcatgcatatgcaatatttctattttttcttatgatgacttaatgaggctgttgtgaactgaatacagttgcaggtgttgatgacattgtt

SEQ ID NO: 110063 - DNA, 1158 bp, Homo sapiens
acaatagcctatgatctacagtgcccattccaactcagagaatctttacatctggagatctatagcagggctatccctagtgacatgcgtgaagaagcttggaaatggtgctgggtaggagctgagtgtgcagaatgtggaaaggcattctaaaccaaaggaagaacacgagtaaagatgatgaagcagggataaggctaaaatgaaatttgtgatctgatccacatacaagcacagtgtagtacagctggaatatagagaagagcttgaagacttatgagcaactatcccggtactcttggaggctctgcaaccacagtttgagaaactccgcgttcaaagttaaaaactgtcacctgaatagttaataacatcaaagattgtgaaagcaagtataaataacacagagattaaaataatgaggcaggatcagaaagtgagtgttatatttatctattttttcctgtatcactgaaacaaaaacataacatttcaaaattattgtgtagaactcctctcctcttccagaacaatgctcagagctttgcagactctggtttgcaaaaacatcatgaaaggggatagtggtagatgagatgagaaatgttgatcaggaggagatcacggaaagccttgaacaccaggcttcagggctagtcacttattctgcaggctgtagagttgtagggagtgagtgatactttatgagcaaaaggcttagtatgctgaggtctgtgtttcaggtttctttggttacagtgtgagggatggactacaggggtagaacagaggtcttgtcaggaggctggctcaatagccctggtggcaaggaatgaaggatgaaagtctgaggaccctgacacaaggcgagtgatagaggaaggctgaggatgaaaaatgaatgagacctgtttgttgactgccatggaggtcaggatgaagcccatattactaggtttctaggccacgtgatggggtgagtggtgattgtagaatcaccccagaggcagagcagcaattcaaaacaggatttgagacagagagagagcgacaaatctgggcttttatttgattcattctattttttccatgtttgaaagtaaaaaggataaatgcatctattccttggagttttgtaaggactgatgaattagcata

SEQ ID NO: 110064 - DNA, 1051 bp, Homo sapiens
aatcccccaacatgggtatttctctgaaaacagacatgcaaatgttgggcttgtcagactctaaaatgttttctttattcttgagaattacggcatcctgcctgctgagcctgggaggcctgacaaactgagcaccggcaccacggtagcaaagcagcagagtgtgggaaagggaggcagaggcacgcggtgggtaatcgggacagtgagggacaaccgccttccacatcaagccacccctccttggcaccgttaggttgtagcttcccttccaggaactggagatggggaacagcgaactgtcagataccagttcacagacatgctcatgatcactctgtaggttggggaccagctggtatcacttggatcctcgggccagctggctgaagcttattcctgccaacttgagtataacaatggagccctcgagagactgtcttgcatgggatagccatctgagacttctggccgggactctgtaggggtctcctccaccaagcgactgggatgggtgagggggttggatttagcaagtgcttcccaagagctgctaaataattgcaaagttcctccctgggtcttgctatgggggcctcctaagacccgctgtccctaggcgatgagttcacagctttgtgggagagagagacaagagaacatgcagctaacaacctgggctaactgcaaaaagagaagcgcaaacattctcctcaccctccaccacccccgaatatggtcaaaacatttataccaggtgagagcatagtataaatatgttactgcatctgcagtgctagagaagagccatttaatttttttttttttttttttagtttttggtttcttacccttaacccgaaaggatggaaacggaacaggaggtgacctgccctgcatgactgagggtgcttgcattaggcacagggtttcactgtgggtgcaagaggaaccatggaagggctgctctctgccccatccctggattattgttgtgaggatcaagtcgaataggggttatgcttagttttgtatgttataaatcaataag

SEQ ID NO: 110065 - DNA, 1059 bp, Homo sapiens
agacttggagcccagggatgagctgactgtgggaggggttaaacagagcaggaagggagaagacagaaaaccaggaaggaggcggcagcggtggcctggccatgctcagcaggccggctgttgggaggactaggtccccgcctgcctcacactgccacgcagggggatcccaggaccagcccccttccttctcagcctcatttcctcttgtgtgcaagacaatcaataggagtagaggctgtggccttcagggcttctgctgtgtccacgcctctgtccctacgacatggtgcacagagtcggtgctcgccgggtgaatgaaggaaagtagaaaaagaaatggaaaattcgaggttttctttccgggaaagcattagactccatctaagtaccaggacttagaggctcctaaagctcctaggctgcctctcactacgaagccaagcttcccaatgcaggaatgacttgcccaaggtcactttgggtgtggatggcagaaccagggccacctatagttttttcactcctgtgatcaaagaaccacccagaaaaaaatgctgttacagattggcatccactcttggaaatgcccactcgaagggccacatcaaccctcctcccctcccaccccctttaagggtacattatgacatttctgtgcagcccgtcctgctcccatggggcagaaagcctgaggaaggatgggcccaacagcaacccagcaacccaggggttcagcattttccaaggcccttgctccacccgagagccctaggcagaggcctggtcatctccctccgcctccaggctcaagggcccctctttcaccccaggacaaggactagccggcaggctggactcagtggtgggcagtctctaaatcactcatgcagaggtgggagaggccgcggcggtgggggggattttcatagattatactgaaagaatgacaatggtgagggaaaggggccggttcccacagtgtccagtcactcctgtgaggggctgcgggagccaggcctggccgcctctttctctctgggcagcagcacacacagt

SEQ ID NO: 110066 - DNA, 1480 bp, Homo sapiens
ggtgggactgaattatttaaaatttaatgtcaatttatcctgctggactataagctctatgagggcaggacctctaccgtcttgctcctggctgtatcccaagggcgtagcacagtgactggaatatagtaggtgctcagtgaacgtcttccgaaggagttaatgaatggagtgaatgcatgccagtgcacgggccgcagatgctcacagggggacacacacatgcacacgtgctcgtgctctattttcttagtgagattgctctgccacaggcaggctggggatgccaaaatttggaggacagctggcagggtggcatcatgcctctggaaatgacattctgggaacaactgacatcctttgggaagctagaatgatgccccttcccagccagtgctcccctctcctccccacctcaggcccagaggctcttccgggggagaaatgatgctcttgcagcaggtggcaaagggatcccagggccagtgggctgtcagtgggggcagggatgctgtgtggaaactgctgcctttccggaaacaaaagggccctttagagtcacttgatatcatgtcttcctgtctgggcctctgccaagcctccctcttcctactgtggaacagcaggcacaacagcgacctgacctgtgcctgctcctcctggggcactgctggggagccagggcaagcaccgagcaggaacagaggtgcctgggcaggctacacatgccaaggtgtgcccattaactgaagttctgattttaatttttgagtgatacatccacatattcacaattcaaaaagtgtaaactacatgctatgaaaagtcttcctcccaacctgccctccatccatccagtttcccctgccaatgttctcagtttcttaagaatcctacagatagtcggtgcatgtaccgccaaatatgcgtatttcctgcagtggtagaattccatataccctgtttgtatcttgcctttttcactttatgatatgtcttggcgctctttctatgggtccataaaagagtgtccttggttttttggtgtttggctacatagtattccatggtgtcaatgtttcatatgtctaaggaacattttatgggaaccttttgttcctgtacgaagtgaagagtattgaggagtgatagttagagatgccaaaaacccgaggcctgcactatccagtacagtaacacctgtctccataaggctactgagcacttaaaatgtggctaaccaggctgggtgtggtggctcacacctgtattcccagtactttgggagataaaagggggtggatcacctgaggccaggagttaaagaccagcctgggcaacatggtgaaaccctgtctctactaaaaatacaaaaattagctgggtgtggtggcgtgcacctgtagtcccagctactcgggaggctgaggcaggaattgcttgaacctaggagacggaggttgcagtgagccaatatcac

SEQ ID NO: 110067 - DNA, 1023 bp, Homo sapiens
ggaaggggaccctgcacctgggggtgtgggaggacagcctgagggtggatgcttagttctgagctcccaaactaaagccaaggactttgtcttgcttgtattggacagcgcccttgggtgctgagttaatattttacccagcttgcaaataagggttatctgtttgtctctgtaaaggacacgggggcaaatggctttctgcactactgctgttggtatgagtgctcattctctttgggcaaaggaaaggaaagagatggagccttatcactgctcctttttagttcattgatgtaggtggccaactttctgaaaaatggccccaggggactgtgaccctgggtggatctttactctgaacttaggaagcagcttcatgcagtagaaataacctgaagtttgcagtcagctaggagtgcattcaaatttctccacttcctagttgtggtacttagggaagtaccttcgcctcttaaagcctcagtttccccatcggtacggcaggcatgaactgctctcctggttgggtcgtgaggtatgaaggggagagcgcagtggtatctcctgtgcttgctggttagctctgagtctggatgtgacacagctctcagtggtctagagattgagaatcgaaaagctttcggttcatgaaaaaccatctcaacgtcagagctgggggcaagcagagaaacccagggtcaaccacttcatcggccagaagaggaaactacacctcgccctgcaggtcccctgtggccaccacacctgtcctcaaacctgcaaaaacaccacagaatggggactccggcacccccaggctttccggacctgtcctcagcatcctcctccccaccacctgacctggcgcttactctcccagctccatttcgcctttgcttttggacttggcccttgctagttcccagctctggcctcaggtccactcagcagtgactctgatcacatgcccggtgccttgctgctggctacctctgatgcacacaccccgcattgcagtggggc

SEQ ID NO: 110068 - DNA, 1048 bp, Homo sapiens
tgtctgttttacttccttagcccccaccagcagccccacgctcaggcccacccagtgtttagctgcgacaaactccttggccacaggagggaggcctgactggggccaaactctagggcaaagggttgcctaggccctgtgccatcctcttgcccagactgggactaagagacacctattagctccatttgagtctggttaccatcccctacccagggatggggtgctggtcacaacaggcaaagagacaaaatgaagtttttgatcacacaaagctaaagatctaatttcagctgctgactcatcccctaaagggcggcgttggtgcctccaaagggcttgggatggagtcaggagatctaaccctggtgcaggtttggccactaactagctgcatgtccatggactatgtctcaggttccctatctgcctaatgagagtaagaagaaggtttatctccaagggctatcaggaggcttaactgaggtgatgtctgagctgtggggttctgtagagatttagtttgggttgatgcaatagggtacttcagggtgcttgatatgctttaatagcaaatgttatatggcacttaccatgacgcgcaaggccctgttatatctgatttacatttatttagtcattgggtattcacagcagccctgtgaggaatgcactgttatccaacccccattttacagatgagaaaatagaggcaaagagagctaagtaactttccccaaatcttcccatgggacatggcatgtcccagtcccacctggacagaatcctttctcagggacccatatctcaaacccacagacttgattgggttttcttttcttttctttttcctttttttgtccttccattgtagaatacttcaactgtgtgagagtaaaaagaatattagaatacatttccaggaattcccattacctagctttattaattaccaactcatgaccatcaccatccccttcacaccctgaattattctagatcaaatcccagacatcatatgtacatatactttattttctatttattt

SEQ ID NO: 110069 - DNA, 1034 bp, Homo sapiens
tctatctgctcccaggagagtattaattgagcacttactatctgaccaaccctgtgccaagtgctgtgtgggatctagtggtggtggtgggggaagcctaacgtacaggagaatatgccgtgtaggtgctggtggtgttccgctgtgcaagcttcatccagacagagggtttttgcagctgggcctgaccagtccaccagcaagaaggggctggcattgttttgttgtcacaatcctggtacctgaggcacctggaataggctggctttttgccttcagcactctagatccccagctcgggctggaattctttcctaacccctactcctcttaactggggtttgggcagccaatctcttgccaccttcttgccactgctccctgtatcttcatctggggatctgctctcatctggatggccatcagtttccacctagcccctgtcccagccctgcaaacaagcaagaccaatgcagactcatcattgtcagcatgtcccctaggtccctcaacatgctgccatttctgtgtttcctcctcaggaaggggcaccttttccaaccaggcacccacctagaaacctgagaatcatctgaaatcatttcctctctgtcaccaccatcgcccaaatacagttgatttgtgagctctcaaatccaccggtttctctccattcccagttacaacctttgtccaacccacccatgtctgctttgctcaccgttgcagtctctgcacccagcacaggacctgtgaaatggttgctcgtaccatttgcggaatggaagatgtgagtgagagtgagtgagccaggggagacctgtcaggatggcctgacccttgtttacctcttaagtctcatctctctccttcaccgccacttaccctttacctggcagctctcctgagctccccgtacagcctgggttcttgtccacatcttccagaagcctccccttttcctgtttgaattagatggtccctctgtgcccccagtgccacatgcctagcccatttcctggggagcacgcatc

SEQ ID NO: 110070 - DNA, 1024 bp, Homo sapiens
aaaggaatcccctttacagttctcgcagcctgacctcagcatccctgtgaatgtcgacggacagctgcgcagagtgcagccaccgcggcagctctgccgggtgccagctggacgtgcttggcggccaggccctgggagccacctctcgggatgtcagaggagagctgcaggccgcccttccgtcagcaggaagcccagccacaaacacttggacaggaacccgagtgctggccagctgagcaagctctggtttctcttgcgtctgagggtttggcccagggcagaggaaggcgagccaggtgctgcaggctgcactgccggggccgcggactcccccttgggctgggaatgtgggttcaagggtgtgagcggaaaagcatcatccagactggggcagaaggaggtgcttcctggaggaagggcgagggagcagggaacacagcgtttaccagcgcgagtccagctggctgagaatgcgcaaagacccctttgtgatcgcgccggacaaagtgtgttccttggtccagtcctcagtccccagcacagaccctgggagcacgcactgcagtcctccagcacagaccccgggctggggagcacacactgcagtcctccagcacagaccccgggctggggagcacacactgcagtcctccagcacagaccccgggccggggagcacgcactgcagtcctccagcacagaccccgggccggggagcacgcactgcagtcctccagcacagaccccgggccggggagcacgcactgcagtcctccagcacagaccccgggccagggagcacacactgcagtcctccagcacagaccccggggagcacgcactgcagtcctccagcacagaccccgggccggggagcacgcattgcagtcctccagcacagaccccaggctggggagcacacactgcagtcctctagcacagaccccggggaccacgcactgcagtcctccagcacagaccccgggccggggagcacacactgcagtcctccagcacagac

SEQ ID NO: 110071 - DNA, 1154 bp, Homo sapiens
gctggccgcctgctggcctagctccaggccgatggggtggctggacaggcagggagctgcacgcagctttgcagttccagcctcaagagtgacggcagcctccctaggtacgggccactgcctggcactttcctcccctcctgcctcgggtggctagggtgtggattttggccggtgaacgccacgcatcaaactcgtgtgtggcagctgggggaccacccagccctaagcagtcggcccaccgcatttcagggtgggttgttttcttgctcggacttgtttttcctggcactgcaaaggtcacatgcttacttcgtggcagtaagtgtgaggcgcccccgtgggctcttagcgagggtaaagagatgctttttttttttttttttgcatacgcagaaagttacgtgggaacagaaccatgtataacccattaaactgcctgtcctgatggacgcccaggccgctcctacatgtcgataatgtgtacaagatgtgtagcgcttggggcggcaccagcagacgctctggccaagcacttatgttctaaataaccctcttaggcagcacttgctaattaataccagggataacctcacagcccgcggtgaacagagaagcctggaatctccaggaagtgggaggatcctctgatatccttaactcgtgatctcctttccagaatcacctccccacaaccatgtgtgtccaatctagcacggacacttctagtgaccggaggtgtgccggccaaggatcagtccgtcctctgttggaaagttcctatagcagtcaaaatctgccctccatagacgtttgctctagggccctcatcagaccctttggggtcagatagagtccaatcccttcttgtaggactgcccttggctattggaagatagttctcaccatcagggttgaaccacctgacacggttctcctgcacctggttttgacccccttccccattctatccaagctccatttactttcctagaaacatggttccctcggtttgctctgagtagcccacagggagagcgggacaggagagtgcctcgcttcctctgagcggtgggcagttctctccattaagtaagagaatgagaggtgagctccaggccccctacagctccctactggggctctgctcgggg

SEQ ID NO: 110072 - DNA, 1035 bp, Homo sapiens
tagaggaaacccttcctgactcacccggggtttccaaactatccctcactcctcggtcgtcgggggcaggaccccatcctggacctcagagtggtccatagggtggttccataggatgaagagttccggatagatggcccgggaagtcctttccagtctgaggctttgtgttatttgctgcagatggaggtccctcagtgccaccaagatccccccctggacatgacctcctctcctcccagggtggctggacctacagtgttgtggcatgacccaatccccttgtgagcggaggccaaaacacggctccagtcccagagtcctgggaaaaccaacaaggttgaagcatcagtcaatccaacatagagaggcaggttggaggggcttagagtgccacgggctgcaggcatgtctgctgacctctgtgcgcgctcacgctcccactcccagtgccctccgagcgaggtggtaacagccaagctgcagctagctcctggctttgtagctttgctttgaggcctgggatgcctacattctccccaaagcagttcccctaactgcctgccccctgagcaacagccccaacccttagagaatccaggggtgcatgcacagtggaagatgtaataggagtctaagcaaagccacagagagacacaggctgcagcccccaaccctgacagctgttcttccctgcatgacgggcagacacagcctcagcctggaaatgcccttctgggtgtcatctggtgacttctaccactcaaattttgggtcttaagggatgttagtcaagagagcaattgttgttcacagcccaggatgacctgtccttgatgcaccttgtcatgggcccatgtcctctcctgccagtcaccgagattccttggctcccttggcaaaccctaacctgtcagtcctccacacaggcaccccagggaggaggctgccttgggcagaggaactgagaccctcatctccttcacatctgccctcgggccccatgagtgagacaggctgaagcctcctcagatt

SEQ ID NO: 110073 - DNA, 1038 bp, Homo sapiens
cccatcagagtggttggatggagccattggcctccttttcttcagcgggcccttcaacctctctgcaccatgttgtctggctgaggagctactagaaaagctgagtggagtctcctttccaacaggatgatgcatttgctcaattctcagggctggaatgagccggctggtcccccagaaagctggagtggggtacagagttcagttttcctctctgtttacagctccttgacagtcccacgcccatctggagtgggagctgggagtcagtgttggagaagaaacaacaaaagccaattagaaccactatttttaaaaagtgcttactgtgcacagatactcttcaagcactggacgtggattctctctctagccctcagcacccctgcggtaggagtgccgcctctacccacttgtgatggggtacagaggcacttgctcttctgcatggtgttcaataggctgggagttttatttatctcttcaaactttgtacaagagctcatggcttgtcttgggctttcgtcattaaaccaaaggaaatggaagccattcccctgttgctctccttagtcttggtcatcagaacctcacttggtaccatatagatcaaaagctttgtaaccacaggaaaaaataaactcttccatcccttaaagaatagaatagtttgtccctctcatgggaattgggctgtatgtatattgttcttcctccttagaatttagagatacaagagttctacttagaacttttcatggacacaatttccacaacctttcagatgctgatgtagagctattgggaaagaacttccaaactcaggaagtttgcagagagcagacagctagagataactcgggacccagagttggtcgacagatgttagatgtatcctagcttttagctataaaccactcaaagattcagcccccagatcccacagtcagaactgaatctgcgttgttgggaagccagcagtggccttgggaaggaagccatggctgtggttcagagagggtgggctggcaagccact

SEQ ID NO: 110074 - DNA, 1065 bp, Homo sapiens
acacttgggctgtgacaccgttttgaagcatgctgggtatatgagtgtacattaaatataagtgccagccagcttgtctccaggagcaattcaagctccaccttttgcacgtcagcccaggcagtaaatatctcacgtacacttacaccaaagagatgggcaaatacccacactgtccacgcagacccctaagagtacaggcaccgttgtcttggtggacagattgttttctcatgccctgaaactcagccttagaatcctaaggtcttaggaatggacaggacaccagttgtcttccagtccaataccctaccaggcatgggagtcttctctacagcttgcttgccaagtgattgctttagcctctgcttgattgcttccagtgacagtgagcttactccctctgtgaggttgcccattttcagtgtgaactgaaatctgctactctataacttctgcacccgcttgacctctgaagccacactgagctaggttctttctgtatcccgtggcagcccttcagggatgctaggaaagtgattgtagactcctcacagcatctcctcctctggttatttattcatccacagctccttcattttaattttaatttaatttttttctcaccatgtcttagggtgctgacacagttccttcaatggatgctcagatgttctgttttctagatccccttgccatcctctagaattctttaggaagtcagtttgccattagcctttttgaagttcagagtggaactgagcccagcattacaggtgtggccacgtcagggcagttgcagggtgagaccatcacctccttttttccacatgtgatacttcttctattaatccagtctcagaccacactagcttttgtgggcagcctccttcctttgttatcgttagtaaaaagtcctaagtcttctcctagggtgaatattgagccactttttttggtgtattctgtttaggcagcttgttttctgttgctgggttctggacctgacatttgtctatataagtttttactttttttcagatgtgtccctagcataacctggcc

SEQ ID NO: 110075 - DNA, 4239 bp, Homo sapiens
atggcttaaagttcttaatacattagatattctgtggtaaagaatccatatctgcaagttatttaaaaggtattagtacacaagagtataggtatataaaactaaatgaagtcaatcatattgattatccccccaaaaaaaatataatctaaagaataatcagttcctaaataattgaaagctgcccttacaaaataaaacaaaagaacacacatttcgttgtgttgcccaggctggtctcgaactcctgggctcaagcagtcctcccacctcgacctcccaagatgctgggatttcggacatgagccaccacgcccggccaaagctgcctttttttaacatggatttttttttcccccattcgttgtgctcagaagtcatttcctcttatttttctctgctaatgtgtgctttaacaaacctgtttaaaacgacaagcctttaatcaactggggtgttttgttttgtttttttcttattttcttaggagtcagtggatcggtggggaaaatgctgcttaccctgggccctgggctgtagaaagaagacaccaaaggcaaagtacatgtatctggcgcaggagctcttggttgatccagaatggccaccaaaacctcagacaaccacagaagctaaagctttagttaaggagaatggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgctattaatacacattagatgataacagttgttccatgaatgattctatgaagctatgcatcttagacctcttgagctgtgaattagcactattttctatagttacttattctctggatcattttataatttccatattaatttcaaatatgctcgtgttattcttcagtgatttccacaattgtgcattttattctttggtttaagtactgaagcatataatgaaagtaattgctaagtagcagcttaaaaattcaattatccgattgtatttaacatctttaagagcatgatcataaagagctatttttgacaccccccccccacttttttaacatttagagttagtaagggttttatatctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataacactttttttctgtgtctttattcatttgtttgctttttagtgacatgaatactgccctttgtggatttattttcctgcctaataatacttccccatttccttcttttttttttttaaaaaaaactggattttgaaggaaataagaacaacattctgcatatcatgccatgtgtgtgagcatcctggggaaaccccacagtcggatgcagtgtagagccaaatgttaaatgcgaggaggtctgagggcaatggtgaaatgaaatagaagagtagggacttataatctattaatagttgggagaatcaaa

SEQ ID NO: 110076 - DNA, 2610 bp, Homo sapiens
tttatattcaggattggtatggaagaagacttatgaaaaccacagcgccattataacatttttccttcaagcatggcattctgttttatatactgcccatgaaaacatttcctaaaagacattgctaagcgtaaacttgacatttttgaaagttctttttagtttctctgctaaactatgcatggtagcctctttccttctctgaggggatgaatttggtcactgaagcattcctttcagaaacaaactgaaagatccggttgctatagctactgtgttctgctttagggacttgtgccgtagaggttttggagagacccacatgctcattctgtgcccccgatgccctgtttcatggcctttgtgttacacagtacttgcctttctcccttcatcatcatcatctccccgctggctgatttctcattccagcatgcctgtagcaccttttattttctcttccagtgaattatattgtgtttgagaatgtgtgtggtatgtttgtgtttgtaaactaacaaacctatgcttgcatgtagtgtactttttgtgtatgatacttgggggaggtaggggtacaggaacaaaatgtttccaattatggtacagtagggggatccttagtgttcctcatgactttttaaaaattgtgacacgtgtacactgtttgtaatagggttgtgaggatatttttcaatgcataaaaagaatcctattcagttattgttctatttgcaaataaattaattttaattttattggttgacttactttccacaagtagggaacagtgaattgagatatgtgtgtgtttggctttccttaactcagcttgctacgtacgcattgctgttcaacctggcagactctttggacagacaagtcctattatgtttctgcttttttaaaaaaagtcagcagtcaacattagtttatttcctgtggtaatctaacagtgctacttaaaagtgacagcttttggccaggtgcggcggcttatgcctgtaatcccaccagcactttgggaggctgaggtggatggatcacggggtcaggagatcgagaccatcttggccaacgtggtgaaaccccgtctctactaaaatacaaaaaattagccgggcgtggtggcgcgtgcctgtagtcccagctacttgggaggctgaggcaggagaatcgcttgaacccgggagacagtggttgcagtgagcttagatcacgccactgcactccagcctggcgacagagcaagactccgtctcaaaaaaaaaaaaaaaaaggtgacagctttcgaattgatttaggaacagtggtttttttcccacaattagattgacaaatgacaccttgggagaaaagtaagatccaagtagtaaactgtcatctcagatgaaatattacgtttgttgtgtgcctatactggaaaggcattatctgttattttggatcacttgaagaatcctatacatagtgacttctgtaccttaatgctaaatattttcctgtggactttttttttaaggtgatgctgatataactctctttagttatgacagtaaaaaggctactaggcgagtaatcttcagactttccccgtccccaccccagaatgccacgtagcttacttttgtccaccttttttgcctttaaattcttggtagcagtgcagctgattgtgttttgttgacaggcttaagctagcagacctttaacattgagagcggtgagtcacgtttaccgtgctctcagcggggccagggaggagagggagagagtggtaggttcctgatggttgtttcaactggatgagaaagagctaccaagttaatatgaaaaagctttaagagctttaattttaaagtatttttgctcttctccattggccaatttagaaacatgtttcaaaatacatctatagctaacttgcctttttaaatcatgaggcattttgggtaacattagaatatgtagctcagttatgttctactctaccttgtgagattactgcatttagagctagttgtagcctggtttatatgttgattggcaaaacaaaatgacctggaatttaaatttcattttggagaagcaacagccaaaatcattacgaagtggctgttctttagaagtaaatataactactacgagtcctggtgtagtcatttatatttatttcaaatttcaattgagacaaattctgagggcccttttcagccctctattgagtttacatttctatgcattaaccagggactctgctttcttgttctccaaggatcatttatctaaggccaaattcactaaaaacatcaggattgatcagaaggatttcagtgacagcagagctttttgcaatgaaataatactaagcaatagtacttgttttatacccctttccagtcgtggagcaccgacggaaaccatcattataaaacagtattgttttttatattagtaaggatgaggttttaaaagacgtaattgacattaaacatgattgaagccctaattttgaccaaacgatatttacttcatgttttgagagatgatattaacagtaacaaggatacttgtacacagctttcttccaaaaatgatcatgcggctaag

SEQ ID NO: 110077 - DNA, 2656 bp, Homo sapiens
acctgtgttttgtgatgtacagtaaaatctcccatttaagggaggggggaagggggagggccattctccaggaaacacagtgaatattaatagcaagagagtttaatgaaagtataaaataataatcgttatggacttacctaatttcagcattgattactggaacatcctccttggtatttgcttttgagtgacctctagaggtcttaagtaccctttgattcactgtatattgtgtagttaccctcccgttaggattgcctttaggttagcgtctctaaaaggaggtagcaagttctcattggtggcttattaataagcttttgtctgctctctgaactactatcataattgactcttacagtaactataaaaatggaagagagagatacagttgtgatttttaagttaagagtttcatagcacaggcttttggatcaaaataaaggtaatttttttgagaaatatatatgcatatattttagtgataatagctctggtcttagaaattacacttaatttcaattaccccctaaaagatgacttggtatttaaatttgggatatgatgggcagcatggatattatggtactgaccttttgaagttgcccattgaaatgtgattttttttctattttatgggtgctaggaagcacatgtaagatactatattcttaaaatgtttctttttctacagtatcagttcatcttttcacagaaatgttacttattcttactacctaaagaatggtttgtgttggatgctgatgaaattatatatctatagatagggatatagaattagtactagatattcaatgaaaataaccattgtgaagaaagacttcaaattacataagcatcattttaatatgggaaagacctatttatacaaaagccatatttcatggaaaatttagaagtctcattttatcaagaattttatgatgatttgtatttgttacaaaagtcctatcattcttgatcatttggcagtattaactgaaattccatatatgaaaatcaaaatatccttttcatcaattatgcagcatgtgtgattttttaaaaaggtgcacattaataaaaaatgacttagtcattattaattcttaactcactggaatatctctcagaacttcttccttgacatggtcctttggaaagttgtgttcaaccgagacaaacaaggagagtatcggttcagcaccacacagccaccgcaggttggaactcagcacttcctgtcaattcttgctgcctctctaggctctctgcttgtgtactctgtattctctagcgtgttcttgttctgttatgtgttattctctagcgtgttcttgttctattacgtgttccttcagcctttttctctgtgcttggcatttcatttcttataagaagtcctagaaaattcatggcaaacatttgttagaggcttttcaagatcagaaatttcataagtctcctttccattccaatcctgatcttctatttgtgtaaaagtcttgtcctcaaaggtgagagttaatttttccatttcaatctactataaattttatgtttttgtttttcatgagtccccttagaagctaaatgagatttatataaacaaagtttgcaatgaaaactgtttcttcttggatcagagtccaaaggcccaaattctgaagaattatttctgatttcttgtcagttactgtcccttaatttggagtggctttttggctttctccagcgttgtataccttagtattcagaagatgatgtccttttttcatacaaaccgtggtttaggacatttgactttttgggtctgttaaacagcctgtcatttgaaaggtattgcaagttctgtggtaaagagagaagagaaacagaggaataaaacccatttcctagtgttaggatgttaaagtatagctcttgatacagatacagattggacttattttttaaacccatcctatgaatcagagctctttgaggcagctttttaggcatagagaatttgataaaatctcaccccttcattgccttacccatttttctttagagatgggtgatgtgctttacagataggagctctgagtctttcactcagccttgagccacaggaagctggtggagttgaagaggactccctggcatttttgagttgggttacccacttagttttagccaacttttacctaagtggtaccttcctgagctttattttggtcatccagcaggcctgatgtcctggtgtaatgccacaggcttgctttctaagagggcctgcagagtaccatttccgttttctaatgctttatggtgaataatgatggaatgcagtcagcctcagtttttttttttcctgaaagcagtgtaataccagttgtccctagtagtgcgtatgactagggttgtacaaggggctcaagtcgtttagcaaaatctcatctgtgtatacacacacacacacacacacacacacacacacaccccaacaccccaaccctcccacccccatatatatagttacctcactgcattacttcagaaggttatctttggcttatgtaatcaactctcatgtgaaatattcgtattgtattcctaggcctaggaaaacattccgatttttcatattctcccaagagatctctgacta

SEQ ID NO: 110078 - DNA, 1074 bp, Homo sapiens
gaatattgagggacatctcagcaccggggactcgctaggcatttgcatgagtcaacttgtgatgtaggtaccaacatttaaccagcgaggaggtaggctcagggagagtgaataatatttcctcagttagcactgaaaagtgatagtgcttgggtcaagcccattgtctctgttttcactctgctaaaattactcccaaaattaaaaaaactgaggggggcttattaaatatttcctacttgattctaattttttaagtggttgagatgtcggactgaagagaaaacccttcatactcttgtacctgttttatatatcttatattgatattgttggaccttttgctgtaaatatcatatttctatttgttatgatagtgattcagggcaattaaggtaagattggtttcttttgggaaatgagtattatgtttactaatgcagacattttttgcatgtgttctagtgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattgtaagtttggcatttattgtgatttccaccctgcttgcccctttaaaactaatgtagaagagaataattataactgtctttgccacagtaaaccagatcttcacagatagaatcaacttagtgatttagatgtttaccgttttgttttactttcattggtagttgccaccctaagtttaaagttcaagctaccagtgttaagcactgttgtttttcacatcatagtgcctctggctccagcttttatttctgcaacccattgtggagggagttaggatgggaagtggagacggaggttcctcagcccactgttgggtgagttaggatcgggggcggagacggaggttcctcagcccactgcggagggagttaggaatggaagcggagacagaggttcctcagttggaacagtaggtattat

SEQ ID NO: 110079 - DNA, 1034 bp, Homo sapiens
tttatttattgtagagatggggtttcactatgttgcccatgctggtctcaaacttctgggctcaagtgattctcccactgtggcctcccaaattgctgggattccaagtgtgagccaccgtgcctggcctagttttatttgttaatattactgctgaatttcaatagaaatgtaaaaattattcctgaggcgtttttcaaaaagcctacactgtttacttttacagattatttaaatatgtacgatatgtggcttggtttttgaagattttttgtattaaagaattgttaggcaaaaacaaatttttaaagttcctaaatgaatctagttatgccttatatagtgatagattaatgtaaatacaaacctttcctctttttcttttcaatatagtgagtttaaatcctgcctggaaagaacttgtggcacaaagaccaccttcgggtcttatatctggggcccttctcttctccgttttgtctcagattatcatctgcattggatttcaatctttgggttttttttgggtcaaacagcaaccttggtatgaagtgtggcatccaaaatcagagtaagttggtcaatctatgtaaaaatctatataaaatatgtgcaacatatatgatataaaaatgagtttagaagttaatataaaagtttgtgccaggtgcggtggctcacacctgtagtcctagtactttggggaggccgaggcaggtagatcacttgagaccaggagtttgatgacttgagaccaggagttcgagaccagcctggttaacatggtgaatccccgtctctactaaaaatacaaaaattagccgggcatggtggtgcctttctgtaatcccagcaacttgggaggcttgaggcaggagaatcacttgaacctgggaggcagaggttgcagtgagccaagagattgttttttgagacaaagtttgcatgcaggctgctttaaacacttacataatttggcttgtatttgcctgtatatcacggtcacgcctgtctttgggaagatgttcaggcaa

SEQ ID NO: 110080 - DNA, 3948 bp, Homo sapiens
tgttcttattacctgtcttacctttttgttttgtatgatcttgcttttgtaattcatcattttctatgatatggtgctggtgttcttgcacagaccactagtcactttgtaaagttatttcggtaagtatttattgagccacctgatctgtgtgtagcaccgtgccaggtattgtgtagatacaaatagtgcatgactggaaaagattgagaattatatttggctttaaaaattgtgggtgagatgttttctttagcatataacgtgcttgcgttatttgaggcttcttttgataagtatgctccaattttgttatttttaaactgtaagtggaagaaccatacattatcgttactctgccagcccagtcatggagactgtagtagattctcagcaagtacatgtttgatacgttcacgtttccattttaatttcaatacatttaaaatattttgaaaattaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggtaaggtcaagatcgactgtccgttttaaagtttgttgatttaaatttagtctgaaaaaataaaaaaagtggtgcattaaaacacagtaaagcaaaaactaaatgaaaacagaagtcagggctattttttcagagattatgtttcattaggactgggacagacccaggaatctcaatgttcaaattttgatatttagctaagatgagaagcatagttttaaagtacaagaattccagatgtttatcgtattcttcaggtaactagtggtaaatgatgcaggtggtccatcatactcagttcatgcatcatttcaaattgaagctgatatttaattgagtttctttttactttgaataaatgtccggctttcatcatgttgtggaacatatcaaatgaaagaattcagttttagaacaaatatgtttaaaatagaattgttttacttggtttggttgcctaaatattgttcccaatgtctcatatacacaggctattccggttaaattggtccatgatagcttagaggatcttcaaatgactcgttatcattttgcaatgaatggaaaatcattctcagtgatactggagcattttcaagaccttgttcctaaggtaagtaatttgggtgtatgtgtgtgctcacatgaatgcatcgcaacagtattttaaaaaaatttgtattattgtttccagttgatgttgcatggcaccgtgtttgcccgtatggcacctgatcagaagacacagttgatagaagcattgcaaaatgttgagtaagtattggtgtcttttttggttttggtttttgatgaatgatggtttcatttcagcatcagaaaaataatttttatatgtttcttatactaatatttcatatttatatatataattgtgatctataagatagttcagaactttaagtgccgctttaaaagagtctcatgtgctttttatttagctaaagtacaatatccacagttttttctctatgacttcattctttcaggtgctctatcttgatagaagtggctaatcattttagtaaacagttatgtttcaggttattaagggataaatttttactgataacgttaaaagtagccatactaaagactgtaggcacaagcgctttgctctaaagatgaggaaattgagacaccaaaatgatttgccgataatgtgacagaaataggacaataacctagctcatttcacttgtggtctggtgctgtttgcaaagcagcacacctgtgttcattatagtgaaaagattcatagttccactgggggaatcttggtgtgttagctctttataatactgtaatagaaaagtcttaataagttaaatgttttgtagtttaagaaattaattaaaatcttaacattgttttgtttcttagttattttgttgggatgtgtggtgatggcgcaaatgattgtggtgtaagtatagtttttgtgatttagttttatagttcttactctagcctaaatcatattcacaaaacttaaccagttttcttaaaattattaggctttgaagagggcacacggaggcatttccttatcggagctcgaagcttcagtggcatctccctttacctctaagactcctagtatttcctgtgtgccaaaccttatcaggtagtacaaattaaaatttttctcatccctttttctctgtctctgataatacagaagagaaaattatcataaaaagtaacatgaatttgtttaatattagcagattagcacatttgagctgtaacttattagtaacagattgattgctactcctcatttggtttagttcttttggtggataagcactttgttgtagccgttgaatgttgatgttcatctgtcaagataaaattgtggtttggaaaaggagtttaaaatgcttctattcatatgccgacatttgatttcttttcacagggaaggccgtgctgctttaataacttccttctgtgtgtttaaattcatggcattgtacagcattatccagtacttcagtgttactctgctgtattctgtgagtattaacattgtgtgcagagataacacttaatgtgcaccgtaaattaagatgttgagcgtatgtgtttgattttgaatgcatccattagtaattgtttctgtgagtagtacctataaatttaccttcaatttactgtagtttgaatagcaaattgaaaaagttaaaatgagaaaagatgtttcaacagtggtttgttgaatttggagaatggtttgcatttggagaaaaagtataaacagcgatggccacaggtaccctatcagattttataatcaaagtgttctgacatcctaaagactcatggtgacactatcccatttgaccgtttgtagaaagtatcagaagggatggtattagatgaagatactaatttacaacgttgaatattttgagtaaatgtttgtgttttctttttgccaaaaaaaccatgttggccagggtggtctcgatctcttgacctagtgatctgcccgcctcggcctcccaaagtgctgggattacaggtgtgagtcaccgcgcccagcctattgaacgaattttaaggagatgccttttatactaatatactaaatcaaatatttataaatatatgttatatttagtttcagagacacttatatttcaatttttaagcaggtccgagtgtcatttttaagttgtcattatagggaaaatccaaactattaataaaacctggggacgctataaaaataattcccaaaaactaataatgtttttaaaattacttctgtagatcttaagtaacctaggagacttccagtttctcttcattgatctggcaatcattttggtagtggtatttacaagtgagtattttgctttgttattgatttttaaagtgtatgaaattctgatgtgacttattaaatttttgtaaatttacatcaacaattgtaacatagctcacacctctccagattccttgtaaatatgttattttattaccagttgtttatatcttgcgccaattttttaattgttctgtctctatttttttccctgaaatatttgaaaataagttttgagtcattatgctcttttgcctctgacaattttagtatatattttctaaaagcaaaaccattcttttatgtaactaaatacagttgtaaagatcaggaaatttaacattgatataatatctggtgcaaaacctatattcaggttttgtcatttgtgtcaacaatgtcctttatgcctattttcccgtagtcccctagattagaacaaaaaatatctccag

SEQ ID NO: 110081 - DNA, 1227 bp, Homo sapiens
ccccacccaagtgtcttgagagcagagatcatccctttttgtctttaacctcccagtgactagcatagtgcctgctgcattcttgatactcagttatttaaagaatagcatcttgataactatattagtaatattttcaaagacccatctctgggtcccaagtagatctcattgttggattgctaatggttcttgtgtcacattttcaggatcagtaattgttttatagaattgatctgagacttgataatgaatccacgaaaactgtattgaatgtgcttgtggcacagttttttctttttcacttaacatttaaattaggatatgttgtagagggcagtaaagaatagatttatgcttatttttggatactacacaaaatgaatattccttagtattagaattgtttagtgtacagtgacatacatttccaaatgattattatattgagatactgaactcttgaacacacacgtggtttattcagcatataaaatgttttcatttatagatattttaaactgcattataacttatagacatttttaattgtttagatatttcaagtttgtgtacataagttgcttactcaattgactaaaccattatgtgttaaaacttctttttctgcagagatgcaattgagaacaacatggattttatgggattaattataatgcagaacaaattaaagcaagaaacccctgcagtacttgaagatttgcataaagccaacattcgcaccgtcatggtcacaggttagactttataaaagaacacagaagcaaatggagtgtgacagagctgaagttatattatattgagggataatcagttataaaatcatattatatagtctatagtggtttcaacctaagttctcttttagctctgaatattttcccaagcgcaagataactttgtcatattctttttgaggtctagcgaatcctatttatagaaagtgtagtagaatagtaaaagtacggccgggcgcggtggctcacgcctgtaatcccagcactttgggaggccgaggcgggtggatcatgaggtcaggagattgagaccatcctggctaacaaggtgaaaccccgtctctactaaaaatacaaaaaattagccgggagcggtggcgggtgcctgtagtcccagctactcgggaggctgaggcaggagaatggcgtgaacccgggaagcggagcttgcagtgagccgagattgcgc

SEQ ID NO: 110082 - DNA, 1090 bp, Homo sapiens
gggattataggcgggtgccgccatacctgactaatttttatatttttagtaggggtttttgccatgttggccaggctggcctcgagctcctggccttaagtgatcattctgtgttgactgtttacctatgtttccttatgttattgtaacatcatgttttttccttagagctctttgaaactgttttcaatttgttaattattatgtgcccactatgtgtcaggcacattccaagaacagtaaatgtaattttttagaagtttattttcaccaattgatcttctcacttttgcccagtggttggatataactactaatttgatcagaatataatgagtcatagtaaccaagctcctcccactccacttctttcctaatccccagtactctccatgtccccccgtcaaatgacagtgtcatattcaaggattgtcactttgactgtaactgatacagacctaccttggaggatagcatttttgtttaggaatatttcatgatgtacctagcattttgtaagcagaaaggagtgtcacttggctgtcctgctaattctgcctatttgggggaggtggtgaggtctaagcatgagtttaaaaaaaaaaaatgaaaaacctctacccaaattatgtgatacatatgcatgtcgggaaccacaaatgggtataatattatatcctaattcctactaaggacacattagtctcttcttaatttatagcttcacactagcaagggtgctaggggataagacagtggatgcctttgccattttcccccataaacactaattactgaattgcctacagttctttttttttcttttgagacggagtctcgctctgttgcccaggctggagtgcagtggcacgatgtcagttcaccatagcccccgcctcccgggttcaagcgattctccttcctcagcctcctgagtagctggaactacaggtgcacaccaccatgcctggctaatttttgtattttaggtagagacagggtttcactatgttggccaggctggtctcgaactcctgaccttgtgatctgcccgccttggcctcccaaagtactgggattacaggcgtga

SEQ ID NO: 110083 - DNA, 1050 bp, Homo sapiens
agtacttaaaatgttaatattttcaggatagcagaacatttgaaaatatttaagaacatactttttaaaaatgggaagtagtatagaaggaatcttgaatcctgactttgaaaaacagttgcttgtttcttttccaaataatgttttgtggatgcttagtaaactttttctaactttagtgtgttaatagagttaatctgtactattttttcttgttttgtttcgtttttaggagctgtttgaacttccagtaagtgaagaatgtttacttcttactaagtatatttgttttgattctttaagaatattaagtgctttgtgcctcttttgaaatgatataggctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacaggtaaggaaatatctatgctttgggtacaattctggtatttgagtaaacttgtattagcaactctaacaatgaaatttactctttcttttaaaaagttcctgtcgattttcaaaacgttttggaagacttcactaaacagggcttccgtgtgattgctcttgcacacagaaaattggagtcaaaactgacatggcataaagtacagaatattagcaggtgaggttgaacggctttcctagtttcccagtcatcatcatttatggttatattagtcatgcacagtaatttgcatgtaattgagtatttattgaatgtatgaaaagatatctaatataatattgttttaggtgattgaagtaaaagtacattttccccactgcctgatttcctttcattctgggtttttttttgagagacagtctcaccccgtacctaggctagagtgcagtggcactgccgtctcgggtcactgcaacctccgcctccccggttcaagcgcagtggcgcaagtctcgggtcactgcaacctccacctccccggttcaagcaattctt

SEQ ID NO: 110084 - DNA, 1032 bp, Homo sapiens
agcctgttcttgacccagcggttctgctaaccatatctgagctctatgtacttttgaatcctttcttggtagcagaaaggaatcactggatgagcctgaaaattctggggactacaagaaccttttatcttttgcagagctagtctctaaacccaacaagttgtaagagtgaagtgagatcagtttctatttctttattctgcttctaaccctgaatgaagcaacccttctcccatgggttgctaggtatctaactcaccatctttgttcatattttcttttacttatgttagtgatccagtagtgctcatttgttccttggacatacattttttttaattattgaaaatggccataatgttctatttaaaaatggaaccatgaattcagttttatgaagcagtgcttgaatgttgtgtttttgtttttttttgtctcttttttttttccagattctggaagaagcaactgaagaagaaacagcacttcataatcgaattatgcccacagtggttcgtcctcccaaacaactgcttcctgaatctacccctgcaggaaaccaagaaatggtgagaaatcacttaaagctagataaaactgttggtggttacttatatttatttttaatttttttcaatttttattttttatagagacaaggtcttgctatgttgcccaggctggtctcaaactcctgggctcaaatgatccccctcaaccttggcctccccaagtgctgggattacaggtgtgagccaccacccccagcctgcttacttacatttaattctcattttgaaatgttgctagaagaggaagtcacaagtcctttatttaactcttatgcagagataggaatattttaactgcgtttatcagaaactacacctctgtgttgagatataattctcagtactatcacttttctttcctgtttactgagcagcttagtgccttgtgatttatacagctggtggttaatcctcttaaattgcatctgtattcctagaatttaataaaaagtatgtatga

SEQ ID NO: 110085 - DNA, 1047 bp, Homo sapiens
attaacatgtaacaattgcctttacttaccccttatctccagttattttgttgaagaaaccaggtcatttaccttgtggatttggccagttgcttcctcctgatgtactttaacctgttcctcttggccctccttatacagtaatccttccttttttgctttataggcatcctttattgattgataagataggttaactggtgcatccttccattgattttttttttgatagtataagcacgtaaatatatacccctctctgcccttacgcagaagatttgtgatcattgtttgcaccccctctcccactttaaccatatgtcctggaagccattctctgtcagggatcttgcctgtttctttttttaactctgtagaactccattatgttatatgtagcatagtttctaatgctgtgtggttgctttttatttttatttttgggtttttttttgaggcatcatccatactttgtgcatgtgtgcttttttgttttttagactggaactctaactgaagatggtttagatctttgggggattcaacgagtggaaaatgcacggtaaatattagttagacttgatagtttattagtttatttttaatattttaacatgtgcaacattcaaacataaaggaagtaatagacaactgtgtacctataccaggattaaaccgtggacatgttgccatatttgcttcagatcgcttcctttagaatattaaaatattatagaagttgccaaagtcccactgtatcccttccccaattcctactgccattctgaaattatttttgcatattttatattttttctaagtataaatctataaataagtatccatgaatgatatactgtacatatgttttgctgcttttttcccctctccaaactttgttttcaagatttatccatgttgatatgtgcagatctagtttattaattttaactgctctgtcttattccattgaatgattaaaccttgtctgttcttctactaagggacaattctgttttttcttcttttttctctgcactgttgcaa

SEQ ID NO: 110086 - DNA, 2619 bp, Homo sapiens
gtgtgtaggggtggatcggggtaggccctcacatctcttctgtacagtgctttccactgttaccattagttcttagaggtgcagggactatagcaactacttaatcttttttgaaattatttgaaactgaacaatgcaactgtttctaaatataaacaaatattacctttgagccacaaatcactttctggaattattgtgggagataatatttgatacttctatgtgaggaaattggtagacaaaaaattaagccatgttgtccacatatacaactctcagtgattattgtaaacagtatggtagcatttaaaatatttaacaatttaatattttttggtgttcgatactgattcctgtgctttcgtttaataatttgtaaactgtttttgttgttgttgttgttttttaaaggagaaagtgttccagtgacaaagactaatttgccaaatccttcagtggatgtgaaaggaataggagatgaattatataatccagaaacacataaacgacatactttgttttgtgggacaactgttattcagactcgtttctacactggagaactcgtcaaagccatagttgttagaacaggtaggaaacatcttaattaatctctttttgcatgtttcagcatatttgatacctactaaatgtttaaaaagagattctgggctgggtgctgtggctaacgcctgtaatcccagcactttgggaagccgaggtgggcggatcatgaggtcaggagattgagaccatcctggctaacatggtgaaaccccgtctctaccaaaattacaaaaaaattagccgggcctggtggcgggcgcctgcagtcccagctactcgggaggctgaggcaggagaatggcgtgaacccaggaggcggagcttgcagtgagtcgagatcacaccactgtactccagcctgggtgacagagcgagactctgtctcaaaaaaaaaaaaagagagattctgttttgggagataattctcattttcttataaaaatatcaataattgtcttctttttttgaaaggatttagtacttccaaaggacagcttgttcgttccatattgtatcccaaaccaactgattttaaactctacagagatgcctacttgtttctactatgtcttgtggcagttgctggcattgggtttatctacactattattaatagcattttaaatgaggtatgtatgtgggactcttaatagggtttgaacctcaattatttatcatatgcagctattgaggatttgaaatgtggctactgagaatgaggaactaaaattttaagctaatttaattttaattaatttaatgctaacaaagtcatgagactagtagctatgatattagaaagcccagctatagaacatttccattgtaaaggatacttcttttgggtgcctctggtttagatggtcttttacttggtcttgtgactttaaaaaaaaaaaacaggaaaaaaaacccccccacataatcaccaaaagctttattttctcttttttacctctgagatgtaatatacagtgttaaaatgatttgtggttagttaattgaaggcgccgcttgtcagaagtggagagtggtacagtaaggtgtgtgcacgctgagtcaatatctgataatgattgttgaccggctttgaagtgtgtcatgtgtgaagtatgtagcgccttgaaaatgagataagtttcttttgaaagtagctgtcattctataatccattgagcttttttattttgcagaaatatctgaagaaaaaaattatatatggttaatagatatgtatatacacacacatacataaaattgaaatatacaattgaaaatggcttacagattttcactaaagaaatacccatattaaatccgtaaataatactggggatttgacatttatttttgtgttaattgtaggtacaagttggggtcataattatcgagtctcttgatattatcacaattactgtgccccctgcacttcctgctgcaatgactgctggtattgtgtatgctcagagaagactgaaaaaaatcggtattttctgtatcagtcctcaaagaataaatatttgtggacagctcaatcttgtttgctttgacaaggtgggttcagtttcatagttactttcaaaggttacttcgtagcgtttaaatatttagatcaatgttttttattttctttgtcaacaaatttggacacattctgtcatgttcctctaattttccttttcctccacttatttggtatatgcatcatttttctataccataagttctcacttaacattactgataggttcttgaaaactgcaactttaaatgaaatgaaaccagttttaccataggctaattgatacaaatgagatttaagttcctatgccatattttggtcacaaaaaatcaccaaacttctaaataaagatctaaaacacttctgatattaatcattgaaataaatatgagctatacattcatttaagaaagaaataaaaacaagtaaggtaattatttacccagttgttttatttcaggctcctgggtagtgggagcgtatctcagcaactggcggaacgaggcaggaaccagccctagacagga

SEQ ID NO: 110087 - DNA, 1056 bp, Homo sapiens
gctgggattacaggcgtacacaccatcacacccagctaatttttgtgtttttagtagaaacagtgtcaaccttgttggccaggctggtttggtactcctggcctcaagtgatctgcccgccttggcctcccagagtgctgggattactggcatgagccaccatgcatagccaccattgaagggttttaagcagaggagtgataaaatacttgccctttggaaaaaaatcattctggcgtccacattcagactggtttagaggagagtaatactgaagacatgcccccccgaatcaaggtagcaattgcggagatgaaaagaaatgagttcaaaagatacttaaatgtgaccattgaacaggatttgactcattggatatgaggccatggagcagtgtctggctaggtggatggatgttggtgctgtttagttaaataggaaactggaagagaagcaggcttgcaagaatggtaatattttggacgtgtaacttgtctggcaagatgttgaagaggtaaaggaggcagcacagcatcatgggccttggaggcagaagccgctttgatttactcagaacaccaaatcagtctccattttcttgactcagactacacccaagagattgcttccttccctgtgcttcctggccacttgctactctagctaggaagatctgcctcccttagctgaagtctaagatgtgtagcttattgatgcctctcctcttcttgttctgctgttgctgaatataatggggatgccagggcagacataccattcaacttgaatcttccttacccactttgtatagtcttacatgtcattgataccttgttttctggtacgcctaaaaggagtagaacttcaagtggtatttaaaagctttaagaaaagtcaaatttttacttttttcttcccatctgaggaatggatttattttctttttaaagaaatccaaatttttaaaagaagggatcttatttttaaaacgaagatcgataatatctactatgtactaaatgtcattctttaaaagttgttccctcataatttagt

SEQ ID NO: 110088 - DNA, 3308 bp, Homo sapiens
taagaactattgccttaaagaaaatcaggccgggcatggtgtctcatgcctgtaattctagcattttaagaggccaaggcgggcggatcacctgaggtgaggagttcaagaccagcctggccaacacggtgaaaccccgtccctactaaaaatacaaaaaaaattagcctggtgatggatggctataatcccaaatactcaggaggttgaggcaggagaatcgctcaaacccagggggccggaggttgcagtgagctgatactgtgccactccgttccagcctgggccaaagagcgaaactgcgtctcataaaaacaaagaaaattgccaatgggctgtcattttgtttaaaaaaaaaatttttttttttttttgacttggcactggcccctgctgccttctggagaagtcatcaaattcagtgggaagaaatgtcaaacatatttactgtgtgtcttttgccagccatagaaacttaaaaatttaaacttactccattgattgaagtgaattatgaagcttagctttcctatgtggaaagtgtggaaaaggattggaattaagtatatgtaagactttctttgctttagagttatagctggtatctcagttaaaataagcataattaaggcggggggtggtggctcatgcctgtaatcccagcactttgggaggccaaggtgggcggatcacctgaggtcaagagcttgagaccattctggccaacgtggtgaaaccccttctctactaaaattacaaaaattagctaggcatggtggtgtgtgcctgtactcctaactactcaggaggctgaggcaggagaatggcttgaacccaggaggcggaggttgcagtgagccgagattgtgccactgcactccagcctggcgacagagcaaaactccatctcaaaaaaaaaaaaaaaaaaagcataattaagatattttgggaaaaagtagatgtgttagttgaagcccacttagaattattacagattttaggcattgtctgtgactcataaattctgcacttcaaaccaggtatgcatttagggaagggtttggcttgatgcttttatggagatggaagaaaatgaatagaaattcttaatttgactctaaaattgaaaaggagaaactatgtagctaaaaagtaaaatgttttcatctttggtttagaattctcaagttatactttatcttaaaattttaaagtttaattttagctattacagctttggcacagtcttaaggataatgatattattatataaatttgagtatttagagccatctcatctatcctgcaataaacatattgaatagcttcgaagttgggtttgagacttagatttgtcattgtttatcttaagaatttgagatttaaaaattctcatttgttatctcaatttttgttaagggtttctaaggatttgtaaggaagtcacacctttataaaatcaggcatatagaaaaatgaggcgttaagaaatttggatattttaaactttgtttaaagtaaaaactttggatttatttaggggactggatgaaggtgtttcttgtacgtcaatttatgaaaagcatagtgcaggactgacaaaggggatgcatgcctacaggtaatttttatccaactaaagttagatcttctcaaaattcctaaaagcagtagtatacataatcaaccctttaccatatagttgtacatattaacagatacttaaatattacagacatagtagttgagaatttattgatgttttatttgggtaagactgtcttagtttaagaattataaaaatgtgcaagctgatattttgaagttggtatccctgaaattataccatatttcatcagttcccaggtgcacgtttttccaccttttaacatctctgagattgggatgtgtcatagagttggtgaagtgtcgttcttgatagcatttttatctttcttgatcatataataatggtatgccttacaattgatagcaccttagattttctgaaatacaagcatgagttcaaattcaccgtaatgaaagattgtaaattgggagacataatctccttcattgtgttattccttgttaaatcataaaaatacaccagtgtattgcgtatgttaaagataaatgccactttgaaattcaataagaaattttcttatagttctgtaacatgttctttcaaaggggtagaacataaaattcactcatttagacttacatttcataaaagtctagaattactctatcatatagaaaatactattgtaacataaggaattaagtggaaacatttaaactttaaaagcattttcttttaaagtcgaatgtacaatgttttgaactaaacactgttagtgcaatattaaaaaaaaaataagatccctcaaatttatttggcttcttgcaaaaaataattgtaattcaaaattgttaagatctagtgtgttcaaggatgcaaaagagaaccttttgctcacatggtattatagactagtgggaaagatacttgtcacacataaagatgtgagacaaaatgaagttaagtgctaccagtataggtatctactattgacttctttgttttaaattctgtaggtagagagtttgaattatagaagacaggtgtttggagacatgaataagaacagtctgtggtttaagccttacctaatacaatgcctttcgtaaattatactattatgatataatgtaatactatgaatgtattttcctgttatagaaaactgctttatggagtaaatgaaattgctgtaaaagtgccttctgtttttaagcttctaattaaagaggtaagactattgattgtatataacttaacagtcatgatcaatggatgtgtcaatttggaatgagttgtgattaaaatattcttggttttctttttcctaacctctttttcatatttttacttggaaggtaaagacggaagacatttactctggtagagaaagaatctggggcatgtattcttaaaattttgtctagttttgcttttattacctgttgaatgtctagcagagttaggctcaccaatcttcattctggtttttggctaaagctcaagaattagttgtattaggtgaacacttttaggagtagaagtaagattgtttttcatcagttcctgggagtggccatgtaatgttgcttatgagcatagcatagtgtagtgattaggaattggaagacctgattttaatgtagttccatcagtaactagctctgatctttagtacattctctctgttgctcctttacctataaacttggaataa

SEQ ID NO: 110089 - DNA, 1058 bp, Homo sapiens
tggtccattaggactgtagtccagatctcggtcactaggccagctgcctgtctgctgtgtgatgctgatgcatttcagccttttttcttttttaaaaaccctaattggaagcattttataagaggttttaatatttagtccaaatatagagactaattaaggaattactcatgatattttatgaagtattgatgtgcttatcggtaaaatatgtcataaaaaccatgagcaatggaaagcaccttatgtttgaatttaagcatcctcatgaaatggtttaatatttagtgagtaggcgtgatgtttcctcaattagagatgaggaaataatgtcttgtaaagaatggaaaataaatgaaaatataggcagttttctataaaattgactccttaccgttatccctttctctctttaaggatgaattcaaaatgtggttttgtgcaaaaattcgcgttctttctttggaaacttacccagtttcaagtccaaaatctatgtctaataagctttcaaatggccatgcagtttgtttaattgagaatcccactgaagaaaataggcacaggatcagtaaatattcacagactgaatcacaacaggtattgtgatcttaatgtcaaagtttctttaaaaatcagaattgttacattttatgctatcatgtatattctataattttgtgtttgcagttaatgcttgagataaatttacctgcatataaaatattacatattactatatataatgctatatataatcctatatatagctgttaatagaagtaacagattacatatcacaagtgattatatgctttttggtgtaacgtttatttgtgttccacagattcgttatttcacccaccatagtgtaaaatatttctggaatgataccattcacaattttgatttcttaaagtaagtatcttccttttgtttggattgtattttgaatatcctgaaaacgttctagatagaaaagagtccattctagtattcataaaattgctgaggttttattttataatttctattcacgtattaattaacaactccct

SEQ ID NO: 110090 - DNA, 1095 bp, Homo sapiens
tttgatacatcccatgagcaagtgatgaatacatcactactttggaagaattcaaatttaaacaaaatcttattaaatattaaaagaacacttcgatggtataaaacagtggtccccaacctttttggcaccagggactggtttcatggaagacagttacgggtggggagggatggtttcgggatgaaactgttcagtctcagatcatcaggcattagattctcataaggagcacgcaccctagatcccttgcacgcgcagttcacagtagggtttgtgctcctatgagaatctaatgcctctgttgatctgatgggaggtagagctggggcagtaatgcttgcttgcctgtcactcacctcctactgtgtggccctgttcctaacaggtccgtgacccaggggttggggaccccttgtataatagacagttgatagaatgcagttgtatcgtctactaagatagaagatagttccctaacgtctgttccctttcttccctcagtgatcttccattgtttgaagcactggacctttaatccactgtaggtatggacagggaagaaaggaagaccatcaatcagggtcaagaagatgaaatggtaaccagctgttctaatttactggtgatgtgtgaagactttatctctgcaatttattattttagggactagaaaaatgcaattaacaacagtggcggcagcagctaactcaatgggcttctttcttcatcctgtgcttttgaattgggattgtgtaatatgtctattagttgcttttagtataattctttttttacctgtggtctgttaaaactgagaagaagtatgtttttgcatttggtgatttaagaggtaacattggctaatataatcctaaataaaagatttaaatacaatcccaaataaagatttctaattttgacttacaaaaattttctaaaatcagcttaataaaaaaagccaacttcaacttctctactttttgttggggggagccagaaagatgtcaggtgaagtataagatgccctgttaaatgtaaaagtcacataatgaagggagaaatttttagtataaatatgtccaaatgttgcat

SEQ ID NO: 110091 - DNA, 1673 bp, Homo sapiens
tgcaacctccacctccaggttcaaacgattctcctgcctcagcctcctaagtagccaggattacaggcgcatgctaccttgcctggctcatttttgtatttttagtagagatggggtttcaccatgctgaccacgctggtctcaaactcctgacctcaggcattccacccgcctcggtgaataatgcatttttaattttagttttttacttcagtactgctgaagatggcaaatactgactgaaggaaaaaattaaattaaaaatgtattattcaaaattgctttgcctgaacttttacttgattacaggtcgttatttaaatcacttcgtgaaattacctactttggaattgtaggcacgtacatagactatccttaaaaaaattcaacactctccacactcactattataatattgttacaactcttgagaaactcaggtttgaagcaaagatgtctttgaggtttggagatttctgtgtctgaaaacaactgatcttgttttaaggaatgaaatctgactaacttttagcatggtataggataaatagtatactttaattgtttgtagtaattacataatgtgaaaaaataagtaaactttcaaaaattggcatatttaatgtagtgagattttttttcccagtagcttcactttgtcccatactgtttttttttttttttttttaaactcacacagcaaatcaagtttattataaattcaaggaagggtttggttaagcacaatagcctataagctccttgctatttagataacatcaagactcaggcatgcactgtggaattggaacttcggtgagctaactagctaggatttattcaaataataggagctctacgagtgacagatggcagaagggcacatcttctgaaaacttactaaaaattggtgaattacaaaattctaaattttaataccttaatcattttgaaagcagttcagacagaaccgaaacagaaatatttggcataaaattccaaatttttatgcttagttttatttttattattaaaagccagcttttgaaagctgtgcaaatatcaggaattgggaagaatgatgatatagtgctactggtaagaaaaatttcttcaatttgttttctctgatatcgaatttgacttggttaaaaaacgtgtgctccagcagtccagaaaagttatatttctgtaagtaatgggtttatcaatttggtattaatgcttcaaatgtctgattagatatatagtagaattgtatttaatatgtatttttatcttgataagcagtgtattttaaatatgtttatgtggttttttatcctctcagtcattgaaataatcagggcttttacttatgtacatttaaaatttaaatatgtttttaacatacatatgttctaaatgtaagagctgttggagttgtcgcattggagttgactaaaagtttatgtgaaaagtgaattcttgggtaatttcctttgaggtgtataatatattcaaagtgaataattaattggaggtttttagagcaactttttatttgaattgtttatttttagcactttggtaaaatttgctaagacttaatttgctttaaaaaacaactacgttttagagaaattacactcataaaaagagtaatggtgtaatatggttaaaaaattgtattt

SEQ ID NO: 110092 - DNA, 1087 bp, Homo sapiens
aagtacctatgcaagaattaatggtatagtgtaggctaaactcttcttcatattgatcctaatacaggtaattatgttatctttcctaattatagcttattttgttatagctatcacattgttttgtaacatacaaaaaagtataattatacaaagactccactttacaaatgtaaatacagtcttggtttggtgtatattggatacaatggtcttccttaagcctaaacacagaaacaaaagcatattataagagaaagtccaagatgggaagtgataaagtgggtattgagtagagctttgttaaaatttagctggtatccttgtaaaatttccatgtattcattaaattatattatgtcattcttatttttaggagctgacttgaagttttaagttttgccctcataaagaattgtcacaatttggttattacagttggatgattctgattttttaaaaattctttttgtatatatttgtataggtattaaaattgaaattgttcaatgactaaagttaaggctttaaacgtattggggcatattttatttcaacagcaaaaagtagaactgattttgaactggacaaggttatcttctcagttactgtaaattttacaagtttgagaataaaataatatttagaatgctagctgtgctgtttatatttcaagatcattaaagcactcttggcttgtgtggtctttaaagatgggtttatcaaatatttatttaacattggtaggtatgtgtaattctcagaaaaaaaatctaggactgcaaaacaaagcgggataattccttctctcattcaacaatacaaggtgtcacagaaatctcagtgaagttttaatttttaaaactccagaattatatatgttataaacttaaacaccattgagaaattcagttactggaatttcttttatacttatttatttttgtgagtttttttttcttttttgagacagagtctcactctgttcccaggccggagtgcagtggtgtgatctctgctcattgcaaccctccgcctcctgggttcaagcaattctcctgcctcagcctctccctagtaactagga

SEQ ID NO: 110093 - DNA, 1513 bp, Homo sapiens
gctgcctacgtgtcattccttaaatttgttggtaaggctttttgatgtaaagtcaccccatgcttgactttctggtgaaaatgaaaaatactaatcttggttaagtgaagatgattttttcctggttttgaaaggcagtattctggtaagtaagagtagataatgcccatcaaagtgttgtgtaaactaaatattcccatacaggcgtcactattgtggttgttatagtgcctaaatacattgattgtggggtgtgtctgtgtgcgtgtgtgtgtgtatgtggttttttttaaatcctggatagtggcatacaggacagtcataggaggttagaaagttaacatttttatgatggttgtgctgtgaataaggtgattaacttcttcaatagcaacttatattactgtatttttgaagtatttgttgaatgtaaatgttacggcctttgcattgtctatgctgggttagcgtgggtaggtttcagattagacaaaggactcaagtagaaaaacccaaattcatgtaacttaaagttgacccaagtacctatgagttacatttatacatttgcaggattttactttttgtacagaatagcttcctagtgattttgtgcttctttgtggttggatttttcaaatcagaatctggaagagtgaaatatgaatcattctgtagtgtatgtagatcatgaggaaaactaattttgctttgtttcaaattgcacagtaattctgaagtgaaccatacagaagtaatgaaaaaaattatttttaggtttgctatcagtaagaaaaaacaaacatttctgaggtttatatgtttttaacacactgaagacttggaggtataacctctggaaaattttcttccactcttctttttttcttctctactcttccctattcctatattattccctagcatcccctttttctcatcctagcttttcctctccaccgtgctgcgctatttcagtatctttctatgcagaacgttactttttgttgtattatgcaactacagtgtaatctttttgaatactttaattagtaatttaaactcaacatagtcttagcaacagtgcacgttacttagctggcatgaccatagtctgagcggtgtggccagtgtgaagcatgagtgtgcagtgagcaccgcatcacagcagccacttgccggcagcagctgtaaggttgtatctaagcagtgtcttgattttagctatggtaaaatgagaattcatgaatgtttaaatttcagagaccatctttaatttgatgactgaaatgtcagcagttatttgagatttttattaatagcattacagtttcaaatgaatagttgttaatttgcattataatggaagacattaatttacatattactcaacaaaaactttaccttaactctgaactaaaaagtataatttttagtttgggggaattaggcttatttatcatttggtttgtttacacaagctgttattgaaactcttgatttgtcaatttct

SEQ ID NO: 110094 - DNA, 1433 bp, Homo sapiens
aggtcactaagggacctgggaacacaggatattgggagagctgggaaaggggaatagggatgagatgcgggagcatgccaaagacaaaattactttgttgtcaaattttgcccacaaaaagaagagggattccacccctccttcacccagtcttgccctgtctcctttattcagctgcactgctggatgcttgcctggttcccagcctttaaggtttttagtctataagttcaacgttgttggaaaagtgctctgatacctgcagaggtgggagaaaggtgggggcagtcctctgctaggagatggaagggacaatcaaagcttagtagcttgagctggtcctggaagagcaagtaggagctctttagccagactaagagaagggcattcttggcagaaggaatattctatataaagaagtggagtcagggaacagtagggctctttgaagaactacagattgtgttctaaatgaatgacatgtaaggtttgtaaggggcgagtgataaccactgatgaatggcagatggtgttgacaactaggcggggccagagtctgtaggatcttacatgtcttgcaatcagttttgactttgaccttggaacccagttgaggctcccttccgccccagttcctcatggcagggaaatacatcatgttgtgcgttgtaagacttcaaaactttgctagtgagaggcctgcttaatattatttaatctagttcaatttaattgttttgaaaaaaaaaaaaaacaacaacttactttgaaggtactcttttaccagtttgggaattgctactacagacaacgggaagctactgaagttttatgtagagagggaaatggtcatatctggctgcatacagacttgaatgagggagacgagggctcaggacctgaatcaaggcaaagctgatggagataggcatggtgaggtggatttgagaagggtagtcaaaagatgagtggccggttggatgtaggtgtgagataggaagagttcgaaggtgacttctaaattcctggcttggctttttaggcaactcatactcattaaaggagtagggggaattggtggtggctgggtggtggggcagattttttggaagaaagagaaaatgaacctattgagtgttagctgtctgcaaacatgtagttgaatctgtgggtctgaagcacatgagagattagtgctgaaaatgtgaattggtagttgccatcgcgatggtccagtagtgccacccctgatgagattgttacaaagagaagagcctgaggaatattaataggaaaattaagaagcgggcagaggaaatggaggcttggtaacctggctacctgcccagcaacccaggctagtgtaatgtgaactgcagctcagcagagttgtaagaggtaaaatgggcatttgtgggctatcttaggaatct

SEQ ID NO: 110095 - DNA, 1284 bp, Homo sapiens
atatttgtaaggtagaagaaggtccacagttaatcagttatcactagataactagtgattataaaaggagttaaaacgatttgtgttagtaggttatgcacagtgactcatgcttgaaatcccagtgctttgggaggccaaggcaggaggatggcttgaggccaggagtttgagaccagcctgagtgacaaagcaagactttgtcttaaaacaaccaaaaataatttgtattaatcaggttaaaaatagaggtaaaatgagatgacatgagtaaatggtaattggaaaaaatgatcactgttatgatagtttaaaaaatgactttatggtaatcagtaagaagggagaaaaacggaataaaggagagaactgtccaaataagtgtctgacactgaggaaggttgtttgaggatggtgattgctgaaaagtttccataaaatgattctctagagggaactatgccaataccatatctgttaacatcttagacccacagggtcatattggaacctttgctagagtctgagatggtaaaacattaactcgaatagtaaacgtcaagaccgcaaaattaatctgttaatcagaattttgtcttttttgttgattcttacacttactccctgtggatcttggttttaaatgatcaattgacactcagagactagttagataagaaattaaatttccagaaaaagtcacttaagtatgtaaagtagaatttcctaattatgtggtctggaaattgctgatgtctacagaatctttctcaagtttgaagtaaaaatacttgtaactgatgttgggtggtaaggtgaaagatggttctagctcagtgagtttttcttatttttttttcacaaaggagttgaacattgaaataaagaggtgtgagactggaaaataatgcggagagatcatggattatttagattagtgcctttttagagaagaggaaagtgaagtaagtgacagcataaaggatcctttatggtctaaccccagatcctttctctagcttgggtgttcctttcacccttgctttaattttgtactctgtagtaatggcacatctcaaaacttttgcattttttttttccagtgagagccaacttttaagggttgcctttgcttgcttgacagacttcttgaaacaaactatttttagtttgtttaaaatgagtcatggaattgctcccacatatgtgtctaagggtggtttcttcatagcatccctgttgctctgtttttttttttttccatttgtgaaataggatgaaata

SEQ ID NO: 110096 - DNA, 1004 bp, Homo sapiens
tataagcgactttgaagacagacagaaacctagctctgtgttaatgtgcttaacacagaggtttctgtctctgggtttataaggttagttgtatgtgactaggcaacataacatctctgaacctcagattctggtgataaatcagatatgtcatcttaataggtgtcacacactagatcaccttcttttagcacacaactgtgaactgttttgactgttttctttgataggtgataagctgccaactcctattccatttatcatccattcaaatatagctcagtttaactcttagatatgttgtactcatccttttctcccttctctctccctccttagaatcacatttcttattttttaaagttttaaaaacattttttaatactgcttcttgcagaacagggctgctcgataggcagtgtgcctggagtagccagaagaaattagaaattaaatttcttcttggtgttacctctgaatgtattctgaatatgccatatctcatctggatccaagaggtagctgatgggatttagccttggttttggaacatagtttttgtgaaaatgaagctaattggcctatggagagagtaaatctgtagtcgtcaaaaccatgttgagtttttttgagatagggtcttgctctgtctcccaggctggagtgcagtggctctgtcatggctcactgcagccttgaccttctgggctcaagcagtcctcccacctcagcttccagagtagctgggaccacaggtgtgcaccatcacacccagctagttttttttttttttgtagaggtgggttttcaccgtgttgcccaggctggtctcaaactcctgaactgaagcagtctgcctgccttggcctcccaaagtgttagggttacaggcatttatcactgcaccccgtccttttttctttttttttccccccagagaaagagtctcgctctctcactcaggctagagtgtagtggcacgatcatggctcactgcagccttg

SEQ ID NO: 110097 - DNA, 1514 bp, Homo sapiens
tggttggtagtcagagctttcggaaagtcctgtgggaggtggaggtcctgtgggcagaggcgtaggggtgctggcagggccctcgatgagtctgtgcgggaccctagctcgtcctcagccgtggagtatggagctgcttgccatctccgcatttcacagataaaaggagtgagtcccgtggaggaaaagtgacttctgacttgcctgaggcctcccactcggactctgtggcagtgaggactagaaaaacccagggccctttgccctagcagtgctctcgtggccactctcgctatggcctttctgtctctccattcccttcacagagtcaggttctggtggaagtatgacctctggcttttttggggaggtgaggggtagggatgaagggggagggaatcgggttgggattggcaggaactcagctgggggcttcccggtgtggaagaagctttgtgacaggtgtttattgtttcctcttcccatagatctgacagacatccctgaatcttggtgtttggacataggaggtatgaatcactcacataattagccgcttttaatcatcagtgtcttagagctatatttagtggttatattagtgcaaaatgaatgggtgtggagtcgtacacctagaaacagacttgtgttcctctatacgattctaactaaatgagtagaacatacctgggtatgtcatggctactttagatctatgaggcaggaagttagaatttaaggaatctaagaaatgcagggacttgaaagattattgcaaaataaagcctttaaaaagtatcgttgttaaaatgaaagtgtttcgatttgattcctttgaagggtgagtacgtaatgaacagtgctctatctttggttagagctcagcctctttaccaaggtacatgtattaattttgtttcactggaatatatgtgacattattttctctagaggtttgttgctttgcttaatagactacagttgccaaaaatcaatgtgtgtgggcatctcatcctggtttgcaacccctttaaggcaaatcagtgcttggaagttgttcgaagtagtaaacctattattaatgattgttgtagaacataacttttgctggtatctttgatttgcattatcctaccattagatcaggcagagagtgaaataattgagattttgagccttgttagaacaacaatgcctggctttggtcaggggattgggtaggaaaagtgacactatttggttgctttaaatttttttttttttttttgagatggcatcttgctctgttgcccaggctggagtgcagtggtgtgaactcggctcactgtaacttctgcctcctgggtttcagcgattctcctgtcgcagcctcctaagtagctgggatttcaggtgtgtgccaccacgcccagctaattttttgtatttttagtagagacagggtttcaccacgttggccaggctggtcgtgaactactgacttcaggtgatcttcctgcctaggcctcccaaag

SEQ ID NO: 110098 - DNA, 1035 bp, Homo sapiens
gtgacagagcgagaactccttctcaaaaaaaaaaaagaaggaaagaaaggtacgtgctctgggcactcagaggaaggagccgctagcctctgggtcagattctgacctgtggcgaaagggccagagaagagtccgtggccaggtagtgctcccggtgaggggagggggtgtgtgaggccgggcaggctgtgaaaggcctggactgccaccctgaggaatccagacttcatcccagtcagtggttctgagtttcagatttcaagggtcagtttaagttcaaccaatctaggggacttacaatggctaattgattattttgccaaataaggccaattaaaacccaaaccaaaaactcaacaccaactactgcttactattaccattctttcctaaaagggcatttaacaccaaaacagttgggaggacacaaactcataacggaagacagtcctctccccgcaccaaaagacagctggcaattgtctactgacatacaagcggccgctacattgtccttgtggttctcatttttccacagacagatggaaacctcctcgctgaatggggctgggaaccacagcggtgggaccaagagagagaacagctcagacctgagagttacgcctgtgtgtgatccaagctgtgacgtgtgttttattcacagacataaaagctcaaaatgaggtaaagtttatacaggtgtcagccgtggtgcccacgacagggcccacttgtgtatggccccactaacacagcaggatgtagctggtgctcctcggggggagaaaagctcccatgggcaaatcagtttgagaagcactgagacttttttttttttagatggagtctcgctctgttggctaagctggagtgcagtggcatgatcttggctcactgtaatttccacctcccgggttcaagtgattctcatgcctcagcctcccaagtagctgggattacaggtgcgaaccaccacgcctggctaatttttgtgtttttagtagagacagggtttctccatgttggccaggctgg

SEQ ID NO: 110099 - DNA, 1028 bp, Homo sapiens
tgttagccaggctggtctcgatctcttgacctcgtgatctgctggcctcggcctcccaaagtgctgggactacaggtgtgagccactgcgtccggccgtgtctatcatcttgagagtgatgggagtcaggaggcttgagtactggagactcagggtcagatgtgcattttagagccatctggggaagttgttgcgggtggcctgggggagaggagagtagcagccgagcagtcagtcagggccagttggaagcccgaggaaaaggaagtgtggcctaaactgaggttggagcagacggagaagcagagacagagttgagcgagttgggaagtggagcgctggaggggtgaggaggtgcgggtgagggaggcagggctccgggtgactccctgagttctggcctacacgaggggtcctcaggaggaagagaattgggaaagaggtgacgagaagttcaccccatgtcccactattccaccaagactgtcttgtcgaggtcaccgatgacctccaagctgctaagtccaccatcattccattctgagagtccacgcactcggccaccagctgctcctggcgtctgtggcccccactcttctgtgtttcctgccaccctcacaggctcttctttcccctcggcctctgctggctcctctgggtaagcttgactgtagagagggagtccaacgccctgtcccaggcaggctccctgctcctggtgggccctgcagtcccacagtcccctcgctctgcacaccagttcttgctgacttcccccattcgtgtctccgtcctttcccctcccctcagttcccatctcggctgcccagctgcccattcagctgtcaccatatggcatctcacgcttacctcgtccaacacagaattctggatttccatgcccagaccggctcctctccccatcttcctcatcttagtaaatgacgcactgtctttgcagtggttcaagcccaaaattcctctttccctggccacacccccatgcccatccattccttttgagagtc

SEQ ID NO: 110100 - DNA, 1114 bp, Homo sapiens
aaacatgctttttctcctgaatttttcccattccctagccaaggcctatatatctgtaaatatggtcatgaaatgaacatatttaatgagtcatctaatgagtttatatgtgtattatgtatataaactaaattttatatgtattatatataaactgaattatatatataaactaaattatatataaacttaactatatataatttaatttatataaaactaaattatataaatataatttgtatatatatgaactcatctaatgaattataatttagtttatatataactcatctaatgagtttaatataaactatttacaatttttattcatatatatttaaatatataagtatgtaatcagaaatatatggtgtttgtgtatatacatattcatatatatagtgactttctgtatataaaggctgcttacatagaaatataaatagtgcatatttccttttattgaaccaatagttttattacatattctccagaaatgtcctcttggctttaaaatttccagaatatcatctctcatttttcggatcttccccatgtgacctgggtcagaatcggggtcccagggagagaagggccgggcctcagctcttctgatccggtctctgtgttaggctgttcttgcattgctctaaaggaatgcctcaggccgggtcactcataaggaaaccaggtgtaattggctcacggtttggcaggctcccaagcatgacgccagcatctgctgggcttctggggaggcctcagggaccttttactcatggcggaaggcaaagtgtgagcaggcagagagagagagagtgcaagagggtggaagggaaggtgccacacacacatttttgaacagccagatctcaggagaactcactcactgtcgtgaggacagcacccagggtatggtgccagaccattcatgagatatccaccccatgacccaaccacctcccaccaggccccacctccgacactggggattacgactcaacatgagatctggcggggacaaatgtccaaaccatcccagtctccctcacgttctcccagcggacattggcgagccgctgcccagcgtcaggtgctgggcactgagatg

SEQ ID NO: 110101 - DNA, 1032 bp, Homo sapiens
cttgtaatcccagctactctggaggctgaggtggagaatcgcttgaacccaggaggcagaggttgcagtgagccgagattgtgccactgcactccagcctgggcgacaagagggaaactccgtctaaaaaaaaaaaaaaaaaaaagagtgtcttatgggcaggcattctccaggcatccacgttgagggaggccctgtgtcggccagtgctggggggggtaagatgtgagcaggggcgagcgcttgccctccgggagctcagtctcatggaagacacgggaatgtgaagcagcatctcctcacgcttcaagaaagatagaaacaaatgtttggggtttcagaagagagagaaggctcctacgctcttcaaatgagcaagggtgaaaactgtttacactgccagaccgtggggtggtggggaggcgtcacgttacctcagaagggagcgtgaatttgaggacacaggctagggaaaggccatcggcagaggagagcacacaggaaaagcccccacgtgcgaaagcgcctgagaaacagcaagacactgtggacgtgtgaccgctgctctgccaagtttcctctgcagacgactctgagacaactgttcctgtctcactgacagaacagtgggcaaacccaactccatggcaagtcataggcccatttagtctgaaaagaatcagctgggtgcggtggctcatgcctgtaatgccagcactttgggaggccgaggcaggtggatcacctgaggtcaggagttcaaggccatcctggccaacatgctgaaaccccgtctctactaaaaatacaaaaactagccaggcgtggtggcgggtgcctgtaatcccagctactgtggaggcaggatggatcacttgaatccaggaggtgggggttgcagtgagccgagatcgtgctgctgcactccatcctaggtgactgagcactactccatctaaaaaaaaaaaaaaaaattacttgcccaggagcatcttggttgaatagcagctccaggggaacaggattcagggc

SEQ ID NO: 110102 - DNA, 1072 bp, Homo sapiens
acaatttctaagttcactatctgcaagtccatatagaagaaaatctctgacagtaaattttcaaagatattgccagattactctcattttactttgtatttctttaaatactagtgaagttgagcatctttccaaatgttttgtgaccatttatttttcttctgggaatcacattttcctatacatggttctgtcttaatgatttgtaaaagttctttgttatatgtgctacacattttttccaatgttaatttatggtttctttggccccaaagaagttgacaattttaatagactatatttttcctttttggtttgactgggtttggtgttttacttgggaaggtcttctccctcccaaaaagataaaactatcttcctgtaatatttacttacttttttaacatttagatttttaatctgacgaaatttattgttgtatattgtgtaaattaggattctaactattttcttcgaaactggaaaagccagtcgacagctagtatgtgagggaactgagttttgaacgcagcctgtctgctgaagccgtgttcttaaccaccatgcttcgctgcttttctaattgagttagtattaaagggatcttactggggaaaaaaatgtaggtacatcattcagtaagaaaacttctctgttgctttctgttttgcaagtagtattgatagcgtagcattctcctacaggtagcctccatgaataaatgtttaaaataaggaggctgggtgtagtgcctcacgcttgtaatcccagcactttgggaggccgaagtgggtggatcacctgaggtcaggagttcaagaccagcctgaacaacgtggtgaaaccccatctctactaaaaatacaaaaagtagccaggcgtggtggcatgcgcctgtaatcccaggtacttgggaggctgaggcatcagaattgcttgaacctgggaggtggaggttgcagtgagccaagattgtgcctctgcactccagcctgggcaacagaacgagactccatctcaacaaaaaataaaataaaaataaaataaagagaagaaataactggagtagaga

SEQ ID NO: 110103 - DNA, 1215 bp, Homo sapiens
ttctgaatttcttactctagaaattctgcagacacttattgatcacctgccacatgccagacattccacttggctttaactaaaacgtgactgaaaattaaaaataattgtgtgttgtgattattcaaatgtccatccgatcagcctcacccagtgtggaagatgcgatggaaaccactgtctgtagatggggcagtgagggaaggctgggaacaaggggatgaaattttctgtagcatctgctgttaacagcaaaacatataatattaaaatgtgcataacttggccatttgtcactggagatgtgtctgaataaatatacccacaccacaggagaaaaaagatgtctcaacaaacacagcatggatttcaaataattttctaaagtaaccagatgcttatgctagtcttgccaccatctatgtcatatctttgagtcttttgatagatgtactgttttactgtttggtaacttctgagtctcttctaggtgggctaccctaatgttggtaagagttcaacaatcaacaccatcatgggcaacaagaaagtatctgtgtctgccacacctggtcacacaaagcactttcaggtatttctgtggtgctttgccacttgcatgcagctctttcttccttttatctgttgtatacccagctcaaacctcttgcttgtcttccagactctctatgtggagcctggcctctgcctgtgtgactgtcctggcttggtgatgccatcttttgtgtctaccaaggcagaaatgacttgcagcggaatcctcccaattgatcagatgagagatcatgttcctcctgtatcactaatatcctttctgctttggaaacactctagttattacgtgcatattagggcttcaggtttattttgggcatttgagggattcagatttgatgaagaattgaaaatactagtgatctgcacaagtttatactgtgagatagcatgagaacttcagaatagaacctcatttcctgatttcagcagtgtagccttgaagaaatgggagaatccaggtttcagatactcagttccaagttgcaaacctatttaacaatgccatgtaaccgtttgaatgaccttggaaaacttgcttaaccttcccaaatactttccttttctctaagtgggggaaaatctatctcacggttgattatatttaatcagtatagctaacatatattgaatacttgc

SEQ ID NO: 110104 - DNA, 1098 bp, Homo sapiens
gcagtggcaccatctcggctcactgcaccctccgcctctcaggttcaagcagttctcctgcttcagcctcccaagtagctgggattacaggtgtgcaccaccacgcctggctaatttttgtatttttagtagaggcggggtttcaccatgttggtcagcgtggtctcaaactcctgacctcaaatgatctgcgcaccttggcctcccaaagtgctgggattacaggcttgagccaccacgcccagccatcctctgtccatcttacaactcattaagtatttttactagagtggaaactgcagttatatacttctgagcgtttctattattttgtcaggaagaggcaaacagagatgatagacaaagcaacacaaccaagtttggacattccagtttcgaccaggctgaaatttcccacagtgaatccgaacatctcccagctagggattctccttcacttagtgaaaatcccacaacggatgaagatgacagtgagtatgaggactgtccagaggaggaggaagacgactggcagacgtgctcagaagaagacggtcccaaggaagaggactgcagccaggactggaaggaaagctctactgcagattctgaggctcggagcaggaaaaccccacagaagaggcagatacacaattttagccatctggtatccaagcaggagttactggagctctttaaggagctacacactgggagaaaggtgaaagatgggcaacttacggtcggactggtaagatgacatatgtcataacattgttaccacgtgattgtctttaatccccatttttcagtagctgcacgaccccaaagaccaaccaggcttccggcatcgtagggaacattgccctcttgttgcccactggcatcacgggattaggcagtgggatagacagagcccaactcaaaggaatcaacttcctcaaggcctgtgttggtaacatacctattcacattgaatgtattctccagtctcctttcagttcagcttttcctgccgtgtgaagtaccaagacagcagaatgagagagatgttaatgttgtcttcagacttcagcccagtgttctttgggcaccctg

SEQ ID NO: 110105 - DNA, 2453 bp, Homo sapiens
tattcctgggtttaaataagatactagcttcaatagtggcagctgtcagcaagtgatttactagttttcttttgaggccttaacatgagggcagattagggattgaatatttagtagactttgccgtggagtgaagtgtttggaatactcttttatctcaccaggacagtttaatagaagtacggtggatgtcttagcaatgaaacatcatccgaacccctctaggctgtatgagagcaatagcatgttatgattaagagcatcacctctggtccaggctgcctgggctcccattctggctgtgttacttactagctggtggccttgggcaagttacttaactgctctgagccttaagtcactcatatataaaccgggaataattataccttaaaaagttaatatatgtccagtgcttaatatattgccagggtttgctactctggccattattatgtggttagtaaaatccctttcacttcacggtgattggtctatctcgtgtttgtttttcagtgatattgtggtccagatagtagatgctcgaaacccactcctgtttagatgtgaggatttggtaagtcaagtttgacaaaattcaaacatcagtcctttgagtagcagtgccagcaccgcatccctcagcaatgactgtaggcatacattctgccctctctggcttcgtttagtgaggccttccctccttccaaggccaggagcttgcagaacgccactgttgagacagatgttttctcaaacaatggtgtccatctgcaggaaggcacagacacttaaatgagctttctagcttttagtttagaagccacttaaggcatttgccggtttcccatttgtcagggaacaccagttgaaatagcattttatttattttagcatattgccggtcacttcactttttaattcatcccataaggttctgtcttctcacactttagttatgactccctgtggtattttacaagtgaactaagtttatgaaacaccacaggggctgataactaacatgtgagagtcccatgaaataatgtaatacagctttgggttagttaacaaaacattgtataatatgtgaggtattcatatttctttttgagaactgtaatacatattatttatttatttattactatcttatagatctaattttttgtagagacaggatcttgtcatgttgcccaggctggtctcgaactcctgggctcaagcaatcctccctcctccgcctcccaaagtgctggaattacaggcgtgagcccccatgcctggcccagattatttttaaacccactggtgcataacaaaaatattaatggtggaacttcttttcaaagcttactgaaaggattagtataatgtgtcatgattaaaaatgtttaaattaggaaatgatttaaaactaggggcagtaaaaacttgtattgggatctttaatataattagcctcatttttttacttgtttgaagaggtctttctaaatctctttgtcttgcttaggaatgttatgtgaaagaaatggatgccaataaggagaacgtcattctgatcaacaaggcagacttgctgactgctgagcagcggagtgcctgggccatgtacttcgaaaaagaagatgtgaaggttattttctggtcagctttggccggagccattcccctgaatggtgactctgaggtaacctgagggacattttaggttggctttcaaagagggaattttgatttcttgttaatgtgcttcgtttgtgttttgtttattcttatggaaaatctgtgggaattagagtttttcctctgtgtgctggattaggatgacctatagaaagtgaatcacaaagttactttctctgtggttgttggacagtctgacctctccagtgttgttacacactgatattagctgtatttttaaatttttttaaaaggttgtagacaggaaattgtataggaagttccacaatgaccctgtaactgcttttaagagaagtcagaacacaagagtacaactgaaggatgtagtcagttctcaggacttgattagaatctcttttgactttgttttgaaaacagagaaactaagtaaccctaaattaggatataccacatattttatcttttagcccaaattttgcaaaagtagtttgggctttatttttacttttgaataaaataatatctataagagggccaggtgccgtggctcactcctgtaatcccagcactttgggaagccgagaggggcagatcacctgaggtcgggagttcgagaccagccctaccaacatggagaaaccccatctctactgaaaatacaacattagccgggcatggtggcgggtgcctgtaatcccagctactcgggaggctgaggcaggagaatcggctgaacctgggaggcggaggttgtagtgaaccgagatcatgccagtgcactc

SEQ ID NO: 110106 - DNA, 1070 bp, Homo sapiens
agggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaaggctttctctgaggcggaagaagggaaagggtttctgctgatttggggtccatgcaggctccttttactcaagcttgaggagggcttcggaaggcccacagtcattctcctggggaactggggaactgctgtggagcagagtagcctcttcgttggtgcctccttggtagttgatgctgtgtactcctgagaatgcccgttttctaatttccgaagagaaatggtaacaagtgcagaagtactgcagcccggaccttgaggacagcaccctccatcttcacacttaattacagtttttgttttgttttcagattttgtcctacttcctatattatctgtctttcctctttgttccttttctttttctcctggtttctgacttttacggaagaggccttcctcaggtgtctagtggtgtttatctgtctttaagaacaaagcattacaaagccggttgacaagcctgcctgtttaggtggaatttgccaactggtgagcttcactgtagggtgcctgggcaggggtcagttttattttgttggaataccccaagatgttaagatctgtaggtcttttccccagagccagtcagttttgtgtgtgtgtggttttgttttgttttttgagacggactttcgctcttgttacccaggctggagtgcagtggcgtg

SEQ ID NO: 110107 - DNA, 1061 bp, Homo sapiens
ctttttctcagctgccattattagatccaaattacctattttattttggttacttatatgaggaatttttttccttctatgattgtttcagaccaaactggaaccaaaatactaccccagaagaactcaaacaagcagagaaagataactttctagaatggagacgtcagcttgtccggtgagtattatagactctatgaagacttactttgaaatcctgagttcagatatttggcatgcttacacagccatttgtgttttgaagttttgattcttttaagaaggaaatggtagcattctgctaacaagtgcaaatagatgtatgcacaaacaagattgctaggtgcaaatgcatccttgcacagagatcgtgagttggttactctgctcagttccgggccttttcctttcattcccttctttggccattgggcatcctggagttgatcgctgctctcctgcacatttttccagtaagagtgtgggaaagaaatgactttgtgtgataggtaaacttccagggcataaatagcttcaggataaaatttgaatttggtggagtattgtctaaataaatagtatttttatggtgtctcagcaggaaatatataaaataatttgactctggatatttgtgcccagtacttatttttaatgtaataaatttgagcatttacactgctaaaaattgtctattataatctggcaaatatataaacttctcattcaaaaactaggctagaagaggaacagaagctgatattgactccatttgaacgaaatttggacttttggcgccagctctggagagtcattgagagaaggtgaattatcattttcttttgtgtaataaagacattgtagtgaagttatattcgatttggctgttgatataggcttataggctcagggtatgggaattaagctatgcagagggttactgagaattataaaaacacagcatgatactaccgtatattttgtatagtttttttgttgttagatgaatatgttgataagtgtgtgagaataatgaacattttctgcaaggtgaattctga

SEQ ID NO: 110108 - DNA, 1046 bp, Homo sapiens
tttcagtattcttctattgccattttactgtactgaacggtacttgaatgcttgtatcattatatgtacatacacctttgggtcactatgtaaaatgtatttcttattgtgggattatatcaaataaagttttgactaattttgactagcacagtcagacaatctgggttcaagttctacctgtgccatttagattttgactataggcaagttattttatctgctgaagccttagtttcatcatcagtaaaatggaaatacagtaaaattcacctcaaaagattttgaaaattaatgaaatggtgaaagggaactgcctattgtgaggtaagaacgtgttcctttaaacattaactataagtagtattgattctaaagggactacaaccaccctcaagaccatagactagttgcaaggaattttagagcttattggatgccaagagcagaagagagcagctgtatttatcaccctgtgttttttcatagttgcacacaagtgaactcaatgatggctatgattggggtcgtcttaatcttcagtcagtgactgaacagagctcccttgatgacttccttgctactgcagaacttgcaggaacagagtttgtagctggtaagttgtttattgctgagtgcaggtgagactgtcacatttccatctggggctgaggttttttttgttttttgttttgagatggagtctcgctctgtcacccaggctgaagtgcagtggcgtgatatcagctcactgcagctccgcctcctgggttcaagcaattcacctgcctcagcctcccaagtagctaggactacaggcacgcactgccacgcctggctaatttttgtatttctagtagagatggggtttcaccatgttggccaggatgttcttgatctcctgacctcgtgattcgccttccttggcctcccaaagtgctgggattacaggtgtgagccaccgtgcccgccctgagtcttgaacaatgagtagatgttcaaaggacagatgagataagaccttttacacagacaggcagaggact

SEQ ID NO: 110109 - DNA, 1089 bp, Homo sapiens
taatactggtaaaatcgagacgtaaaaggagaacttgagaacaagtcattctgctttcccctctcaagtttgagcctgaactacttgggctcgcttatcgtcacttccggggatcgaactgtgaatcccggaaactgcacgcgccgagccgggaagcttcgtccagcggtcgtgttgccatgggccggaggagagccccggccggtgggtcgctgggacgggcccttatgcgccatcagactcagcggagccgaagccatcgtcacactgactcctgggtaagacagaccatgtcatctttcttatcttttctgtctagcctgagtgctgcaaaattcggggtcaaaagtcagataagttttgcaggagggacgcctcagccgggttttgaaggatgagttggagtttctgccaagctgagtagcaggccctcctcctggcaaggcccagaacacaaaggtaggagaagcttgaaagaagagttagtgtggtgatgaggcgtggagtgagaatctgaagagtcttcaatgccaggtcttgagtacgtttgggttttgccctagaagccactgaagtgcttggaacttccagagcaggaaaaagacaaaacgtatttttgtattgatttgttcaaagaatggatcctccagaagcggttggttactgccagaaatataaaataattcagatccttgcctcatccttgcgaagcaccccctagtggtttagctcaaagataaatcattgatttttcaggtgtgacaagacctaatattttactaggttatagaaggatctttaaaaaaatgaatgaagtgatttggcttgtgttcatcattctagtcgttattttcaccattcattcccccgggaatgaatgagaacatgttgagtgctaagatcgtgtgctaaatttagttaaatatgtccctggagctaagtaagcgtgtgccactgtcacaccagctgactttcatccatatagtctgcagagtaaacagcatggagtgcttatcagtattcatcaggtcagagttactctggacattagattactggtaatttttattagctttgaagcaacttgtt

SEQ ID NO: 110110 - DNA, 1124 bp, Homo sapiens
tgggatgtaattggaggattggaccggtctccccgctccctcgaccaatggctgtcacgcggtccctttaagaaaccaggaatccgcccggagtcggagcccaaaacagatcctcttctctgctcctcccctgtccccgcgcggcgaatggttcgcgccggcctatatttacccgagatcttcctcccggacggcaaggatgtgaggcaggcgagccggacgccgctcgcagcaccggagagggcgcactgcaaaggcgggcagcagaccgtggagagcccgggagcggagctggacaccgcctcggagggaagaaatgaggtagcggcggttcccggacccggccatgcccgtcccctgttctcggagcccagcgccgtctcggccaggccagcccggacactgagcgggccgagcgcgagtccccggcgtccggcggagcgaagatgcagtgagtccccgcgggactgctgcgcggggcccgccgcggccagccggacccagcatccgaccgcactttgggcgagctgctgacttgagaccagcccaaacggggggctttccatctccagcacccctcggaggtggggagcaccggcccctaggcacactcgctgtagagtttccgcgggttttggccccagtcctgagggttgtgtgtgttaggggacccacctcacgttcgccgaggagttcctgcatattcttgcaccatcccgggtgctgttgctggggctctctttatttgcacgcgcgcttctagcttttttcctgacattttccactctacgctcgttctttctcccttgcattttgttgcttgcctgagactctttgctctcgcccttgcccaggctggggtaattctgtgtgcgcgcgtgtctcccccgcaccaaccttttttgcacactcgaagctgaatattttcttttttagagaatttacccgcacctcctgcggggttcctaagcactctctctgctcccctccccccaactccctaccacagggccgctcccagtagttttattcttcgatcttgcccgggccgagcctggcaggggccggtggctcagcgggcctcgcacccggcgctccgccgccgccgccgcccagctgcgccg

SEQ ID NO: 110111 - DNA, 1056 bp, Homo sapiens
gagagagaggcacccctctgggatgcgggtgagggaaggttggctgaagttcctagtctcaggccgtaggtgcctggccagtttcctgtttgtggggcagctggggcctgaggaggaggggttcacttcctcctcccaccccctgggagcggccctgcgctgtcactgacatctcattaaaaaaaaaaaaaaatttgctctcaaggtgtttgaggctttaatgcaaccctttagcccttggttctttttggtgcaagaattctggctgtttacctcagactcagacccctgaaatgttgccaaattcttcaaataactgtttggggggtggggggagatgaaagagagtcgcgttttgtttacagttaaagacatccaatatcttaaaaaggagttttcctttagaaacacacacacccttcctcttgctcaaaagatctcactccatgatactgtgtaaaatatttttgcactgttgtgaagtatttttgacttttttctgtacataactgtgttctcagagctgaatgtttatatcttttgctgtgcaaaagaaacatgtaaaatgttgttcagttgtatatacagaaatgtgtataaaacattttgttattttttaaaagtagcactgttctggttctgtttgcacgccagtggggagagaataaagaggaaaatttaacagaacaggtgagcgtctggaactgctgcgttggggtgggagaggctgtgtctgaccctgggatggtgtcataagacagtctttggcctttcctgtgcttggagagaattagggaaggaaggtccactttatgcgccatctggggccttcctggacctccacaactctgggtgctgtgtctgggaccagccttttcttgtattatcctgtatttttcagtaattaagttgtgtgatctttttctggtcttttggagaggccacggtgagttccatatcgcactcccagacctgtgaggttatttatggaggagtgacttccagatctgctgagattttactacctccttctgtgggccatgctaataatcaagc

SEQ ID NO: 110112 - DNA, 1007 bp, Homo sapiens
tctcttctctctttccttcccccaggcctctccttggtgtctgctgtccacgagcacagccctgtcttcagagccaggggatcaggaaacagcatgggtcatgttgagagacacaagctcacctctgcccacaggacgaaacagcctggcgggcacaggcctcacatccaactcctgggggtccctagcctgccctccctgaccctccatcctcacccagatcctccgctgctccccgggagccctcggcttgcacagctttcacctgggctgggaaagtctctcttctgcacactcgctgccatgtttgccaagcaccagacctttaagtaccatgtaccatttttttttcatatctgcataccacatgtactgttatttgcttgttagttttctttagagtgactctctttatattaattgattttacaagtgaaacgaaatgatgaaaaccagaatcacttgctataaatagacgatgcctgagtaacggaatacaataaaaacaaaatactatcattttagctcaatatcgttgtcttccaaagatccaggcttgagacctgccctgtgtttactgaatggaatatcaccatctgttcaagatgtaccaatgagactttctttttaaagtacactaaagaaaccaaagagaattgaaaagggcaaaaatcttcttactctgtgatttaatgctattcaacgttgtgtctgtatctacctcaaatcatttctcctccctcctgtggcccatatttcatgctttgataatcacagttctgcccaaatcctgacttgtttttaaagaccagctaaaaggttctactgcctccaaaagtcttcggagtcttttcttactacttctgcctatatctttttcttctttctctaacccccgcttccagccttttcctggtaatttttaattcaaagccaggcattgtatacatctgcatcatcaaacatagtcgttacaagtcacgtgtagctctttgaattaaaataaa

SEQ ID NO: 110113 - DNA, 1042 bp, Homo sapiens
ttcattccagacacattacagccacagaggtgaggaggattcaggtcctgcccgcagagacagttgcacatacagccagccacacaaggggcaagaagtagtctgtgctgggccacaggggcagctctcaggaggctctgtattgacttcacgcccacgctgtgctacattcatcacaaatctgacagtatgcaacaaaaagcaggccacaaaataatggatggtattaacagcagagtcaagatgtgggaaaatggaataaaatgagctctccaggtaccatctattttttagaaaatggaatccattcattcaggaagcttgatggataaatgaagtaggccagacagggagaatacaaatagcagcagctcctgtgggaagcctgccagcccctcgctgagtgcatgatctacaccatcacatcatccactgaacagcctgtgaagttggtactctgatgattcccattttacagatggagaaaccatgacacaggaatgatgtggctggcttacagtcacagagctagagccagaactcaaacccgggtctgtctcactccgaagtttctgctaatgacagcatggaaaagattcctcatttccaccagcttccttttaatcaaggcagattagacattcatgcattggctaatctaggctttgagtgtagtgacgtttatgtagtgcctacaaagcaagattagccattacacgttttgtcgttctggaaactgactcttggcaattcccagccaggctttatctcaacatacttcctgaaatctcaggccatgtgtattttgcctacagagtggctctgaaaataaagtaggctggaagtcaggtgactgatgtcatcctggactcgtaggcgattaacagtatgaccttggagaagtcaccttcctctggtttcagtttcccatttgaaaatgcaagaattgcagccattctaccactaggactagaagagacgtacctgggcattaagaggcatgctcagtgggaacagaggtgggtggattgcctgaggttag

SEQ ID NO: 110114 - DNA, 1842 bp, Homo sapiens
tcagtcaataatatcaatgttggctgtggtgaggacgtagcagaggatggtagaaagaatctgaggcttggggtccagagccctgggttcaggtcccagctctgccacttgctggtgtagtgatgcggattctgcaccccggaatgtggcagtgtttgcatgcaggctggctgtgaagacccagggcagcaggccggcaggctggttcccctgcacaccggactaactctgtcctctctctccacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggcta

SEQ ID NO: 110115 - DNA, 1022 bp, Homo sapiens
gatcagaagccctgcctgcgacaaactgaggacctctgttccctttctgcaaaaatgcaggcagtaatgtccctgggctgccagggagagggagccgaggtggagagtgtgagagggcttcgtgacccacgctgtgctgttgcgttggggggattggcggtactgcctgtttaggccattttgccatgggatagaagttcctcgcacgagctccaatactgtccacaccccgtaccattccttctaccccgaggctgatgcgattcctctacgagaaccagcagacacagaagccagagaaacccaccattcccttaggtgactgctctgtctttctgggttcatttggggatagtagggacgccttgaacaagggccccctgaacatcgctttgggtggggacagtcattgttccttttcaggctgtgtttctgctgcagcacacacacggggcagcttgcacgcccaatttcctgtccctcctttccttctcaggctgatgcccagaccagtcctttctgaccatcatcaaatacctcttcatcctgattgagtggtggtgctgagcattgtccccaaagagccacttgtgctgtggccttctcctggaggcatattctgtcctcttctctctgcctgcggcccccatctcctgagcccagcgagctcagtgctagttcactgtttgctcctccttgctgcagacacagaagatttgggagcgttcctgccgaggttggtaaggatacctggaacagtgggcggcctctttgctccccacttgctaggagtaaagccgtttaaaaagacacctgagcctctccgggttcctgctcctcactcaaccccacagtagatctggtggggaggttgagggctcagtgaatctgcaggtgcagcatcgtgtcctcagtgtcctgccccctgcttccacccggtgtcgacagctgcacggtccaccccacgcctgcctttccatcgttcctcatcagccctgtgatctttcctgtggccctgctgt

SEQ ID NO: 110116 - DNA, 1038 bp, Homo sapiens
actctccagaattccgtaccacctgcttggtgctctctgcttatggccggtacctccagccacctgctgggctcctccacattgctgttctctgggcacctgtttgggactcaacatggaattcccttttcctccgccccacacccactcctcccagctccgccatggctgtttctggctccgccgtctgagtagggatccaggcttaaagcccctccactgcctcttccccctcatctctgtcccttgcccctcccagggccgaggctccggggctgcatgtgactgagtgagggtgagttccccagtccctgcccatctgtttttacagctccagggctgcagatgctgggggaaggtcacgtgactgacaaccccaggcaggctgggcacggggagcggagggccaggagaagccttcgagaagggcatggcacatcctgaggatacggggcagcaaccttggggtcctggtggtgccgtgccatgtggaggcctcaggcctgccagctgcccttctgcagggctctggagaaacggacgcctgcagggggctgaagggctgccctgcaccaggtcagaggccttgccatcagggccattcaccccctacgacgtccagccccaggccgcgctttacagggccccacagagatgggctggtcatagctggtacagctttgggaacgagactgacactatgggtcacctttatcattccagactccaggaggctggctgggtggacgagggctgatcgctgaggagccgccacaacctaagcctgggcagggaggagcatttgcagcatcagctctgcagaggctgagcacctacagggacaggcagggctgctcctcagggcacgctgctgggcagggtcagcgcagagtcccggaccagcccagtgggggcatcttccccattccatccatgttattgcggcactgcctctgggttgagattgcaggagatgttgcaagggggagcttttggacatctctctgctggggtccccgtgccgccccctacatcatc

SEQ ID NO: 110117 - DNA, 1024 bp, Homo sapiens
ggggatgagtctgccgaccggactcccatgtcagctttgtgtctggacagaacaaggggcgaggaagcctggtcgggccactctgggcctgcatgcgtgtgggcaggtgtctgttggtcttgggcaaagggcgaggtgacactgagggcgtgagggaggaggccccaagagagcagggaagcgtggaagatgccagctggcctgggggcgtggatgtgggtttcagcagagtgcagacaggcagtggggcgtggggcctccttggggcctcgctgggctgtgtcgggtgcttgctttcttttctcctttgcctccttccaaggtgcgtccacagccagcgtttctttatgcttttccctcagtctgagacctaggaacaggagaggccagtgctgtgaatttcatgtttcatggcctccccagcaagccagcccacgaaattccacacagggaggaggaagaggaggaggaggaggaggagctgccactgtccccgaggggagcagctgacactctccccttgactgcaccaggccttgggggtatggcgcctccacggacgtgggctgggggaggataggctcctaattagtttggatgcgcttggagtcagggcaccttttccccagtgggcagttctgcaccctgaacagctgtggggagaagggcagcgggaggacggccagataattccagaagaaaggctccaggagtggcagcagaactgctgttattttcggaggagtctaattactttccccaggtaatggcttgaagtagcatctaattttatttatttatttatttatttatttttatttttttattatactttaagttctagggtacatgtgcacattgtgcaggttagttacatatgtatacatgtgccatgctggtgcgctgcacccactaactcgtcatctagcattaggtatatcccccaatgctatccctcccccctcccaccaccccacaacagtccccagagtgtgatattccccttcctgtgtccatgtgatct

SEQ ID NO: 110118 - DNA, 1053 bp, Homo sapiens
taatgtgtgtgctaaatatgtctctctgtggtcatgatgcctgggtggtgatggacacagatcatggctgtccagctgctaccccacacgtgagtccacgcacctgcgccagggtcaacctcgtatgtgtgaagctgagcacgtttatttatttcttagagtttattattttaatctcttgggaagggagagggagaggagaaaatagaccctcttcaacagcaagcggttgtttgagaacgcggtgtctgtctgccatgtcctcggttcccctggtacattccacgttaattacaccgtactctgctaccacagtttttcctttggtatccacagctttggaaagtaaatacattgtgattgtggaatggtctgtgcttgaagcaatgagatggaaagggagaagcagcagccctgccaagccaaggggcacatgtcccaagtcaacagggccgctcagggctcgggcagaacatgggacggaaagccctgaggcagcttggagaccccaggctgcaggccaggaggcccagggagggtcccacccgtaggtagtgttggaatgaggcagagagtgagttttccagtccctctgattgccatcaagaggcaccagggccttaactgtcagaacccataggaaaaaaatcactttcttctgatgacgggctctgcagcaggggccagcgcagcgaggagggctcccgagaccttgacagcatcaaggcccgtggcttcacctcctctgccactgtgaagagagattatggtcaaatatatacataacacagaattcgccattttaaccttttgttgttgttgttgagacagtctctctctctgtctcccaggctggagtgcagtggcacgatctccgctcactgcaagctccgcctcccgggttcacgccattctcctgcctcagcctcccaagtagctgggactacaggcgcgcaccaccacgcccggctaattttttgtatttttagtagagacagggtttcaacatgttagccaggatggtctcgatcttctgacctcgtgatccacccg

SEQ ID NO: 110119 - DNA, 1016 bp, Homo sapiens
caccacacacacgcacacatacaccacacacaccacacagacaccacacacactcatacaacacacaccacacacacgtgcactcatatgccacacaaccacacacaccatgcacacacacaccccctacacatgtacaccacacacatgcacactcatacaccacacacgtacacatacctcacacacacatgcacacatataccacatacacgcacacatataccacacactcatacaccaccaacacacacaccatacacatgcacacatacatgcacacttatacactacacacatgccacacacagacacaccatacacgcacacacacgctgctggcttgggagagccaggcctggttattccgccttctcgagagtgtgcctcaaggtgttcagctatagtgaaggcgctgctgggctgtcggcctctgctgtggaagtaccttgcctgtgccctccttcataaaatgatgctcctgttcaagagtggagatctgcaagcaacgaagagagagtatctggaggaatgctgagcatgaattttgggggtagtgggactgggtgattaacagtcctggctctgcccctttcgagttcactttcctgagaattcactgctttatcaatatattggaaataataatacctttggggttttcgtgagaactaaagaaaatacaggtaaagctctgaagtagtgcttacctcacaagataatagctgccttaattattatttctagccactgtgtgggacgtgacgttaccagtagggtgttgtaaggacatccttggatttactttctagcttcatggagggggagagtgaaattgagttatagtcacatgctgcgtaacattttggtcaatatatgatggtggtcccgtccgattataataccatattattactgtaccttttctatgtttggatatgtttagatagacagataccattgtgttacaggcatctacagtattcagtatagtaacatgccatgcaggtttgtag

SEQ ID NO: 110120 - DNA, 1059 bp, Homo sapiens
gaggcatttacaggcaatcaggatgttcactttgcatgtagagcaggcacgcgctatttgaatcaagcttccacgattggggcgagcaaatgatcttgtatttacatatttttccgaaggccactttacctcaattttaaatctttaagttgagttcctatttttgaaaattctgttttgttgtaactgaggtaatccagcctcaaggccctgtgaagacagcttatgttagaagtctgtctgttaatcttaccacgttgaagacagtggaattctgtgagaaaagataggcttcacgagtcagtaccagtggtagatgggtgggccagtgatagtataatactcgttcagcttggtcacaatcagcgtgtcctttacctgctgcttacagacgttcacagtgacagatgctcccgtcatgagagacactgagcaccatcagacacctgcccctggagcgccatcctagccagagagatacacacaggcccagcccactcagcccagccagaccctctccgccacctcctttccccttgctccccatccagcctctctccccatctcccctctctgctatggattgaatgtgttcctcagaaattcatacgctgaagccctaaccaccactccctcagaatgtgaccttatttggaatagggtcgttgcagatgtcatttgttaagatgaggtcctcatggtcgagcctaatccagtatgactggtgttcttataaaaagaggaatttgggcacagacacacacacacagggagaacatcacgtaaaggagaagtcagatcacggctttgcttctgcgtgctaaggaatagcaaagattgccagcgaaccaccagaagctaggggagcggcctggaacaggctcggcctcgcagccctcagagggatccagccctgccgacccatgatctcagacttctagcctccaggactgcggacaatcagtgtctgctgtttaagcaaaccggtttgtactttgtcgtggcagccctagaaaataaatatcaccctgcccccacccacatacacatacctcacac

SEQ ID NO: 110121 - DNA, 1046 bp, Homo sapiens
ggggcacagttgttgcaggatgattggctgccaccataagtgggcaaaatcatgggcagatcatcctgcttccttaattgaatcttggaatgcattcagaatcttcaacccaggggtctggcactcaaggcgtttgtgacctggcactgactcagtacgctctagccaaattgggcactcatggctcccagatgctgtgccaagctttcacctgcttatctttgcttgcactgttcctgccacctggagggacttctcttcacccatctctaccttgagaaatcctctctgtcattcatggccaactcagacaccccttcttcatagcattctttgcccgccggcctcaggagcaccctctggcactatcagaatgcccagggctcctttccacccttttctcctggccacaaccctttctcctggccacacccctttccgcctctttgcctggtcctgtgggtgctgtgcaggctccctcagccaagctcggcattcccaggcctggctccgagtaggtgtttgtggaatgaatggctaaaaagtaaagcaaaaagctcatgaaacagaggggaaatccaaaactgattaaagagaaaaaggattctaacaaaaaagaccgtgagtgctgggttcacactgcctgggttcaggtcctggctccactatttaatagccctgtgaccttggacaaaccagtaaaccgctttgtgcctcagtttccccctatgttaaggataagcgtactacctaatcagggatgttctgagaattaagattcttgaaaacatgtcagcttcttggaacggtgcctgcctcgtagtaagtgttaatatacgttagtgcaccactcccctcccaagctttcccaactccctggcttgtcgaagatagtgtcagaaactggcgtttttccgagctcccgccagatgttcacctccgtttccatcctgcagttgcggcgaaatcagtgggagatgttttcctgaggcggctccatccttactgtggaagggagaaaagacgggaaggtccacggaccaagg

SEQ ID NO: 110122 - DNA, 3178 bp, Homo sapiens
gtcggtgctcagtgacggagccacggagaagggaaatcctgactctgaatcctgaatgaaatgggtttcactctcagagttactaagcacttttcatggagccatccgaggagaacactgcagggataatagcaatgctaacgatagtcatgggaatacaggggtgtttctgttgctacagctgaacaggaataataatgttagttaatgttattggggtgcaccctgtgccaggcactgtgctcaatgcttgctttatatggagtgtcactgaatcctcacggcaatgctgtaaggtcaatatgaatattactcccattttccagatgagaaaactgaggcacagatggtttacacatggttcaaggccagcctcagagccaggatgtggtggagccaggattccatgcccagcctgaagctctttaccaggctttccttctctgtggccatgggggctggggcggggggggcatctgagcagcagagggcagtggtggggttgggaggggcacccccaggaggatggggcagctactgtgtcagagtgggtgggggtgaggcctttgctggacgcccaggctctgccctcctttgagtagatcatcttgtccgtggaacctggatagaggccttaggctgaagacagaggagaaatctaagctttttgttttcagagagaaaagagacagcatgtgagttttgagtggaatctgatcctagagacaggcagccggtaccccagtcacgagcaggaatcctgcgggcccagtgggaacttcccatcccaagggaatgcagggacaggctgctccccccgccccgcccagcccctgacctccccctgccttccctgcttcagccacaaaccccttgaccttgttgtttcaactgcagaacaggctccccagctattgttcttggagatgattctgtgatcttaggacctttgagaaaagaacaaacagctaggaaaacacagggtggttaaaagatgtttgtgatgtttgtgccgtatggaacaaaagaggcattcgggagactcagcattgttctgcggagtgaggacgaaacagccctcggaggcctcctctcatctgggggcatccagctcattgtcgtggaatgtagctccagccatcgcttcattgtcaggccatatactctgtgcggggcccgggctaggagtgtgtttacacttgattcacttggaatcctctcctggtttctgatccattctttctgtcttcttgttgggaaaagtggctcatgttatcacccagtcactcatttcatagcagctacccaggtcccttactggatacccttcatcgcctgtcctcagcaggaccaataaagtcatatttatacagcaatctaaggtcacatagtcattttatgtgatttcccttattggatttttatatcagcttcactatatatgttatttccttttttttttttttttttgtttgagatggagtctcgctgtgtctcccaggctggagtgcaatggcgcaatctcggctcactgcaacctccacctcccaggttcaagtgattctcctgccctagcctcccgagtagctgggattacaggcgcgtgccaccacacccagctaatttttttttttttgtatttttagtagagacagggtttcaccatgctggccaggctggtcttaaactcctgacctcgtgatccacccgccctggcttcccagagtgccgggattacaggcatgagccaccgcgcctgggcttatttccattttttcaaagacaaaactgaggctcaaagcagagaggtgacctgcctgctgatgtacagctaatgacagagccccagaggaacgcagtgctcttagaaccccactgaagattcctccttcagggaactacgtttcgaaagtttactacgtcacctccttcgggaattctgaaacattgtgtactcgtatctttacccgtgaaagctgtttctgggattggcgctgtcaactccaggcccaggtctctctaattctgggttggtaggttttgcattaatgagatttaactcaccatggttcatttctccctttgcagtcccttgtgtatgcccctggggcataggtgcctgtggcaagtctgtgaaggctgcattctcccccagcttggaatgcccagtgcccctgctgcagcccacagcccttcagaaggtgattgcaaggaagccaagcctaacctcatcttccgttccttctgccatgtccacacctggcgtcacctgtgcagcctttcctgcatgagtcatggccaggcaagctcggtgacatgcactgggagcccggtgtggaagctgggaggcagtcattgtgtagtcacgctagtggtggccacgggccatggggctcctaaggaaattagaaggacctttggaactgccttcctccccaccctgctctgtatctccttcagagtttttctgataggggtagtgctgacttgttccttgggaaggcttggagatttggggtcttcgcctgcatcttatcaaaatccctgtgtctcactggaggagtaagaacctgacctgccatcaggaaatgccttagatgagtgctcagcaccggtggcaggactggggatgtttagttaagataagagaaagcccaggggggcattatctctgtcttcatatgggacaggaaatgtacttgttccttgtggctctagggggcaggacgtggagcagagagcagaagcgttaaggggtgaaattcagcatcatgtgagaaagaactcactaaaaagtcattttcaaaaagtagaacatgctgccctgagcagagtgaatttcttcttcctggaaatttccaagtgttattccgacggggaggctgtggcccaggggcccaggaatgggaactccagtgctgagtggcactgagatggccactgacctttacacttattggcatgtaattagtcccctccacagtgtcctgtagtgacagctacccacaagagctgagctccgggcaggcaccacagagggaaagagggccagggacccctcattcttattgtttccctggatgtgtgcatgcatgtgtgcgtgagagaggggggtgcatggagtttttccctttgtttccacgctaccccgacccctactccacaccaaataactcat

SEQ ID NO: 110123 - DNA, 1995 bp, Homo sapiens
tggggctgcgttcgtgagcaaaacaaacgtggtccttgcccccacggaattcacagtctagagggggaggcctagaaacactagacaaattatcaggggaaaacaaagttattctgtgccaggcccaaagccccagagctctctcatgctgccatcgcaaaccatttcccttccaggtgagtcctaggtcttggatttatacccatcgttctcccagaagcatctcagtccagcccccaaccatctggtcagttcctgtagaaaaccttgtcattttccttaaagcagctgacaagcacctagaacattgccgtttagtatgagggactctacctgagatctggcttactgcgtaaccaccctggccctctgtctctttgtctgtaaaatgagggctgtggtctagacccacacttctcgaggtgagttccatggaacaccaatcccagaatgtgtcctggaagaaaagggtgtaatgatcaagtaagtttgagaaatacgtacattttattccccctcttctagattcacggagcacactaaaggctcctagaagtcctgaagtacacagtcctgtctagctttgttgagcgttagcttttttaagctttttgacccagatccctttgttcacatgatacctgttttcctgaggcattaggacccttggaatttgctgcaaaggtctttgaagggccttctgctctgtgtgctggaattagggttctggtgatgtcctgggcgggggacagaagttgatatggggcagtggcccagaccctgtagcatctggtgcccccctttgtgattatcgtgcccgcgtctgaggagatggctggctgtgaatttcctgcagtgggctccggagacatttaagatgctcactggtggtggcactgccttggaatccgcaatcattcttaattggtctcagaaccatcagctggcgaaagcatctgtcaggggaaacttgagcagcgttcagagtcccattaataattcagctgacgagctccttcagacgcaggccttgcagccctcaggactcactcgtcttctgcctgcagagatattccagggaggccttctctgttatatcaccgacgttagtgactcaggcagtagcacctccgtgttctcccagaatccccaaagcctcatcagtcaggagagggaagattggtacagattaagccctctgtaattccgtcagccggccaggagaggggggcttgctgacggggaggctctggggagtggatgctgatggcggggtttaggcagccccttatgctgtgctggggggatttgtccactatgatggataggtggtgggcccctccacttcttccactgcctgtagccattcaggaaaaaaatgtagggtttttttttttggtaaattagaggcttgcacattgaagatacctaaaaatattggttgaatgagttctagctgattagatctggttgtcattcccatttagtagaatgatagaatgacattgccgaatgggaacatggagatcatctcctccagctccttcatttttcagtgtaggaaagtgagatcagagaacagtgactttgtcaaggtcaccaagctggttcgttgcagaaccaggccagtgcccgggctcctggcttatagcacctggtcctttccagctggccacaccctgtctctgagcacagagggctcagtgtccttcttggagggctgcaaacagccccaggcacagtgatgtggagatagcagatgctcttcccactctgctgctgagccaccaaggggagcgtgtcgcccccgctgtcacactgatggggtggtgaggggagtttgttacgtgccgtcaataatgtgaaaccaaaaaagctggaaacttccttctttctctcagcttcctggctaatttgtggtgctggggctggcagtcgcctcccccttcctgtggagtcgaaggaccttgggactcatcccttctcacctgtttg

SEQ ID NO: 110124 - DNA, 1001 bp, Homo sapiens
acacccagccaaaagtaaatactttttctttttatccttattctgtaagcttttttccattttgtaagtttttaattttttaaaacttttttgttaaaaacaagccaaacacatacatcagcctaggcctgcacagggtcaggatccccaagacgtcactaggcaatggggatttttcagctccatcatgatcttctggcaccatcctctgttcgtgtgttctgtcgttgactgcaacgtcgtcacgtggtgcgtgactgtatacaatgctgcatggcaacaagttgccgagagtgtgcatctgggagcgtttggcacagcagctcgtccgcctctgcttgttaggcgtagcagaggtgactcaaatatgaaatgtttatcatgctggaagctgaacatctagttttcttggtgcagacacattcatttttagagttcaatagatgctgtcacttatgggacacatttctcctgaaggtctttgatcacatttgcctgtagaacttccagaaactcttggacacctattgaattctccagtgttttccttcttacttgagaagaaagttcccacccttcttccccctctcccactccccaccccaagggctggctcagttatccacctgccgatgtcagctgctggtactccagggccattcaggaaaaattaattttcctttttttatcagagcgttgggacttgcagccatctgtctgctcagcaggcggggcacctggggcttcagccgtctttctcttcacatttcatgccccttaatctgcctgattccttctcttgccaccctccttctgtcaggtccctgagaccatgctggtgcttacacttgcccaccacctccaccccaagcagggttttttatttatgatgttgtaagcttttgtttcactagaactcagcaggacgattcagtttacagaatgtagttacttctgcccttgttaaccagaaaatctagtccatcagaatatatggtttt

SEQ ID NO: 110125 - DNA, 1564 bp, Homo sapiens
gtggccttcctggcagctccctgcgtcctgtgagctgcccacttcaccttgtgtgcttctggccagggcttatagcagtgctgtcgtcctgtgtgcttgaacggtgctcaactgtgtgcaaattggttttacattcatattttaaatttgctcctcatactaattcagtgacataagaacgcaggtggttttatccttgttttgtagaagacactaagttttcggtaagttgcgttcacccggggccgcttggtcaggactagaacccaggttcctgggctcagtcccctgcctgtcccctctgcccctgaggtcctggagtgatggttcttagaccacatcctctatttcctgaattaggaaatagcagctcttgagatgttttgcagtctcctacccagccaccttatagcctgggtcactgagtcccatttatttttttgggccggggtgggttgcagtatacaggtgtatgttaaagatagtcttttcattcaaacctataggagcactgagggtcctacgttggcgtttgagcgctgtccgagtggatctctcatctctgtccacagtcacatttggcaaaggctgcatttctgctctgacgtgtggggctctctccagcaaaatgatgttatcgcttttcctcccagcatggtgacggccctggtgatgctgtgatcagtgtgtaattaaaggcagccgtgcatggctgctctcagactgttgctgagggcttctgatcattgggaaatctcagtggtgtaggttttagtggaaactgtatccagccaggccattcatagcttctacaccatagagggaatgttggtcattatcagagggcatgggtttcacttttttatgtctgcagcctgagtcgggtgaacctttctcttaccctagggaagcactagaataatgcctgcctgcctacctgactgccgtcctgccatccccgtctgtccatccgtccatccatttatccatctaaggtgacagcaaagatttactgtagaaaatctctttcccacagtaaaaacctcttttctacagtagaaagctcttccagtctgagtttccgtgtctgccccttcagtcacaggaaccccatcctgctatgtactgcaaaagcagctgacttctgccacagtgtcattcccgtgggtctcagcctcctggtgctgaggcctagggactgtgttccgagccagcctgggttctccagggaagtgtggaggtgcccagtgtgtcatctgccctggaaaatggaagccacttgtacttcactgtcctccctcccatctcccaacacccctttctcttcactgaaatgctgaacaaacctccctgcccctgctgactgactcttttttgataaggggatggaaagatagactcaggtgcctcgggtccagtcccttcctatccaccttggtttcctcctgtgtaaaatgagaaaggtgaattgaactatctttcctaactctagcagaccattatagattctgttgatatcgtcgcagaattctgggaatgggagggacaccgagggtatctcgcc

SEQ ID NO: 110126 - DNA, 1043 bp, Homo sapiens
tcagttggtacaagggaagaaaatagagagaggcagcactaacctctagccaagcacactttccatctctctgcagattgcctcatgtcaggatgttagcgtgaccgtcacgtctggaaggctttatggctgatataaattcaggtccgttgttcactaggcatgaagccctccgttgtaagggaaccagccatcaccctcattacgagatgcataaatgtaggacttgaagataaaagctattgggttcttttcgtctctctgacacctgaagatgaatttcttgaaccttgttctcgtgtttaaaaaaaaaaaattaaccaagattgagcctgtcagtttctatcagagttaaatctgagtaaaggagaaaaaagcttgccaccttttaaaatagtgattccttcactccctgggagttagaaaactgggctaagtgtttttgtgtagcccgtgtgacctggaggccgtgctataacccctgcaggaattactcataaaaagggagggatgtacctgccctgtggtagagatcagaagtctactctgaggttgttatttttaaataacatcagtggaaaaggtattttaaaaggaaaactctgtacagagaacccaagcgggattgtgttgctgtcattgtgaccgtctcttacctgatggctctgcctcccgggcaggctaggagctccgggatgacgtcccaagactcgggcgcatagcgggggctgctgaagatcggagtgtgaggctgagagatgaggtccaggtggagcacgtgaaaagcttcctgtgtctgaaaacacgactccttccagttcttttgtctgtctgcacattatgagtattttggtactactgaatccgtttttaaaagttcaccacgtcgtgcctgacacaggtgtctcctgaaagaatgagtgaggaagtgaatgcgtggaaggggtgggactgggaggcagcccttctgttctgtttatgccgtgcagaccaatgccaggcacttcgatgtttgttgagtgaatgcaggaacagatgtgtag

SEQ ID NO: 110127 - DNA, 1028 bp, Homo sapiens
aaaatcaataaatcaataaaaaaaaaaatggcccatattccccaaattgtcctaagtcctggaaaacaaagaaagactgaagaatcatttcagatagaacacgtgggacaactacatgcaatccggggccaggaactgtgtttttgtttttggacaactgacacattttgaatgggactgtggatgaaatagtattggggtgttactgctagtgtcctgactttgatgttgtactgttgttctgaaagagagtgtccttgtttcttaggaagtgcacgctgaaatatttatgagtcaaaaccttgttttctctttgttttttgcactcagctgcagttctgtcagtttggtgcattgtattttatgtctttaattaaaattaaaataactcaaatgttatttaattagaagaaaaactaatgaattaaatgaaattaaaatttaattaaaattgggaaatagactaattagtgctgaagtgcagtttggtaaacagaatctttgcaatgatggagtctgctgtgggaagtgactaagggggtttcttggtggtgaaatgtgtggggacttctgctccatgggaaggggagagtctgtatttccaatgaaaattggagcctggattctcagcacaggggccagtcctggacttccccaccttcctgtgtcattcttatcagactcataacaggaggggctcctctcaaccttggtaaacagagatgaaagcaatgaaacttcacctgtcagggaggaggcagctagagaatggggacagtaagccctgtgtgtgaggattcaatgaggcaaaatatgtaaagtgtgtagtccagtacctgagatatagggacttaattatctcctagatgatgctagatcgtccatcttttttagaagatatagtatcaacagcactaatataacgatgatgatagatcgtccatcttttttagaagatgtagtatcaacagcaccaatataacgtgacattttgttaggattcctggctcaggagacaggaaagctga

SEQ ID NO: 110128 - DNA, 1084 bp, Homo sapiens
gaccaattttgttaatgttaaaggaattaaagttaccaaccatcatgatggtacttaaaatatgaatgaaggtacaagtgttttaaaaagaaaacaaaactcaaactggctcccctggaaaaggaacatcccttttccttttggtacgtgttcagcgtttctgtgaccacacaattaacgcctggctttataactgaaatcacttgggaattcttttaagattgttcaaatcttccatcactgacagttaccaaactctgtacctggatgtttatcacttaactattaatgactccagtaaagtcacaaataactgttgtatgaattgcacagaggcaacctcatctcttgatattggactagaatattcagaaagcaaatttgccctgacctggcattctgggaaccagaccatgaatacagacctgtggggaagcgacctgttttggaagaggagagaaagggcagggcatggcgtctctgcctcatcagagcagtacacgctttttgtttgtttgtttgtttgacatccatggagatcgggaaactgcaggtttaagagtacaatcaagacaccaataatccagataccacctgcctggataaggttaaaatgtcttagtttccataggaatgccaaagtttttcgttcatgcaggcgtgtaggaaattaaaccccaagaaaggccaagtcagatttcttaatccaccccaagtgatgacatttgaagtctgggtttatggttggaaagtgaccgggtaaaaatagcactgactgactcaacaaatacaccatctcgggctcccagagctgttgatgtgtgcggacgctggtaacagaccccagggcttggccgttcagaacctgccctcctgtgggaagggtagggctgccaggagaacttaggcttgcctgtggcatctcctgcccaggtgcccagctctttccatgcccagttcccgaagcgtgcggtccaggctcaccctgtgcctttgctggctgttaactcagagggaagcccgttggctgcttttgctgttgggtttggatggtctgtatcactttaggcagtagcaagttcat

SEQ ID NO: 110129 - DNA, 1050 bp, Homo sapiens
tataagatatacgatttacaaatatttttctcccagtctgtggcttattttcattttaatattgatttattttttatgcacaaaatttttaatgttgaagttcagtttatcaatttttttattgtatggatagggctttttgtgtcattatctaagaattctttgcctaacccaaggtcaggaatattttctcctgcaacatttgttttctagaagttttatagttttagctattacatttagatctatgatccattttgagttaatttttatgtatgatgtgagataaaggtccaaattcttttcttttattaatttttttgcatttgtatatctaattgactgtcctttacccgttgaattacaatagtgataagtaataataattaccttcacatttttgttgaaaatatattgactataaatgtgaggatttatttctgaattcccaattttattgcattgatctataagcctttcctgtgccagtatcacaccgtctggatttctgtggctttgtagttatttttaagatcaagtagtgtgaattttccaactttgttattatacaaaattgttttggcttttttaagtttttgcatttccatatacattttaggatcaattcatcaatttctaccaaaaagtctgctgggattttgatagtaatttacatatcagtctgggaggaattcccatcttgacggtgttgaggcttccaatgcatgaacatgaaatgtctctccacctatttagatcttctttagttttctcagcagtgttttgcagtttttagtatgcgagtcttgtactccttttattaagtttattcctaagtattttattattttaggaatggctttttttttttttttagacggagtctcgctctgtggcacaggctggagtgcagtggtgtgacctccgcccactgcatcctccacctcccgggttcaagcgattctcttgcctcagcctcccaagtagctgggattacaggcgcacaccaccactcctggctaacttttttgtatttttagtagagacagg

SEQ ID NO: 110130 - DNA, 1190 bp, Homo sapiens
ctgtgttgcccaggctggagtgcagtggcacgatctcggctgactgcaaccttcacctcctgggttcaagcgattctcctgcctcagcctcccgagtagctgatattacagtcgcctgccaccacatttggctaatttttgtatttttagtagagacagggttttatcatgttacccaggctggttttgaactcgtgaccttgggtaattcacccgcctcggcctcccacagtgctgggattccaggcatgagctaccgtgcccggccaggatagtgactttgataccatcaagctgagaacgtttatccccacaaagatccttcgtgctgccttttacagccacacccacctcctctgacccgtagcaaccactaatttcctccttcatttctgtatttcaagaatgtgtatcaatggaatcctaaagtatgtaaccttttgagataggccttttttctcaacataatcctcaagaggttcattccagttgttgcgtgtcagtaattcactttttaattgctgagtcgtatttcatcatgcgaatataccagtttgcttaaccatccatttaaggacagcttggttgtccccagtttgcggctagtatgcataaagctgcattttgttgtatggacataaatttttatttctctgatataaatgcctgaaagtacagtagctgggtcttttggtagttacttgtttcattttataaaaaattggcagacttttccagagtttggcgatttgccagagtttggcagacttttccagagtttggcaaaatcccaacagcaatgtttgagtgtttctcaagtcccttctaaaccagaggtcctctctccctccacctctattttctgacttcgcaactggggaggaaaatttgtgctctgatgatcttgcgtgattgggattatcttgcatgtgaaactgctttataaactgtccccagctgggtctattagtgcttcctttttgtgggtgtatctgaaaacagtgtcacagaatcttagcggagggctgtagacatttattcactgtctgcccctgcgtttcctagcctggctggattctgcagggctgctgggtcatgagggttgccacaggtcaagcgtgttaatgaagttcgtcttggcttctgcagcacattgcgggttgtgggtagtgagatacttgagttgcctg

SEQ ID NO: 110131 - DNA, 1052 bp, Homo sapiens
tccggctaattttttttttttttgtatttttagtagagatggggtttcaccatattggccaggctggtttcgaactcctgaccttacgtgatctgcccgctttggcctcccaaagtgctaggattacaggtgtgagccactgcacctggccatcattactgattctttatcttctttatattcccaacatgtagctttttaaacatttaggcaaagtaggagttatcctatatatcaaatcattctgagtctttttttatagatgaagatttgaagttgaatcttcatttcaacccccatgaaagaaattgtacaaatgaagctatgtcatgattttttcagttaatggctcacgtccccattttctgtgtaattatagtctttgaaaattttttgaatggttttattgagtagatgaacctccgttcactttctcatttccctgttctcagctagctagctgctttctatattttctagtattgtaaattatacgatggatatccacatgcatacagattattttctctcattaggattcttccctatgatagctcccaagggtagcattactgggccagaggtgacccttataaggccagggtgtgtcaacccccagccgcccagggttgtcgactcacacaggtgagcttctgtatagtttgaagcctactggtgtctgtacagttctaagcctgttagtgtctgacctctcacatgggccacctcaggcagccacttaagagcttcgagacagtggctgtccccactggacaggaaaggaaagggaggagctgagaggttaggccgcttctccgagttctccagcgatctgtgtcctccttgccctgggagttctcagtccggagcttatgcccattctgatgtccagatgtggacacccagcctcttacacatgcccagccctgtgaaacttacaggacttggcatccttgcctgtcttctgggccccatgtcgcagccccacagaggggacctggctgggatagggttgggctggtcaaacccatgagttttgccctgatcgcccc

SEQ ID NO: 110132 - DNA, 1052 bp, Homo sapiens
atgtgcttccagcaattcttttttatttttaggcggagttttgctcttgttgcccaggttggagtgcagtggtttagcaatctcggctcactgcaacctctgcctcctgggttcaagcgagtctcctgcctcagcctctcgagtagctgggattacaggcatgtgccaccacgcctggctagttttgtatttttagtagagacggagtttctccatgttggtcaggctggtctcaaactcctgacctcagatgatccgcccgcctcggcctcccaaagtgctgggattacaggcatgagccaccgcgcccggcagcaattcatttttacatgtgccccaaagccttttcctaagaaaacagttattaggagttactaaaatttgatagtcataaaataaaatgagcggtccttgagtttcctgtggcgtctggggtgtgtcctgccaggaagtctggcctggcacacttggcagcactggggagttcctaccgagatcatttggaattcctgcagtttttggaaggacactctgttttcagacatcattcgtgctgtcttgagtttgtcatgattcttaactgctgccttttttgcattcattgttttttaatcatagaaatgagtgttgttttgtgctttggttgatggttttgttgtcatgtaattgctgcattcttgttacattggctattctgtttctttcatagcattcgtttttctccaggaaagtgagagtggagtatgggtggagcctgaacccttggtctcacccaggagggctgggtcagaaaagcctgtgctcctctgagttcctcctggaggtcctgtctagtgtttgccccagaaatccaaattctttttctgtgtttaaagctctcctcccgccttcccttctgtagcatgagggtcatccttctgtacctaaactatttttaaaatgtgcttactttttttttgagacagagtctcactctcgcccaggctggagtgcagtggcacaacctcggctcactgcaacctctgcttcccgggttcaagcaattctcctgc

SEQ ID NO: 110133 - DNA, 1063 bp, Homo sapiens
tgctctgtgcgccggtttgtcttctgttttggtttctagcctgacacagcttttggatctcacccacttgtgactccctgcagtcgtctgtgttttgtggacaatgaaaggctttgctccacgtccactgatcggctgctccagaaggaagctttgcagcctcctcagctgcaggcccagagtcatggctccctccaacccattgcctggccctgctcagcccacttggatggagctgagtccccagcccgactgggtcctgctgggggctgagctcgtgggtgcgagccgtgtggggtagggaaccccgctgctgtctcccacctggctctgcactcctgcagccccagtcctgccgtgactgtcacagggatctccaggcctggtcggcggctccctgttgtgcgagcatggtactcggaaaccgccttttctgctggtttagtccgactgaagctccttgctgagggactgcattccctctgcaaacctatggccttatgggtctttctgatgctgctgttatcccctgctctgtccgcagtgctggtgaatttcccagcctggggcagttggggacagggtccgagtctgacttctttctctttcctgtgcagcgggtgtgggaatgggcgtgtgtctcttgaatgagtatggtgttggctacagatgggccgctttagatcctggctctacctcatctttctgggaggtggggggtagttgtttacattctctgaaccacctcctctctgtagcaggggcccagtcctatcacctgccccaaaacattggtgtgagggcgacgttaagtgactgaatgtgcacagcgcagctgtttgtgcttgacgcgtgctaggtggacccttaggcactgccctggccccgtgaaggccctgcaggtctgtgtcccacccttggtggctgtgcccagctttagcatgccacctcatggtcctgctcagtggctcacctgctcaccctgtgtcaggtcccagcctggcgcaggtggctgcccctgaatctgggccttgcgagcctgttgcctggatgcccaggttcc

SEQ ID NO: 110134 - DNA, 1099 bp, Homo sapiens
cagctaattttttttaactgttttgtagagatgggatctcaccttctttcccaggctggtctcaaactagtgatcctcctgccctagcttcccaaaatgttggactgcagttgtgagccaacacgcccggctgtgcatgtcttttatagcatgtattcattttttcatgtattcattcatagggtgttgttaagtgcatatcctgtgccagacactgttctaggtacttgtgaacagcagggaacagaacaagtttctgccttcatggagcttaaattctggggttgcagggaatgtataggagatggatttttaacaaataaatatggagtgagtcagattgtgatcaattctacagagagaaataaagcaggctgcagagatagcaagtgtgtggttgtcagtgtggggagttgttcgccgtggtgcacgggtggccagggatggctccacggataaggtgccatttgtgcagagcctgaaggaagtgagggagccacagccctctgggcgggactccgtccgaggcacctgcaagtgtgtgggcctcaggttggagtgtgctctgcatgtttgagcaagtaactatcctgttaacttgtttgtagtctctctgtctccctcctggaaggtaatctccagaaggcagagaccttacctaccttcatctattgaggtttacgggaaccccatagatgccatccttatttcttggcctgagttggaaatgatagagcgggcaagcagtctcttaacctgggacacaagaactggacagacttctggaggcacagacagctctggcagctgcttgcctccctgcagggatgggcaggttctgcatacatagatcctcctgccttaaggaggagttagtgtgcaaggaggagaggaggatggggcagggagcaacaggccggagtgtttgtccaggagagcatcctccatagagaagcacagaacaatgaagaaggggtgcttcctctttttcccgtcgacactatagtctcagcactgtttctggcacattctctgttctcaataaatatttatagttgactaataactatagtgattaaacccaggatatcctagaaga

SEQ ID NO: 110135 - DNA, 1145 bp, Homo sapiens
aaagactccaaatattctggagaacctggataaaagtttgaagggctagattgggatttgaagacaaaattgtaggaaatcttacatttttgcaataacaaacattaatgaaagcaaaacattataaaagtaattttaattcaccacatacttatcaatttcttgatgcttccaaatgacatctacagatatggttttgtggacatctttttctgtttacataaatttatccacttaaaatgtgataatgtggagacaaagcaagatttgattacataaacttttctctgcattggtcttttcactatcttatttgctaacttttcttatttttcttcaacctccccaccctccattttttggatattaaacagggaaagcttgctacattataaagattgttggcaccatttattttacacaaaggctaaaggttaacttttggaaatgatgagctacttttatatatgtgtttactcatgctttgtgatatttctggatcattccagtcataaagacttattacatgtactatttcttgctacctgtgaaaaggtatattttaaagaatgtataaccaacagtccatttactttttattagtatgtagaggatttgtatctaattcatgaatgtagttttacagtagtttgtcattgtaaatggagcaaagtacattatcttctaaaatgtacattatgtaagaattgtaaatatacttaagtaatttgtatgccaaaaaattacaataagtcaataaagatctcacctctggcttagttctttcatggtgatttacattttcttgtgaaatacactgtgaacatatctgtcaacagcagttatttttaaggtactattatttttaaggtatttcttcccagccctttcaaatccacattcatcctatttgctgattacttcaatcaagaaatccatttggatcttttaagtatataattctctttgttcacagagctgttatagcccctaattcattggcaaaaagataaaaggttttttttggggggtggggggaggggcttgctctaagttttttccattatgattgacattaatgttcctaatctatgcagcacattcccattttatccttttagtaaacagacacacacacgtttgtc

SEQ ID NO: 110136 - DNA, 1387 bp, Homo sapiens
ttttaaaaacttagagctgtccaggcacatagaaaagttaactgtctgaggggaaatagaatgtggttaagtttaaagaatatgcttagtattataaatgttgagtgatgagttgtttaccatttataataaactgttaaatgtatttctgggaacattccatggcagcatattctgggttgttgtttatgtgttccaatgtagacaaattatatttgccttgggaaaaattctaagtaatcaaaattatatttaaatattaaaaaatcacattgaagttcaatttgtgttagctgtattaaatatcttggtcactattgttcttgtaacatttgcttttgacaacacattttgagatctaagaaaggtagtacattaacagtgcattaattaatgttttgttagaaactaaatgttaacaaaaagttttgtgtgtatgtgaaggtggcaacttccttttgtattatattaacactttttaaatgtattcagtcagtgaaaccaatgattattatagcaccaacactttcattcaaggaagcatttgagtcttataatttgttttgcatggtacaatggttctactaaaatatacttgtgtaataggtactagatgatttaaaaacaaaaccggagaaaccatttaaaaagttccatagcttgttatacaaaatatgcattgctaatagtagaagccatatattgccattgtactgttgtaatacttaacagtgctcatctggtgctacctgtagactatttggtattaacgtctgctagacccttcttcctatttcttcttgaatgtataatgtgtgccttttaagttacttctagtgttgaatggtaaaatctttgtggtatttttgtattatactctgcactttacactttcttggaaaggaaaattccagactatccagtttaaatagtcttttaaaaatatttataatgtttacaataaatattttacatattttaattcaacatctgcaaattagaaaaaatattttatatggtttgttgctatttaatgttgctctatttattttctatcttttagaatggttaaaatgagaatagcaatgtttgtcttttgatgtggaagtgaacttttacaaaaccatgggtataattggattgtcttaccagctgttccaacgtatcaaccttttattttagtcatgtcaatatgagttagatgttactctcagccacctgttaataatctcttcttactgtttttttctttttaaagtagactgatgaggtttaattgattgattcaggtcgggaataaatttccagggctaaatgaaaactatatagagatgttaatagttgctttttacctagactaaatacaaaaagtgactagaaagtatta

SEQ ID NO: 110137 - DNA, 1032 bp, Homo sapiens
agccaggaattgtcaggcatctggaggaagcaagccactagaggtattgcggggatgctgctgcagtacagctaaaatgcagtcgtcagaagatttttgttgtcctttcttatgagaattgtatgaaggtgagatacttatctttgtacctcagattgctgggtttgataaactaaaagccagattattttaatggcaaataaaacacaattacattagtacatgtattacctgtttatagactttatttatgacatttatattatataatgtcatctaaaacactattttatttatttttaggttacgtttagcaagaatgaatgaagagatgcgggaatcagaaggactttatggacagccaggtcaatattctactaataaccatactgaaatgcagtataagaaatgcattcaggaatttatcagtttacaactggaagattcatagttctttagcaaactaatgtgatactatagagtttttataacccacttgtaaattgtgagttgttagctttgtactgtacttaactgaatccttgggtggctaatcccgggcctttaaacattcgtaactcttcctatgacagtacacattgacttgctctatttcactctggctgctgacttctttatttgctgtacggatgtcttccatatacattccagtgaaatgaatggaatggtaaaaatattcttcatatacttacagcagcaaaatagttgttttctttttggaattctttttagctgtcaagtgaatataacaaaattgttttctttttgttattcagggaatttctataaattacgttcagggaaaaaaaaaatcaccatgtgtctggcatataaaaagccagtatggaaaataccaagaaaaagtttactgatgagttttgtactacaatctaaaaatgagttgaagatttaaaatgaaaattcaccaggtggagaagtccatgatgtgagtggagctagtttgaaaggctgagggcaaaggtctcattttatctaaagctaaagctttgc

SEQ ID NO: 110138 - DNA, 1026 bp, Homo sapiens
cagtagcaatcaaatatttaaaaaaaatcataatatgttctgaactggctttagtattgtctttgcttcaagagatgggttagaaaatagaaggaacctctgtgctattaatagtagtggtttctgagcaccacttcggttgtttcaagtttttttgcagtggaagagaattccgataatgaaagtatataatgtgttttgctagttcacaaactgcaaatgaatctctattagaattagttcttgggaagaaaataatataatttataatttctctgccttggctgagggatattttttgttttggagagaaggaaatggaaatgctatttgagtaacgaaaaccaattgtttttaaaaagaaatgtattgttgtttcttgttatttgcttttgtctatagttatcctcttttttcctttaagggctctttggtgacgtgtgagttcctcctacagaatggtgctaatgtcaaccaaagagatgtccaagggcggggaccattgcaccatgccaccgtcttagggcacacagggtaactgcagtgctttcatatttaaggagactttatttgaaaaattattttgaattaatgttttagtttttcttaggttaaagttttcaggtagtgtttgtaaagagatgtgttccatgacttattttgtcacgatggaatttgaaagttaaaaaaaatctctttcagaaaaagctactattggttttcagatacaaaaatttcaaggcttactttgaccttaacttgtcattaaatagatcagttttagtacttaactttctctgttattaaaattgtgattttgtcagacaacttaagcctgtgtttgtgtttatgtatgtatgtacatatacattatttccatagcatgcacacacataacctatttaaagataatttgatgactttgtaatttttagttttttccacagggtagctaaagtcaaattctaaactaaattcttactttgggttgttgacattgtgtcttctggagcgatagtaagattc

SEQ ID NO: 110139 - DNA, 2332 bp, Homo sapiens
ttcacagtccatgagctgtttttaagtcttacttttccttttcttagaaatgttagtaacaactagggccgggcgtggtggctcacgcctgtagtcccagcactttgggaggccaaggtgggtggatcgcttgagaccaggagttagagaccagcctggccaacatggtaaaacctcgtctctactaaaaatacaaaaattagcagggtgtggtggcgtgtgtctgtaaccccagccacttgggaggttaaggtaccaggatcgcttgaacccaggaagtggaagtttcagtgagccaagatcgcacccctgcactccagcttgggtgacagagtgagactctgcttcaaaaaaaaaaacaaaaaaaaaacaaaaaaaccacaatgaaatgttaataacaactaggattattctatagaaataattaaaaattatattcccttttacttaactgattaaagttttggtcaatgttactagtttttttaatttataatagcaatggaggagtgatagtgttgtaagacacacaaatcttagtataataattgaaaaaatgttttctacctaggatatatgacgtttttccttaagagatgtaaaattaagagtttatattttctttcctcagtttataaaaatcgatgttatgaaaacgtcattcagaagcagatcgatggcagaggaactgggtttcagaaatacatatgatccttaggttaataatcagagggttagctctttgacaacaacataagttttaatactatttttagaagatattgtcctaagatgcagctggtcaagagaagttaattttttgaagacctcagaagcgtgaaaagtttacataatttgttgttcagtaaaactcttcgtagctttcatcaaattacagaatttactatgatataaaacaaatgattttgtatgactacagttcaccctacttcaaatgatttttacacaaacgctttcatcagtatcagagattgtttccattgcatgtcatcccatgtggcagggttgcaccattttgtttgtttgtaggtatttccttaacatttctaaccaactatctgtcccaaagtaaagaaacccagaagttcttccttttctagcctacctcttgatgatttgcatttagaggcaacccagctcattttatctagatgcttatttaacaaatgtcttttttaatggtaaaggcgattcctctttaagtgacaagaaaacctaagtctgtctagtaaatggcttaaaagtggaaaagcatcttctagtcatgacatgagaacagctttggataattaacttaatttttaaaaatagaaattctaaatacaatttctaatgcttcatattagtatcaatgaaaaggtagaatatctgctaattgattaataactaatgttacaatagaaatcatctcacatgaaactaattttaaaataatgattcaaatactgttttacctttcatgcttgataagaagttttgctttcttttctgaatggcttttggctgtgaattttttttatgcctttaggtcttttattgttttaataaattagaattagtaaatatgtaatacatagcatagatttttcttctaaaaaagatcgtaagtaaattgtttgtctaataatttacagtaatgagcagaaccatataaatagttgagtgaatcatttgtagtaataactttgattattttacttaggagtattttatatgaaagtaaggccaagctaatttgtgattgtctcttgttagatgtcggttctgacatgattagttttctgttttgcttatcaaatcaaactcttactgaattatctgctgaaaagttgaaaataaagcacaatttatttcaatgtttttctgtatacaagtggatactttttttttttttttgagacggagtcttgctcggtcgcccaggctgaagtgcaatggcgtgatctcggctcactgcaacctctgcctcccgggttcaagtggttctcctgcctcagcctcctgagtagctgggattacaggcacctgctgccatgcccagctaatttttgtatattttattagaggctaggtttcaccatgttggtcaggctggtctcgaactcctgacgacctcaggtgatccactcactttggcctcccgaagtgctgggattacaggcgtgagccaccgtgcctggccacaagtggatacttttattcacgatatacatttatgccaactttatgagaaaagcaattatttcttgggaaagagttcagttatttttgaggaacctcaaaagctgtaaatttgtactttaaaacagtt

SEQ ID NO: 110140 - DNA, 1370 bp, Homo sapiens
gtaatgtagtatttgaagaactttttgaatattcctgaaattttcagagtcttaagagttggaattaattgtacaaatgcatatgtgtataaaaagttaataaaatgcaacagatacttttgattattttgttaggttcagagcttaagcttgtttcttaattcttgctttattttcgtatcatgctagtcctttgcttattttgcacatttttcgttttcattcttttaccacctttcccttatgttttaatcctgccccgttttttcacacgacaggaaaaagcccgatcacatcaggtaccaaatggcttccttccctttaccctcatcttactccagtttcctttttggcacgagaaagctcataattaacttgcattccagttggattacttgcaatggatgaaaagtctctttatgttttaaattgggaagaaaatataactattttatttgagaaatggaattataccttttagttgcacatctcctcaatttgttttaatctgtaaaggaatctttgatttatttataattacccaaagaagatacagattgagtaatttacttttttttttaaacatatcttatttttttgaaaagagaaataaaggctggatgtggtggcatgcctctgtggtcccagctactccagaggctgaggtgggaggatcacttgagcccaggatttccagactgcagtgagctgtgattgcaccacgacactccaggctgagtgacagagtgaggccctgtctctaaaaaaaattacatatatgtctaaacaaataaaaatatagagggaaataagctagtaaactctttttaaaaatttgagcagtaactaggattagtccttttggtaaaaccatattgattatgttgaaagaatacattgtcagttcgttacctttttttgttttgccatttattttctctgtataaaaataaattgaagtaaaggagcattcatgttcaggcttttaatttttaccagttgtttacctatttggcacttacatgaatgtgtaaataaacccatcatctgtatagttctagtgataacgtttctacagatttagaagtttgacttttactcatgttcttgattacaagagcagtctgggactagtgatcaaacatggtaaaagataactcgaattttttgtttatgtattttttcttttcctgcccaaattttgtcatttggaagctctaattagtatgttaatattaataatatttaataatttataaatttaatatttacaacaaatatattttaaagtataatatttagaatttaataaaatgtgtattatattgagttatttcaatttgagatacaaagtgataccttatttttct

SEQ ID NO: 110141 - DNA, 1055 bp, Homo sapiens
tagaagttggaaaaaaaaaaaaacaaaaaaaacccagcttgactggtgagtctttataataaaggttactcaccagtatgttttcatgatataatggcagaattgaattttagccttcagatttcaaagcaacctacttaaagtttaacaaagtgaaaatacagtaaatccatagaaacataccattatgttaagaagaaaagaaatgaacttccatggactactacaatgagagatggtctcagacttcaaaatgaagcatagtaagtgttagtagaatattgcactgccatttaggacaatagaaggaagtcgattttgatttatacatgaaccttttcattatgattaattttctgaattacattggcatagatattaaaatgcagctaaaatcaagtaaggaataatggttaaattttcagttgtagacattacctcctatttacaaagtgaaaaaaacaatgcctttggaaattaggctgtttttaaaggagatgccatctatgtgtagtgaaatggcagttattgactagaatcatagattgtagagccccttattttcagtaaagaaatggagcttcagagacatagtcactttttcaagatcacacagctggtttgtgaacaaattgaggggcaaaacctggaactctgaactcttcctcaagtatcctatggcatttttcttacttgctgtgaaaattccaaaccatctttattttgatagaacaagatacaacttcaactatgaaaaaatacttcattttaaaagaacttcctgaagcacttacgttattaggaaaaattatggatagcaaattaatatcattttcacatgctattgaagaacgtttgccaaaaacactagtaaaattctgacttgtaaaagaatatagcatataaggccagtcattgtggctcatgcctctaatcccagcagtttgggaggccaaggcaggcagattgcctgagcccaggaattggagaccagcttgggcaacatggtgaaaccccatctctacaaaaaacaaatataaaaattagtcaggtgt

SEQ ID NO: 110142 - DNA, 1147 bp, Homo sapiens
aggatcttggtgcacaggtaatgttgcagtatatttcttgattctgttttatacattggtatttgtatttttaaagaaatttagcatattggaggtgtactagtttgttctcacactgctataaagagctgcctgagactgggtaatctagaaaggaaagaggtttaattgactcacagttctgcatggctggggaggcctcaggaaacttacaatgatggcagaaggcaaagggaaagcaaggcatctttttcacaaggcagcagaggggagaatgaacgcaggagaaactaccaaacacttataaaaccatcagatctcgtgagagctcactcactatcacgagtaccagcatgggggaaaccgcccccatgactcagttccctccaccttgtctctcttgacacgtgaggattatggggattataattcaagatgagattttgggtggggacacagccaaatcatatcaaggaggacttgatgttttatttacttaatgaagaatgaagttggatgctatagcagatttatatatgggttaaatactcaaatgtttgcgttttgggtatacccaaaaaatgaaatcaaaggtaaaaagaaccttatgttatagtttgcatgtgaaggtattgaaaaggagaatttaaaaacaaagtgtttgttttgcagtctacataactggacttatatttaaattttatacatttggataattgagttattgttccaatttgcttttcagttgagttatagctcttttttatttcctgaaaacttgtatcttgttatttgaataaaaaaattttagaatcttaaaattatagagctcttgggaactttttcatttcatgcagtcacatgtggcctatctatggctatgtgtaatagtattttttttttttttttttgaggtggagtcttgctctgtcacccaggctggagtgcagtggcgggatctcggctcactgcaagctccacctcccaggttcttgccattctcctgcctcagcctcctgagtagctgggactacaggtgcccgccaccatgcccggctgattttttgtatttttagtagagatggggtttcaccgtgttagccaggttggtctcgatctcctgacctcgtgatctgcccgcctcagc

SEQ ID NO: 110143 - DNA, 1044 bp, Homo sapiens
cactctaatatcggttaaataaccagtttttcttttagctcagaaatgtacgagaatttcactggaatgtttgtcttaactgtgttttgcaaaaggatagttgaaggatgaaaaagcttgagctttgtttttatttgctttttcgaaaagtattaaaccattaaaataagctttacaatattgcattatggattagctttaaaataatgcatgggtgattaaccacgtgtgttttccctcagattaatgttcttcaatcaaaaaggagatcagaaatcctaaaatcagtaagacattaattgaaatgatgttttaaatattttaatatgaaactaaatgtacgtatttaggtgttgaaagagcatctgctatatacatgataaggtttataattgctcttctttttgatcttcatttgtgtttcttatgtggcactggacttctttttgtctccttcatgttacagttgtttgtgtgtctcatctgttgatacactgtgaggtccataaaggtagactctatactgttatgtttttgttttcttttatcctcatatgttgctttacatgcactagatgcccagtaccatttggtgaataactaaaaatgtttggtataaaaacctgtgagaatatttcagaatttgttttgaaagttatcaacataaaaaactgttacacttaggtttttaattttttcttacttgttttgctttaaaatttttttcccagcctctttcaacatatttacatttttctctataatttttggcattatttggacttcaaaaatatttgagattgaggatttatatgaatagtatcatttggagaatttttcccttaaagttgatggtgggtcagtcttttggtttgttcttccgtatgcagttacaaaaccagtgggatgaaatttggggatcacttttttccttgagcctcttcacccacttgacaatgaatttttttttttttttgcggtggggagccctatttttggtcttaaagctaacgaaggccgggtgtggtggctcatgcctgtaat

SEQ ID NO: 110144 - DNA, 1880 bp, Homo sapiens
acctttgctgcagccctaagtcttactgtttcttgtctggagtattaaagtcttctcatgaaattggtctgccttgcattgcttttacctgccctgtcactaattcactctctgttttgtgatccgggttactcagacttctccaggccagaaggaataatttttgcctctgccttctctgtgttgccgtatttttgtacacattgcagttagactacttacgcatttattgtaaatatttatttatatattttttctatttctagattgtatccctagcctctagtccagtggttagaaaatagatatgtagtaaatgttttttgagagagtgaacggcttaatgttacaaattttatactgggaggattagctaaaattttcattatttttaaacttacacattattttcttggatgtccatatgtaagttaggaatcctcacactgcctcctcatgcccaccacccccaacaaataactattagtttgtttgatttttctgatgggaattattgtatcattttatggcctttatttcatttatgtctactttagagagtagtaagtaatagatatccaaatgtataaagtttgtcttgcttttaactactctaaatatttgagtttacttttttcctccaataatttaaatgctatataatttaaatattatataatataaaaatcctattttatatagcattttatttttatatataacatttaaatttaaaaattttatatagcacttaattttttcaaatagaaaaaaagacatatcaaacaggcattttaacattattcagtgtttgagtagtaggctatttgcagcttcttctttacttagagcatttgaaagtgaatattgtagttctctaaactgaataggctttgaaatacatgcagaagaaactagtcttttgtttctgtttttgtttttttgagaaggagtcttgctgtgtcgcccaggctggagtgcagtggtgcgatcccagctcactgcaacctccgcctccagggtttaagtgattctcctgcctcagcctgccgagtagctgggattacaggcgcccaccaccatgcctggctaatttttgtatttttagtagagatggggtttcaccatgttggccaggctgatctcaaactcctaatctcaagcgatctgcccacctcagcctcccaaagtgcaaggattacaggcgtgagccacctcacccagccagaaactagtcttatggttaagtaaagttacttagatttttcttgttctgtttttttttttaatttagtgctttaaaattatttgataaaatacagaattcagtgggaaggacatattaaaaagatattgtataatcttttgacagtattggcaaagagtgaatgattctttttttaaacatttcattaagctgatagataataacagacaaaaataaaatgtttgttgtgaatttctggagttgggagagatcctctaaaaggcaaatcttttaatttattgatctttcagtaaatttagtctaattaaaacatttacttaaaatctggccgggtgcaggggctcattcctgtaatcccagtgctttgggaggccaaggcaggaggattgcttgaagcgaggagtttgagaccagactgtgcaacacagtgagaacctgtctctacaaaaagtaaaaaaagttagccaggtctggtggtgtgcacctgtagtcccagctacccagctactcgggaagctgagatgggagcattgctgggggctaaggcaggaggattgtgtgcccaggagttcgaggctgcagtgagatctgatcatgccactgcactccggccagggtgggcaacagagtgagactctgtctctaaaaacaa

SEQ ID NO: 110145 - DNA, 1047 bp, Homo sapiens
agaaagatgaaagaaagagaagagcccggtactaaggcttagacaatgcctggaacaataggtattagagacattttttttttttgaatacatggttgattaatcactttagctatctgcgttgatagactaatattgaaatgatcactaagctatcatacagtttacttacctttcctccaaaatacttttgttgttgttatcacacagcctctggatcctaaatggtcaacttttctggtacaactctgctacgaatttactttataagctgaaggaaaaaagaatacttttcaattagtctgttttgagtttatcgatgaaacaaattgaacttaactaggtcacctcatatagttactgccaacacttgttcaactaagtaatttgtaaaactatcttcaacctgatgaattttttttttctttttcagcttgtgaaactttgtattgcaatgattgatactggaaaagccttttgtgttgcaaataaacagttcatgaatgggattcgagacctggctcagtattctagtaatgatgctgtcgttgaggttagtattactaaaattgcagttaaaaatgaaaaaaaaaagcaataagacattaaagaattgtgcattcatctacctgatttatagttatggtgatacttaaaattagaagtagaaaagtggtcaccccttggtgctctcttgtatgattctgttttctaagagaaggtgatggttgatttgcattgcgcattatctagcatggctcttctcacctagtttctcattgttgtggttagtttattaagtttacttgctgctaggtgagctgaagcacctgtcagagggcctgagcaggaagatcaagatcatgcctactagtagctgcttataggggcacgcagagagcattaacctaagtacagcgtcttaactgtatgtatagggggctgtataggttctgattagccagcttatgctcggttagcttagattccttggtatactatgtggtgttatatttctttcatgagaaataataactggtgaagaaa

SEQ ID NO: 110146 - DNA, 1075 bp, Homo sapiens
ctcaggactttgctttagcatctctctcctttcccttctctgccacctctatcttaagtagataaagatttttttttttttttttactaagtttgtttcttagtaaaacaaaacaaaagcaaacaacaataggaaaacctctccctctgacaaggaagcacaaatctctattgaataattaccatgtgccagtaagtttgtgctaagaatcttttttttttttttttgaatacagagatagggttgttgaccaggctggtctcaaatgcctggcctcaagagttcctcccatcttggcctcccaaagtattgggcttacaggcatgagccacgcctgtgctaagaatctttatgtgcattcccttagtctttttttttagtaaccatatatggtttggtaccattgttatgtgtgatacagaagaagaaatggaagtttgttgaggttaagttcactcagtctcacttagatgtttaagtatgacagtaggttgaacctaagcagacttagctgagaaccctatattttttgccgtaatattttactattaacctgtctctctttgtttttatggaaacttttaattatttttgaatttaatttgttgcataataccacctatgtagtacacaatttgaaggtaaaaaagtgtgtacccagtgaaaatcagtcattttctaatctctttcctagaggaatgcactgaactagtttctcttgcgcccttgtgcaattttcttttttttttgagacagcctcgctctgtcactgaggctggagtacagtggcatgatctcagctcactgcaacctctgcttcccgggttcaggcaattctcctgcctcagcctcctgactagctgggactacaggtgcgcaccaccatgcctggctaatttttgtatttttagtagaggtggggttttgccacattggccaggctggtcttgaactcctgacctcaagtgatctgcccaacttggcctcccaaagttttgggattacaggcgtgagccaccatgcctggccttttcacaaaattttctaagtatataaaagtatttgtactcttcag

SEQ ID NO: 110147 - DNA, 1109 bp, Homo sapiens
gggatacatgtacagaatgtgcaggtttgtaacacaggtatacatgtgccatggtggtttgctgcacccatcaacgcatcatctaggttttaagtcccacatgcatttgtcctaatgctctccctccccttgccccgcacctgacaggctccgctgtgtaatgttcccctccctgtgtccatgttttctcattgttcaactcctacttatgagtgagaacacgcggtgtttggttttctgttcctgtgttagtttgctgagaatgatggtttccagcttcatccatgtctctgcaaaggacatgaacccattcttttttatggctgctcagataatttttaaatacacttcaatgtattcctcttttttgtaattaaaaaaagttgagataaaattaacctaacataaaatccagtatttcaaagtgagtaattcatggtttttagtatagtcccagtgttgtacaactatcaccactatctaattccaaaatatttttcaccccaaaaagaaaccctgtatctattagcagtcactcccaattctcctctccctctgtcttctggcaacctaatctactttctgtccctggatttgcctattctgaacatttcaaataaatggaataatacaatatttggtcttatgtgactagctcctttctcttagcatgtttttaagagtcatccatgttgtagcatgtatcagtcctttgtttttatagctggataatgcatcattgcatggatgtacctcattttgtttatccattcatcagttgatggacatttgagttgtttcccttttgtggctgttgtaaataatgctgctatgatccctttcagagtactcttaatgttattacatcattatttctcttcagagactttcatgtcccttccataatagctactctgcagaattctccactattttaagtctgaccatctatattatttgtcccgtatctggcctataaaaccctacaggggaagttacacaactgtttggtgaaaccaactgatggtgctacacattcctggaattcttgatataaagcagtttcctccagacccagtcaggtgcctttcttgttaccgttagtggct

SEQ ID NO: 110148 - DNA, 1028 bp, Homo sapiens
cggagggaagcgcggccgcagccacgtgacttccttcccaaggaacctcagctgccggcctcccagcaaccggtgcgtcccgcctagcgacgcccgcgcatcccggttggccctcgggggcggttgtggcaaggaggtgcccacggtcgcgctgctcattggctcgggttgccgtcgctcagacccgttgcccgggcgcccgcaggcggtgctgccggatgccccgccccttggccgccaggttcgtggctggctggccgctgctgtcactccccggccgtttccctgcggccagcgctctacttggggcgggaggaagaggggcgggactggggcctgactagtcgtcgccgtcttcgcggctgctatgaccagcgggcgaggcgcccttcgcagctccgcgcaacgctagtcgcggccgtgcgcccgccgtagccgtctgcgtcccagcgcggccgctcccgcggccccctcggctttgccagcgccgcctgcgaggcggaggcaggatgaagatgactgtggatttcgaggagtgtctgaaggactcgccccgcttcaggtaaccggcacggccgcccggcgtcaccgcggagctgccttcccggcgctgggggcgtgaaagccgggcccgcgcacccggaggaggccccgccgtccgctccttccgacggggcgagcggctgttgccgccgtttcccaccctgcgagggcactgcagtccccaccgagccctcccgaggggcgacgaagtggcggggacggggacgtcgcctctcatttctttccttgccctctgccggggcggagcgccccgaaggccggcgcaccctctcccgctgggggaaatggggtgcagccgcgctcccgaagtcccgtccccttcgcgggcgctcgctctcgcccccttcctcctctggctgctcttccttcccccttccttccgccccttcttggtttccaccccctccccaccccctctttgagggagctttcagggcatcctcttgcagttcatttagttcctc

SEQ ID NO: 110149 - DNA, 1051 bp, Homo sapiens
cttccacttgcaggtttatggaaacagcagtatttgaaaataaataaaaagtgggagaattccttgctgttagaagaatgtggccattattttgattttttgaatgagatatataatcaaagtactgctgaactgtgagtgcagtattctaaacatttcagctaggaataccactgatttagaaacaaaactgtttgtctctggtttctgaatttaaaatgttgggattacctgtttaaatctgtcttgggggatgtagagattaagtctgtacatgtgcgtgcacatatattcatgcaccctctgattttggttttcttgtttctgagttcttagaaagtacccacatactcttttttttttttttgtagaagtagctgtcatagagtgaagaaaaggataagactttaaacagttgattctttttgtgttttctacaaactattttttgaaatttaaatcacaaactcattttctggtttttagaaagtagatgatgatttcagaggagtaaggcatgccaagcagcatgctcagtggggttttaggctgtcacatgcagctgagaaaaggtatgttcaagtcataagtaggtaattgatagggtatgaactagtcaaaatatgaaccattatgattcaagttagattttcctctggagagacagatctgaatgttcagttctagccaaggtagattttactttcaactttttaatcagtatcactttctgtgcttaactatttggtgttaccttgtctgttttcatttgtctaaaattctgcagagatgactaaaatttgacataatggtgtaaatggattgttaaggtaactttcagttgaagattaaagcaagatgccattttccccatgactttggttttgtttacatttttccctttcagttagtatacactacacgtactgtaataaaatacaataatatgacaattgcctgtgtgtggattttattttattgttacttagctatctcaagaccataatccatcgaccacttgccctggataccaggagtggatcatggatta

SEQ ID NO: 110150 - DNA, 1300 bp, Homo sapiens
cagtactttttgttattccgtaatatgcttcaaccttttagtctatttcatatagcctttcatttccattatatatcccatagtctgtttaacttatatttaacttgagcaaacttcatcttacatagtagctgtggcatgtttttattatccatttttatttttattttgttttttgttatagaggcagcgttttttgtttgtttgttttaacgccatttcttttgaaaaataactatggcattttgtccgtctctgcttataagatattacatttcacatatttagtacataaatatattttttgtttaagtttaatggaggattaaaattttgtattaggtcagtgcctgatttttcttcactggagatgaagtacaccttgcaaaggagtatatcctgcttagcattataaaacccacaagaataggataagacttagggaaataagtaccttatttaccccctaccctttttgggcccttaacattttaccagcttttcagatctctaagttctatagaacccattagttttgggacagtgccagtctcctcccttccccctttcctcccccattcacacaattcattggagaaaatgacatgtttggactcttaggtgatattttatagctttcaggtaataaatatgtatctttttatagctctggatattggagttgtcgtaaactcttacctttccacctgtgacttacagaaatgttcaatctgaaacctgtttgttttatcagcaagtagacacttctgttctttagactatttaggggagtgtatagattcttcaatttcagtctaaatcagcctacatgaaatataccttatttgtttttaaaatttttatatttgcttgtcatgcatgctaatagaagggaactttagccagggttgacaacatataacaaattatgttgactttttcttttatctttgcaggatctactccaagtgaccaacagcaaaacaaattacgaagttcatagacgagatttgttcaacactgcaattgtttgttagatgtaaaccctgtgactatagtacgttgcttcttgttcttcacaattcatgacttaagtaccaaaatgcataccagttattatatattgccaagaattaaatgataaacttagagactgattagactgaaaatgcctaatcgatatatatattcttgtgcctagtactttaccacaaatacagtgtaatatcatcagtccaaaactgcattacttttgtaaaaacactggttaatttgtataagatattatagagctttttat

SEQ ID NO: 110151 - DNA, 1038 bp, Homo sapiens
gcacattgcactccagcctgggcaattagagtgaaactccatcttgaaaaaaagaaaaaataaaacaacggtgaataattttaatgctgttcattggtaaaatagctggcaattttatattggcccccccttttctgttgtttttttttttttaattttctgatctaaggaagttaaaaaccttaaaattatgtattcataaatagttgctctagtgtgatcagttgtgttgctgccagctttatgtttctatggtgaagactaaaatgaaatattttggagtcacttcaccattactttataatacgtttttcttaaaattactctgaaaatgaggttacgtttttagccaacaatgtcttaaatcatggcagtttcttaacaggtaagaattgttttaaaggattttttcttaattataaaaatagaaaataataaaatattaaaactacttcattgttccttgactcagaattaaacactgttaattgctgagtcttatttttctctctgtgtgtgtatgtgacaggcattgtacatagtaaatatagtatatggtgttgtaacttgctcttttgtcaccatttaactctttctggataattttcccatagctttaatctttcttcacaaatataatttctaatggctggatatattcttgttcttccattgagatgaatgccagatagtaaatattttaaattttgcagggcccagtggtctctattacgaactactcaactctgccattgaacacaaaagcagccttaagcatgacaaaaacaaatgagcatcactgtttcaataaaattttatttataaaacaggcatgggccaatccttgagctcaaacttcctaagtttacattttgcatcttatagaaaaaaagcgacaatttgaaatgaaaaggaagcttcactacaatgaaggactcaatatcaaactagccagacaattaatttcaaaagacctacatgatgatgatgaagatgaagaaatgttagagactgcagatggagaaagcatgaatacgg

SEQ ID NO: 110152 - DNA, 1050 bp, Homo sapiens
acagggccttgttctatcactcaggctggagtgcagaggcgcaatcaaagctcattgcaacctcaaactcctgggtttaactagtgctcccacctcggccttccaaatagctaggaccacaggcgtgtaccaccatgcccggcacgtttctgctctcttgccttttattttcctcatcaggttatagctagcacattaatgatcttcagatgtttttgtaagaatcaacagttgaataaggcgcttaaataatatcaaaacatcactgttaatttctttgtacatgattgttgcatagattagctgcagctgaaggcttggagccaaagtatcggattcaggaacaagaaagcagtggagaggaggatagtgacctctcacctgaagaacgaggtagtttatttcctttactgctttcatcatggtgctagtaatttttgctaagataaatccattatttggaagatgagcaaatggttttcattttggggacacacaggggaggagaatgaaagcaacatctttataattcagatactacttgtgtgttttgttgtgtaatagttttttacccctgatttcaagaatatggggaagtattaccatctttaaagtaattataagtattattttctttgtactttttagtgcagagtagatactcagtaaatactttttaaattaatgcatttcaagtcattgagcgtttggacggtcttaaagtgggtagctgaaagagctaatttcccagttgcttatgctttttgtgttgttggacagtgatgcaacttaacaaatgaaccaagatgatcagatgcagagtgaaggtctttattaggtcccatcaatcaaaaggagcagtagtgtcacaggaagggagatggagacagccctccccttcacagggatggaagagggtctcgtaggccattcagcacatacacatttaaggcattgctgcctgctcgtgctttctgtttccacaagtaaaagtggttacccgtggaggctgggagaaaaggagtatgtcttatcttgttgcattttata

SEQ ID NO: 110153 - DNA, 1084 bp, Homo sapiens
atgtatagattttgacttgcattattttataggccaaatgaaggctaagcatgtcatagtatggtaatgttttgaatgcctgatatagatactaaatattgtgtttttaatatgtgggcactaggtgttctatatttactgacattttattgtagttacttaatggtttttaccctgagtcagcttctattccaagaaagtatatgtgaaaatagaggttggccatcaaatagaagttgaaatgttaaatttggacatttgtgaattttgatattcaggtttatctttttctgcattgggaaaaacgttttttctttttaattttagcaaaaaatcccagaagtgggatgaaatgaacatcttggcgacgtatcatccagcagacaaagactatggtttaatgaaaatagatgaaccaagcactccttaccataggtaatgttacgtagacgtcattcctcttgtgacttacttccattttgcatttcatatgaacgtctggataacagcctatttgaatttgttttattgtagatttgttactggagcactagtgaagtcagtaacctaactgcaatttgtttagtaatggtttaagtgatgtgtaagtttaaaattaagaaagccattttgtacattataatggtagtagtaaatgtttatttgttgcacctcagtggttgctagctactaatggtgcatatattagttttaacttccatgaaaggaagatgagatatgggcttgtttgcttcccaagtagaaatctggggtttactcagtctctttgcagagaagcataactgcatggatggtaacccactgaaagataggtgtcattattactgtttatgtcttcattttttaacttaatgtaatattgttgttcagatcattacatgtaatttttgacaatttcaagtctcagaatttcctaaatgaattgtgaaattacattacgcagcagtaaccagtatgaagacaaaaataatgcaagaagcattatgagaagatgaggattctaaataagtatagatacctaattaagataataccttgggccgggcactgtggctcacgcctg

SEQ ID NO: 110154 - DNA, 1048 bp, Homo sapiens
aaaaagtttgttttctaaaagttactttttgcttacttgtaattgcttttattgttaagtcttactttaattgttcagtaacgatatcaggcttcgaagtcttatattgtgtcaatctatataagttgaatcttcatttaaagaaagaaccatttcttgaaatgtgcaattaaagttaaatcaccttgaagcaaaatcttgcttcccattccagacacagtcacaacttatcaaatgagcaagtcacaagcaacaagaagttccagtaggtcttcttaaggtggcaccatatgagctaacaaagtaaaagtgagaagcggtgacgttttcagcaccagatttaggctgtaggaaaaccagtcacccaagagggtgggggaaaactgaaaccagcaggtgctttcaccatcatggcagatctgccatgtaaatggtggtgcccctatttttgtctgcagggatactgacctcaaaggaggtcatacagttcatgatggtactgggattaagctcaggctcactccttgggttttgctattccacaactaatgttaattctgccatcactttagagatgccgactttcatatccagtgtcccctgctgacagtttcttctacttcactaactttcgaagatttcctagcatttttggagtctgttttgtaatacccttatttaaatgcttgtttttgcaagctattgttgtctttttttggatctgaataattgtactaatttttttttctgttagtgttctgttgagaaaacaagttgagtgagactttgaatatttagaacttaaaatttcatttacagaagaaagtaaactaaatggcaaacaaactgggaaaaattgaagttatataaaatgtggtttatataaatctaaagagctcaaatttatgggaagatttctgataggcaaaggatgtaaacataattcacatgaggaaattaggcaaagaaacaacagttttaaaatactgttttatacctgctgaaatggaaacacacacacacacacacacacacacacacacacaca

SEQ ID NO: 110155 - DNA, 1083 bp, Homo sapiens
tgtctagcaactcccacgctcatggatgcttgaatcttacattctctcacacacaattttccaacttctttgggctaagccacgttaaatggagtgctgggggagtgtgatgtgtaggtcatggaattaagaagacagaatttcaccagaacataactgaagcaggagaaccaagttagttaaaagataaataacatccaggcgtggtggctcaagcctgtaatctcagcacttggagaggccaaggtgggaggattgcttgatcccaggagtttgagaccagcctgggcaacataatgagacctcatctcttaaaaaaaaaaaaaaaaaaaaaaggaaagaaaagaaaaggaattaaaagataagtaacgtaactacagaaggctcaaatgtagcttcagggttttcagcagcaggaatgtggtccttactggcatttatgttatttagctgttctccagtgtgagtttcttttggtccatttaccaagtgagttactctttatctctgcttctttagtttctgtttattcttaacttggatctgctgtaatttcccgtgggcccaatctatggattggcctctttctttctgtaattggttgggatttacattcaggtctttctgcctcaaaagccactatactagactgactcaactgcatagggctgcctcttctgtagtatctgtggcagggtagattcacttaaaagggactgacctgtcgagttagagttacagtcctgtctttaaagagaactatcaaaccctaattcattgaagttcatgatgtttggttccaagtggtaaaaaggatgggttttttaatgatccttgttatgtgactgtaaagcaaataaactaattctactagtaatacaatatagtcttagtctgttttctgttggtcataacagaatgtctgaaatgataatttataagaaactgaatttatttcttatggttctggaggcttggaagtccagggtcttaagggtgcatctggtgagagcgtttttgctggtggggactctgtggagttccaaggtggtgcagggcatcacatggcaaggaagctgagcg

SEQ ID NO: 110156 - DNA, 1084 bp, Homo sapiens
aggcagttcggctgtttacacgggcgaaatggaaagaggagatacccgttttcttcaagtcagctaacctctctgcggagtgacgtcacctcgagtctcagtctgctgatctaaaaaataaaaataacactacggcctcacaaggtggtgggacgagggtgctcgagagacgcgcgggtccgggaagcagcaagcccgggcgctctcccgcaggttctcagagacagctcccgcctcccagcgccgcgcgggggcggggcgagcagcccgggcgggacggagggggcggggcgaggaggtcggctttgttctcgccccgccctctccccgcctcctccctagatatcgcgagagggcgggtccgcttggcttcggcgtcgcgtcgctcctgcgctggagctctaggccggcgtctctccgcgagccgcgggtcaagtggcagtggctaagggtgcgcgagtagccgccacccgttcggcgttggctctggcgtcggggtcgttgtgtcgtgacaaccgctgcggtagccgtttccgaggcagcagttgcggccgctttagccctgagcgggatctgcggctgcctgcgagtctctgctgtgccgacccttctcttcgcggaccccacgccaagcagcgaccctgagccgacagccggagcgcccggcaatggcggcctcgacggcctcgcaccggcccatcaaggggatcttgaagaacaagacctctacgacttcctctatggtggcgtcggccgaacagccccgcgggaatgtcgacgaggagctgaggtgagcgctgggagggacggcctgggagcccctccttcccgccgggcccgttacctacccagaccccaggggcgggcgggcggcgtggatgcggctcgggtgccgctcgagtctcttctcctgcccggctagccgcgggtgggagcgatctttaagaaggctgggcgatgacgtttatcatgcttccttttttttttttaagcatttgggcatatataatatttttaaacatcatctttgaactttctgtaatcgggaacatcaaagaatgaaattgaagcttcagatcttcga

SEQ ID NO: 110157 - DNA, 1031 bp, Homo sapiens
tgtgagatacctaatgacaggcatttgcctctgggttctgagctaactgaggaagggacacaggcaatagagaaagcaccaaatattagttttatttccgacgaagatacactagagagttcaacccagaactgtgaggctttctaacacgaagagtgcttgaaagcccctttcccacctgcagggtagacactgaagtcatcagctacaaaagttactccctgcacttcctacttctcatctctgccactcctccaccccacaccagtcaagtgcctagagcggggaggagaggaagttctaattttatagaccaagaaaggaatgctgggaggagaaaacagttcttctcacactatgaatatggacaactaacttcacatgtacaagccagaaataactgcccagtgtcgtgaaaataaaccagatacacacgctctgtaaactgtaaagggctttatacacagtttctcttgttatttttatcaagaagggagctaaagtgcaggtgggctgagtgacgcaggccatcactgaactcattagaagtagagttgggacctaaacctaggtctccaaactctcaactgagtatttttcccatagggatcagggacggggattggagtgaaagctaactattacatgcataacaaggattagatgtttgcgttaggccttgtaggattatgggagattatggaaaaggatttccaagtgaagggaactggaacatagaagaaggcctgaatacaggcatatcacgaagtcaggagttcaagaccagcctggccgacatggtgaaaccctgtctctactaaagatacaaaaaattagctgggcatggtggcgtgtgcctgtaatcccagctactcaggatgctgaggcaggagaatcgcttgaacccaggaggtggaggttgcagtgagctgagatcgcgccattgcactccagcctgggcgacaagagtgaaactccatctcaaaaaaaaaaaaaaaaaaaaaaaaaaaaaacgaagaagaagaaggcct

SEQ ID NO: 110158 - DNA, 1020 bp, Homo sapiens
gatataaaactggatacacaaagaagccacatcaaccatatagtcggtacttaataagtgtctgaatacatgaattatttgattaatgaattaatgaatgctgggtcacaggaggtgggtcatgccagagacaaaacagattaattgattgaatgaatgagagagcagagattggggtctctttgacctgtagcacagatgccagcctagctcctcacctgtcttcaccccaaggctcagccacagcaggaggaggaggaccagccacgtggcagcaggcatcaagcagagatagaagtgctgcagcgtccaaggcctggtctttaaatatccacccatcccagccagcccacctggttcctccctactcctggggaggaaccagcagacacctgggcagtcactggcagacagcaggagtgacacaggtatcccagctgcttgaaatagctcacccaagcagaggtaattttgacatcctggaaactccagcctccaggggaagaatctgaaaaaccagagtgacaaaatgacagcgctcacaggaactttgcagattatctaatctttttatttattttattttattttttgagacagagtctcactctatcgcccaggctggagtgcagtggtacgatctcagctcactgcaacctctgcctcccgggttcaagaggttcttctgcttcagcctccccagtagctgggattacaggtggctactattacacccagctaattgctgtatttttagtagagacgagttttcaccacgttggccaggctggtctcaaactcctgacctcaggtgatccactgcctcagcctcccaaagtgctgggattacaggcatgagccaccacacctggccaattgacttttattagcattcatatacaggttttgtgtgaatatatgttttcatttctccgggataaatgtgcaaaaatgaaattactgcatcatatagtagttgcacattcagtcataaaaaaaaacagccaagctgtttcccag

SEQ ID NO: 110159 - DNA, 1581 bp, Homo sapiens
tgcacctgggacgcaggcactccgtgtcacctgtctgtcactgtctcgggtggttcttactgatttgcacctgggacgcaggcactcgctgtcacctgtctgtcactgtctcgggtggttcttactgatttgcatctgggacgcaggcactcgctgtcacctgtctgtcactgtctcaggtggttcttactgatttgcatctgggatgcaggcactccgtgtcacctgtctgtcactgtctcgggtggttcttactgatttgcatctaggatgcaggcactccgtgtcacctgtctgtcgctgtctggggtggttcttactgatttgcagctgggatgcaggcactccgtgtcacctgtctgtcgctgtctcgggtggttcttactgatttgcatccacataggctttgggctctatcccacctgtcgtcttcggattctctaatacgcaggagtgctcttctgttagtttactcatagtttattaaagtacagagaaaagacatccaggatgataaattttacagtccttgccggggactgccagcttccagtggtgttgcctggcaccagtgtgacccccggtgcctgccccgctgaaccttctgtaaactgtttaactgtgctggtggtttcccattctctaggcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttacttacttgtgcctgcctgtttctttgcctgttagtcagcaagctccaggccccaagcgaggctccccaggccaccagcatctgctccgggcagcaggccttgtagcaccac

SEQ ID NO: 110160 - DNA, 1034 bp, Homo sapiens
tgagcttccgcggctgccctggcctagcatgcctgccccccctcgagcccgccccccggagcctgggcttctgctcacgagtgtggccctggcttccgcctcggcctcactccctcccagacctgtctgagcttctggagcacgagtgtggccctggcttctgccttggcctcgctgcctcccagacctgcaggcgctgtctgggctttgtggccgttggtcaggagtactgtcctctccaaggatagtccttatagcccctgatggcaggaggcggctccgtgcctgcactaatggtgtgccgtgacaggggcggggatgagggctcactaactcgccagggcgcaggagcagggccgccggggtcttgtgctggtggaggcagcgtcaggcaggagccagtgttgcttgctgcagcttagacggagcgaggcggggctcaccggcccacatggggctgccgggcagagcaggttccgccctcctgatggagtggtcggaggtgcgctgagaacctggccgccggtggctgacctcagacctcggggggagttgggagtggagggttgctgggggacacttggctttctctcccacgtgccacctcccctcgtgtcccagaccctgcctgactgccttcctgttgggctctccctttccatcacagaaccaacctatgaccctgtgagcgaggaccaagaccccttgtccagcgacttcaagaggctgggcctgcggaagccaggcctgccccgagggctgtggctggcgaagccctcggcgcgggtgccgggcaccaaggccagccgaggcagcggggctgaggtcacgctcatcgacttcggtgaggagcccgtggtcccggccctacggccctgcgcgccctccctggcgcagctggccatggacgcctgctccctgctggacgagaccccgcctcagagccccacgcgggcactgccccggcccctgcaccccacgcctgtggtggactgggacgcacgcccgctgccccccccgcccgcctatgacga

SEQ ID NO: 110161 - DNA, 1015 bp, Homo sapiens
ctggaacccagccgaggagtgaaatcaagtggccagaagaggactggggccccggccttgccagggaactgaggggtgaggaggaggtgtgggcggggcgctggccccacagacctgaaagctggcgttgggtcccaggtctgctgggatctttctggtaaccgtggacaggtcatgttgcctgctgcagcagcttccagcgtgcctccttatttgcaaaccatagggaaagctgcctgacccacctagagagttgtgggtaaggccgtgtgcaaacaggcctgtacggggcatggtgggtcacgggggctgttggggaggagggccggtggcacacagcctggtcctgaggcctgagctccatcccccttctgccacagtggccagggtgtgaggagggtcccagtgccggggctgccccgccacgcctggcgttcaccgtgccatctctgtcgcgcagggccgagaactactggtggcgtggccagaacacacggacgctgtgtgtggggcccttccctcgcaacgtggtgacctccgtggccggcctgtcggcccaggacatcagccagcccctgcagaacagcttcatccacacagggcatggcgacagtgacccccgccactgctggggcttcccggacaggattgacgagtgagtactgggcggggatggatgctgacctggccccgctcgggactccagggccctcagcacggcacgcgtgggcggaatctgctcttcaccctttcgcccgggcttcagcccccgacccgccactctcccctcctcaccctggccttactctcgggaagctgtggaaccctaggaagcccagcctggtgggggttctccaggggaatgttctccaggggagtgttctccaggggagggttctccaggggagggttctccaggggaatgttctccaggggagggttctccaggggagggttctccaggggagggttctccaggggaatgttctccaggggagggttctccaggggaggg

SEQ ID NO: 110162 - DNA, 1067 bp, Homo sapiens
ccacctgcttcccttgctctcagcaggagcctgtgtgcctgccagtgtccccaggggtgactcagagtggcctgtgtttggggcgtgtgtctctggagctggtgttttaggtcaccgcccgggcaaggcgggcagtgggaggggccgggagcggctgctcctgggagggttgtgggtgtgccccgccccgcccttccgtcgaaggcccccgttggccccagccgctggttccctgtggctgctgctggtggggctctgggggctccttccccctgggccaccagccctggcttggaaccacagcacctgccctccgtgcctggagctgctcaggaggtgggaggtgaggggcaggaggccacaacagccggtgaggcttgggagcgggcctgggtgtcggtggtggcagagcttgactctgcccccttgtttcttcagtccctgaatatctccatgtttgtttggctgcctccgtctccatgtctccaggcggatggctctgtgtgagtctttgggcctgggtgtgcatctgtgggtctgtgtttggagttccctcctagcctggccttctcttcgccgtggcttcccacttgcgaagctgtgtccagtatttgtttcctggtgcggagtctgggaggccacctgccgcagctctgactgagtctaggctcagtccttctcagggtaccaggctgtgggcagaggggagacacctagatgtttcgtgctgtgtctagatttggagacacaaatgatgactggtctttcccaggggctcgtttggaggaaggggtggctggcagcacttttgttccgcatacagagcgggtgttggaatccattgcgggtccttggcctggtctggccctggagcctcggcttcctgtggtgggtgggagccaggcatccgggttatccctccaggcctgggcgcctgggacccctagggagaagagcgggcgggcgttttgaacagaatgtccggcattagttgagccatttctggactaccttcggcccggacgggaacgtggtgctgagatttccagagctggggcagccttagg

SEQ ID NO: 110163 - DNA, 1035 bp, Homo sapiens
ggggcctgccctccttctctagcccttgccacatccacttgttccgaggctccagacctgggaagaagggactggggctctggagagggcccctcccaggcaggcagatcccttctttggaggccaggcatggcagcagccgctgcagctgtggatgggctggagggaaggcgggaagtgaagggctgggcgctctgtttgtcgtcaaactctgcacctcctcaccttcagatcctgcataagatcgacaaggagggggagcggctgccccggcccgaggactgtccccaggacatctacaacgtcatggtccagtgctgggctcacaagccagaggacagacccacgtttgtggccctgcgggacttcctgctggaggtgagggacaggtcagcccaggagagctggggtgttcaagctgaggggctacccaggcgtcagtcccagagttggccacgaccttcctcttcctccaggcccagcccacagacatgcgggcccttcaggactttgaggaaccggacaagctgcacatccagatgaatgatgtcatcaccgtcatcgagggaaggtagggagtgcagggctgggccccgccctgggatcgcttgaagggcacaggtcggagggacctgtggacagatctgtttggcctccaagattcccttggccacatacaggctggcggttgggcctgaaccctgcagtgtgaggggaggacaggcctgcctccgtcttcctagtgcctttccctgcccagcttccctccaccaccctttcccactgggctgcagccctggctgtgtggttgggccaggctgcctttatggaggggtagggagtggcctggcctcggtggcagcagagttctggactcccgtgcttcctcctctgctcctccccgcttctctccctgcttcttcctggcacagggactcagccatccacctgggtgcgtttcagtagctgaagcagcccagcctgccctcttgcagctttccatccttcctgctgagcccaccaccccctcccagg

SEQ ID NO: 110164 - DNA, 1050 bp, Homo sapiens
gaggcagaggttgcagtgagctgagatcacgtcactgcattccagcctgggcgacaagagcgagactgtctcaaaaaaaaaaattccattttataacatttgaatattctctcatcatactggttatctcttactttttggttggtatttaagcccggcattcccccaggaaggggaggtgtggccgacgatggctcctgagggccagccgtctgcccttctccagccaggcctcacgcagagcacgtaagcccaggcactggtgacatgcttacccacccagatgaggagctcacaggcagggatcgttgagccgagttggagggtggagcaggttggctccgcgtgtctgggacctggcaagtcctgagtccttgcaaatcccgctctgggcaggtgagtgtggctgtgaagtgcctgaagcccgatgtcctgagccagccagaagccatggacgacttcatccgggaggtcaatgccatgcactcgctcgaccaccgaaacctcatccgcctctacggggtggtgctcacgccgcccatgaagatggtgagtactgcgggcgggagggggcgggcagggagagggctccggtcccatatgtgtggttcggttcctctctccatcctaaggtcagaggcgccctagatcctactttggtcccccaacctgatggagtaaaggggtccacaggggcccagcctggtacgggctgtgtctgctgcggtccagtccgggtctgtctctggattttgctggtgctcagtgtcaagagagttactcccatgggaggggctggccactgagtttaatttggggaatttatgttttatttatctatttattttgagatggagtctcactttgtcgcccaggctggagtgcaatggcatgatctaggctcactgcaacctcggcctcctgggttcacgcgatattcctgcctcaggcttccaagtagctgggattacagccgtgcgctaccatgcctggctaatttttgtatttttagtagagacggggtttcaccatgttggccaggctggtctc

SEQ ID NO: 110165 - DNA, 1103 bp, Homo sapiens
tgtctgagcgttggggccagtgtccagcgtggggtggtggacctgtctggacccagaacgtctttgcttggcttccctcctccctgaccctctctaatctctgggtttctctggtcatctgtccctgctgacagcttccttccccacagcctgtccccacctctccccacaccttgtcctaatttgggtctgtggtgtagtgagtccctggtctgactcagtggaactttgcccattgtctggaagacaatgagagaggaagtgagccagccgtggtctttcctccccacttctggcttcagggctgggttggggggtgggcagggccgaacagctgcagtgggattgggcagcagagattttcctggctgcaatccggcaaaggggctgtctcttgggatcctttggcttttcctggaaacactgtcctggtcctttgcccgggttttagggaaggatgagtagtgtcgggatggtggaggcaggagaagagagcagcgtggtttgctgagatttaggggtcttggatctgccactggctcctgataggtccctgggcggtcagtggcctccagatttttgttgtgtcttcagtgaaatgataccggtccccactgcccagctcacctcccggggctgcaggaggcaccggagataatggctgtagagggtcttgtaacctgaacattgcttgcaaacataaggaattctagttactgggaggaagcacagggcagaggccagaagaggccctcagatttgaggcaccctagcccagacggataaggatccaccagctctgggggcgtgagacccaagctggcaagaatctgcaatctggagccaaggctgtgggtgcctcagtggaggccgagtcagaccgacgtggccagctttgaccctcatggcctcctttcttctgtcccttgaccttcggctcctccctgtccaccctggcctccgagtctcctccacttttccttccgtctcagccctcagctctaggcgcccctccagagacccagctgtcttcccaggccccttcccagcaaggactagcttcatctgaaccacacacacactcacggttcaacctcagacta

SEQ ID NO: 110166 - DNA, 1091 bp, Homo sapiens
taatgagagggggttgccttcactgacatttttgcaaatagtggacttctgctatgttctgaataaagcaaagtccattttcccttaagtttacacagtagtttcattccaggaaaatttattttatattaaaactgtaaggccaggagcagtggctccccagcactttgggaggccagggcaggtggatcacttgagctcaggagttcgagaccagcctggccaacatggaggaaccctgtctccactaaaaatacaaaaattagccgggcgcctgtgatcccagcttcttgggaggctgaggcgggagaattgcctgaacccgggaggctgagtttgcaatgagccaagatcataccattgtactccagcctgggagtctcactctgtctcaaaaaaaaaaaaaaaaaaaaccaaaaaactataaaagtactttcttatttatatataaagtgggatcatattctaggtttgcatgatcataaacaccttcatgaattgagttgtgtgggatttgggacagtgcgagaatgtcctacgcattgcaggctagctcacgctcttgtcccccaaccacccactgaatgtcactaaggcccccccaaatgttgtggcaaccagaactgtcccatagggggctgtgcagcctcatgagaaccattccagtaaagggttacagctttaagtttggaaaccacccggctggcccagctgcctggcccggtcgccgaggtggaagagccaggatttgaactgagagtttctcattcccctttgttactctttgtacttccctgagctgcctgaaaaagtcggaactggcactgtgttggcagggccactgggaactgtgggggcaggaggctcacgctgggcccaggctgtgtgtgcctgcttctcagtgctgctcactgtgatgggagctggggaggaggccaccgctgagtgggggagggggatggcttggtccccagccgggcagctggccttttttctctcgcctgttcctctttggggattgagcatgggtccggggctagcctggccacgccctcagctctgacacaccttacgcagacagggatgggttt

SEQ ID NO: 110167 - DNA, 1225 bp, Homo sapiens
tttttcagccagtgtcagagctgctcagctggggagggagggagagagggagagagagaggcaggcaagagggagggcggccgggcgggcagttgggtggggaagccggggagtagggctggactgtgaccactgccctggagagaagacagaaacaggacagaggatcccggctgcagccagcgtgaggaaagctctgctccctgccagaccggccagctgtggaaacccagcggggcttgcagcagagcggaggggcccaccccgttcttcctcatttcccacccctggtgtgggatttggggggctcctgggcagagtgcgaagctccggagccgaggccactggatccccagtgactgctcgggggggtcccgctgcgtggagatgccggcagcacgtcggttccctggcctggagctctccttccctctcctggccagactgcggcgacgcctgtacacagtgagtggggggcaggggctggactgctggggactggttgggctcctcagcaccagcacttgactgagaggcagaaagcaagactgggagcggctgagggaccccgccagtgagggcttgacggggagtccgggccaagtggcctctcctgcggctgctgcattccttcttcttggcctgtgtgtttgcacgccggccacagagtagtgacggacacaggtgtgcagactccatgaggtgcgggggccaggaccatgcagaattggagagtgtttgaactctggaggagctgcagccatgccctgtgctgcacaaagaaccttgggctggagggggacttagaggggaggcggacccctgcggagtcaccctggactgagaccctgaccgcttgcctcaccagcatcccggagttccttcccgtcctcccacatgcatcccctgtgcagagctgcgctgttgctgggtcagggagcatggagtgcacagctgaacagaggtgcattagctggtgtttcagggagagggaacaggccgggctgtgctttctgaagagcttcaggggaggggcctctgggtctcccccagccctgaccaccccgggcatggctttgagctgttttcaggagcctagaggagggggcctggatccttgggagttggtggtgggaaaaagaagaggagccctggagactgctctccctgcgggagactaggagcctccatcctgaggctgagccctggagggggggggtcactt

SEQ ID NO: 110168 - DNA, 1012 bp, Homo sapiens
gtgcgtgcccagcgcacagcgcgtgcggcgttgcgggagtggcgcgcggggaaccggccgcgggggcctcggggcgggggcgtggcctgcgcgggaggcgggcgctgggaggcggcgcggagccggctgagcgcagggccgagctgcggggcaggtgggcgcccggcgttctgggagcagagtggccgccggggcaggctgggggcggggtgggctgcagccccgggatgcctcggaggagggggtctcagatggagtcggacggaggcccctctgctgtgggcttctcggatggccccttaccgtgaatacgggggactcgtgaatccccaaggccccagttggtggctctggggccctggaggcgggctgagggctgagtggagcccggttccgcggccggcgaaggcagagccccggctctcggtgggggtcagcccggggctggcacagctggctcactgggagagggtgggagccgcgccccggagaggaggaacggagctgggacgggctgcaggagggaatggccgcaggccggcaggaggaggggcgcgaccacccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcaggtaatggggaaggctaggggatagccagatacctgggccccagaccccttcgtctgctgtgagccgggctcagccctgccccctgcggcggcctcaggagtgagagtgtctgctcctgggccaggggacagagagcggtgtgtttatgtgggtgtggcggtggtgacttagtgatgctggcatctgcctgtgtgtgcatggatcccctg

SEQ ID NO: 110169 - DNA, 1090 bp, Homo sapiens
ctctctcggtgagctgggatcctgacagacccaggcccccttcccatcaccctgtgtggcagcccgcgccccagcaccccttcgcagtccgatgagaaggcaccttccttaagaccaatgtcaggctctccctctgcctgagggactggctgagttgttctggttctgagatggctttgggggactgagttgcttagtgggtctggggtcggagtggttgtgatgacatggacagcccctcttcccagaaaggtgctggcgtctctggattagaaatcatggggggaggcaaagccggggctgggagagggcaaccaggcttgttcctggcacccactgggaaagcaacctggcagcagctcacgggggaagaagcagccaccgttctccagtgttcctcacaaagactgagtccttctcagcagacacacccagggcccctgccaggttctcccttcagggcgacagatgtggacagatggttcccttacgatgtacagaccacagcagaggtatacagaccgctccttcagcacaattatgtgctgatacaaagagttacaggaatagtgaccctttaaggataggaacgtgatggataatttaaactttttaaaattcttggccgggcgcagtggctcacgcctataatctcagccctgtgggcggctgaggtgggcggatcatgaggtcaggagatcgagaccatcctggccaacagggtgaaaccccgtctcaactctactaaaaatataaaaattagctgggcgtggtggcgcacacttgtaatctcagctacttgggaggctgaggcaggagaatcgcttaaacccgggaggcagaggttgcagtcagccgagatcgcgccatggcactccagcctggcaacagagcaagactccatctcaaaaaaaaaaaattattttggctatttttcacatgtattattgtgtagttttactactcatgttttcaagcatccctccaacaaaacagcagagataaccatttgtggctaggaaatgggaatttacagaagagatggcatttgacttggatcttgaggagtgtgtgggagtttatcatgtag

SEQ ID NO: 110170 - DNA, 1594 bp, Homo sapiens
ctgcaggagcgcggcggccgcggccacgagcccagccggggggtggtgtgggggccgccggacggcgcgggctgggggcgcccgccgtggtggacgggctcggcgggctggcctgtggcgcaggaggaggggctggggccccgcgggcagcaccaggagaagggcggaggcagccccgcagtgcaggagcgcggcgaggcccgggccggggtgcaggagcgcggggaggggagcccgcggaggctgctgcagcagcccgaaccggcgtccgagtccggggaaggcccccgcgagcgcagggaggggccggaaagttccggcgaactgggggagcggcagtgggagagcgtcgggcgggaggcggtggtcctgggagcggccccggcgccccgaagccgccccgagctggtggggagggcccggccggtggggccccgggggcctgcgggggaggggcgcctgggggtgcaagaggcgaattggctgcccggggtgcaggagggacaggtggtgcgggctgtccaggaaacctacctgaacgggaaggagccccaggagggagagggacccggcgaggggctcaggacccggaggcgccggcggaggaggaggtggtgactggcaggcccgggccccacggtacctccggggctgaaggggacgcaggatgtaggggcatggggagtcgggcgcagaagagtgcggggaaccgctgagctctgggagccactgcctgagggcaggccgcggccggcgggaacctcttctgccgtctcagcctgggcgtcgctgaagctgtgtctgcggggaggcagcggaaggcggcaggtaaggaagcccagtcctgttagctggagttggtgtgcttggaagtgagaggctgcaggtccctggcgagagcgtagactccacactgccctcgttcttttggcctttcatccctggagggaggaagcagtgcagttttcagcggcaaggcaggacctctcccccgccagtactgtgtatggtaattggagtgatagggcatcttcttagagtctaggcagcaggcgggacgtctgggtggctgccaggtctgtgcagagggaagagaggggtagccccagggaggagctgcaggacggtcccccctccacctgccccccgatggcagtaggggtgcctccatgctatatgctctgcatggtgcagtcaacacacaagtcctcaaaacacgtcccacagaagggaagagggcagcgtgggattaacagaaccttatcttgtaaccctgttggtcacgtgagctgagatgagtgtgacagctagtggcttgggtacggcacgagcctggcccgcttctgccacgccgtcctgtcacagctgatttaccctgagggcccagagccaaggatgattagtgggcggaaggagggagagcaactggtgagccctctcgtctctgggtgggacgacccagcgttagaggggcgggagaggagggtgcacttgcaccccagggctctgggctgcctctgtggccccaccctggggaggtttgcagatgggccgctgtggtatcatgggctctgcacctgtcaggacaggagct

SEQ ID NO: 110171 - DNA, 3042 bp, Homo sapiens
aaaccccatctctactaaaaatacaaaaattagctgggcgtggtggtgcatgcctgtaattccagctgctcaggaggctgaggcaggagaattacttgaacccgggaggtggaggttgcagtgagctgagatcgcgccattgtactccagcctgggcaacaagagcgaaactctgtctcaacaacaacaaaaagccgggcacggtggctcacacctgtaatcccagcatgaattgcttgaactcgggaggtggagggtaccagtgagccgagatagcgctgttgcactccagtctgggcaacaagagcgaaactctgtgtcaaaaaaaaaaaaaaaaaaaaaaagtctgatcggcattcttaaatttgggacattttacatttgaagtgaactgttgttttactacaaaagtcacagggctgtgtaaattgccttgtgtgttgttttcgtaggtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttccta

SEQ ID NO: 110172 - DNA, 1037 bp, Homo sapiens
ggtcttgaactcctgacctcaggtgatccacccacctcggcctcccaaagtgctgggatcacaggcatgagccaccacgcccggcatcttatgtctttcttgaaactaattgtaactgttgaaaatggaacttaccaggtggaaataactaaatcctgaagtaccttgaaccaaaatgttttcccctatagggacattttcccccaaaaggagaattgaactggaaacaatatagtacataggattatataattatgttcaatttcttaatgagaatggttttcttacatgctgggctcaaatatgagtgtatatcacagtccatagagcttggaacccctgtgcaaggtgctttcggagtcttgagcttatctgcgagttccttttatcagaatcttacttaacgcacgttaaattagaaaggcatacaaaagaatgtccttagaaataaaacttctcatagcgaataatgtctgtttcaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtaagtgaacttttgggaaaggaggaactaaagtatgtgtaaaataaccgataaatcttacacttctgcaaagtggacaaactctaggagtctagaattcctttaagaagggagcattaatggtttagctgtcattttctgtttctgctgtctaattcagaacttagtcaaacctagtctttttggaagagacttgctgtaaaacttccatgtatgctccaatggggaaaagaatctgaacacatttaaagttttcctttgtaaaatgaatcagtttcctttaaaaaaattttttttttttttgagacagagtttcactgttgttgcccaagctggagtgcaatggcacggtctcggctcactgcaccctccacctcccaggttcaagtgattctcctgccttagcctcccgag

SEQ ID NO: 110173 - DNA, 1100 bp, Homo sapiens
ctctagcctgggtgacagagagacctcgtctcaaggtatgtttcatgtatcttctcttttttcattgataaaggcccaaacttcccagagagaaaaacatacagccttaaggaatttggctagaagtctattcagggcatatgatacgatagaacagggattctgtagaacctggaagaaagtagtcactctaggagtaggttagcttgagagaagtagcaagaatgtacttaaagcagcagataatgagatagaattggggtaaattgcggtaggaatatgttagaagcaagggtggaactgtcgtcactgttacctcgatggcgaagccagaatgtgaggctcttgctcttagaactcacgtgagtaccatagcctcgcgttgtcttgcaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggtgagcactgattccaattacgtttttattttgctgaatgtcaagtattttgaaatgtgatgtgttcctgtgtgttcctgttggaagggtgattgtagccatagtacattttaaagtgaactgaggtataattgtatgtagaattggtaacttgtttgagagaagtcgggaggctgtggattagagacctaggacagagctcagcaggtgtttcagaatccagagcagtgtcaggttttctgtcactcatgtctcccaggcagcccgtcagtaggacacggaatatgaagatctcagcaaggagttgggctgtgtgcctctcgggcgtgacccggatggaaagacagcacagctagcaggattccatctcgtagtgatctgcgcatctaaaagtcaaatattctattaaacgaaactgataagcagggtgaggtggtgcatacccgtagccccagctacttctgctgaggcaggaggattgctgg

SEQ ID NO: 110174 - DNA, 1016 bp, Homo sapiens
ttaaaaattgaccattatgactagaaaatctattctaagttattgactagaccagtgataagcaaatttcttaagggggcagataataaaccttttgccaggctatacagtctctcttttagctgttcaactctgtgggagcaagaaaacaggcacagactgtgcgtagtgaatgggcatgcgggctgtagtttgccagtccctggagttaactttaaatgcaatcaaacagccaacacttactaagaaataagtccttggacttaagtagtcagtaaatttaattagtagtgtaggaaaaaagtagctctactagtaaggtaaaattaatattctcatgtgaatttttaattcccagagtttttagtcagatttgaagtaaggctcttttatccttaatacatatactgtgcttttacctttctactgatgtgctaattctagaaaagtttagaagctgattatataagttctttcttcctcttttttcttttttaaagatcactatgttgtagttggggcccagagagatgcatggggccctggagctgcaaaatccggtgtaggcacagctctcctattgaaacttgcccagatgttctcagatatggtcttaaaaggtagagtacaaattttgattcttttgaatattggtgcactgcatacagttctagatgttatactgtgctttgctcactttgcctgcattcctgtggttctcatgctagactctagttcttaaatacaaggcagattgtcttttgttgtagctgccttttcctttgaaacagctttccataaagtgtcttaactgtgctagaaatcaccagtttctttgagacagtggagttactgagccctagtgcttagtgtggtggatccagagtgataaggtggatcatagtccctaagcaatctatttgaaagcagtagcatacctctctactcatgtactgaggcctaacagctattgaaattttgttctgtttattcatttattcattttttgagacaga

SEQ ID NO: 110175 - DNA, 1116 bp, Homo sapiens
aatggttcaccactagagagtaagtttttttttgtttttattttgttttgttttgttttgtttttttttgagacaggacttgtgctctgttgcccaggctggagtgcagtggcgtgatctcggctcactgcagcctccgcctcccaggttcaagcgattctcctcctcatcctccttagtagctgggattacaggcgcatgccaccatgcccagttaatttttgtatttttagtagagtcggggtttcaccatgtcggtcaggctggtcttgaactcctgaccttgtgatccacctgcctcagcctcccaaagtgctgggattacaggggtgagccacttcgccgggctgagagtaagttttgtttatatgtcctcttaatctgtaacttcactggacaggagtaaaccctgggcaaggaacaataactcagaacttacgcctgctttctgattctaggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccaggtaaagaccgcccccccccccccccgccccgctttttttttgttttcttttctgttcctaaggatgtggctagagaaggagcgagtgtaggaatgctggcttggcttggttttatgaagtgctcaatcttgtctgtcctaaagttaattgtttatgtgttagtttcttttttttttttttgagaaagagtttcactcttgttgcccaggctggagtgcagtggtgtgatctcggctcactgcaatttccgcctcccaggttcaagccattctcctgcctcagcctccccagtagctgggattacaggcatgcgccaccacgcctggctaattttgtatttttagtagagacagggtttctccatgttggtcaggctccatgaggtcagagctcctgacctcaggtgatctgcctccctcagcctcccaaagtgctgggattacaggcatgagccaccgcgcccagcctatgtgtcagttttattgggaggtaataaggcc

SEQ ID NO: 110176 - DNA, 1500 bp, Homo sapiens
ttttttttttttttttttttgagagggagttttgctcttttgtccaggctggagtgcagtggcgcaattttggctcactgcaacctctgccttatggtttcaagcgattctcctgcctcagcttcccaaatagctgggaatacaggcgccagccactgcgcccagttaatttttgtatttttagtagagacagggtttcaccatgttggccaggctggtctcgaactcctgagcttgtgatccccctgcctcagccttgcaaggtgttgggattacaggcgtgagccaccactcctggcccgttactcttattttgcaaacaagtgagttaatttttcaggaagcaattaataaattaccagataaacaatttgaaatatttggaagtattataagtttagtcctctgtaaccatttggcctttagcataatgtccaggatgtattctcatttcgtatgatcagatcttcattttctgagctttatatgttttcttttaggttgcaaatgctgaaagcttaaatgcaattggtgtgttgatatacatggaccagactaaatttcccattgttaacgcagaactttcattctttggacatgtgagttatttcttgagtaaatcaccgttttgagttccttgagttgttcttggattcctgtattagcagaaatagcactgtgtcttccttaactgctcttttttctgggagggcgttagcagtaagcaagaagatagattacattgactttgaggctttattatttgttgctaaaagtactttgtcaatagtgccttgaatttgagaatttccatatgccatgaaaacaggagtcacattgtagagccactcagatttttgaggcttcaagttggtaaactaaggttgggctgcagccttataccaaacctgaatcttacagagaagttttgaggaagtatgtgatggagtgaattgctcttttgttttcctaggctcatctggggacaggtgacccttacacacctggattcccttccttcaatcacactcagtttccaccatctcggtcatcaggattgcctaatatacctgtccagacaatctccagagctgctgcagaaaagctgtttgggtaagtttttatttgaaagcggtcttgcatagtgaggttttatgattagggaagaacggtaatatgttgattaaaatgttaaacatgatgataattttccacatttgggaatttggaggatggttagctgttaccttggtacagatataaatgaatttttctctataaagagatcttaataatggactttggacttataaacacaggagaataaggagacttataaacccagtgaattccttgtgcaagattcctggcatagcttctgctcaagtacttctgtgctgaagcacgatgcctatagcagcccattcagttagtagagagaatctgttagaattcatattgggataaaatcctattccccgaaacatccatttgtctgga

SEQ ID NO: 110177 - DNA, 1082 bp, Homo sapiens
ttcatctggactcttatgagcttaggaacatcatgacacatctaaagttggtgtatgcaagtcactttgttgtaatagatggtgttttaattttgggacagatttattatcagacctttcagttaaaacctatttctatgatgtcctcaaggctaagattgttccaggcctccagtcccatgaccagcctacataggcctctttaatctaaatgcccttcagatgaaaggcagcatgggataaaagcatgaaagacataggaggccaaaaatcttgattttattccaatagctctgacctaaaagttgtaaagttttttagaactcatgtcttttttaggccttggcctccttttatctcttacttgggttgcctgtcttaggtttgatctataacactcttctgtctcaagattttagagctgttccgataccataatgctcattaaatctaatgtctttgttctagggtaaactggtccatgctaattttggtactaaaaaagattttgaggatttatacactcctgtgaatggatctatagtgattgtcagagcagggaaaatcacctttgcagaaaaggtgagtatgagttattataatattaaatacagtacttttggtatcttactcttcaggtaagtgatatttcttgttaatattcttacattctgaaaatcagcaatcttaaactctcataccagataatataatttattaaaatgctcaacaaatgaagtaagttccacttacctaatcagaagtgcttaagtgaaagctatttctctgtataactcagttttacgcatatacagaattcagctaaaagcatgttttataaaaaggaaaattaatagccaaacatacacaaggaactagagtggaacatatcaaaagacagtggtgatttctgcatttttaaaaaaagtggcagggctcacacctgtaatcccaacactttaggaggctgaggtgggaggactgcttgagccctggaggttgtgagatgtgactcgtgccactccagcctgagtgacagtgagactcaaaaaagtggttgtcttagatgggtttttgttatt

SEQ ID NO: 110178 - DNA, 1091 bp, Homo sapiens
gtacaccagaccttatggttaaagtgagagtatagtccaccccacaaaaatgtaagaactaatatgctgagtaaatagaaagaagtatgggagatcggaccaaggagcagttctgcttcagggtattcagatgcttcacaagtaggtgagaattgaaactatgcactctgttcagcacagtattactatcttagattttatagtagatctggaagctactcatttcccctaaaactatcctaagcagatacattgtgttatgatgaggctcttgaaggagtgctttgtagtgggtaaagaagctttgaagttacaagatttggggcaaaattttttttcttttgtgatattctggtcagtctagaagttttgggtcacagttcatttatctgaactatgagggataatattttgctttcaaaacaatttgtttaatccttgacttaaatgtttattttaaagtaaacttaagttcatttaaaaggcattttctcctccaggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacaggtatgttgaaagatggtaaacttatttttatacaagtagctattttcaggtgtgctaaatatagcaaagactttttgttagtgttgttggcttttttttgaaatggagtctcgctctgttgcccaggctggagtgcagtggcacaatctctgctcactgcagcctttgccttctgggttcaagtgattctcctgccttagcctccagagcagctgggattacaggcgcacgccaccacgcccagctaatttttgtatttttagtagaggtgggatggtctcgaacttttgacctcaggtgatcagcccgcctgggcctcccaaagtgctgggattacaggcgtgagccaccgcatgcggcccaaaggcttttaaaataaaaatcaagcttaagatttagaggtaaatttcctcaagccaaataatgcaagacatactaaat

SEQ ID NO: 110179 - DNA, 1190 bp, Homo sapiens
tacaggcatgagccactttcccgtccactttatgcctttttaagtgccactaggaagacaatcatgagtagattctatacctgtcattgaatttaatctggttggaaagagagacccatgaattatttcaatacgacgtgcaagtgttttctttttatttatgtatttttttgtttgctcccactccaccaggaagcaaatgctacgctagaaaatatccgcaggacactggcggtgcagcagctcagtctcatgtttcaagggggtcttttggaaaaaactacctatgttttgaataggtagctatttgaaataaagctagtatataatttattaagtggtttaaagtatacaaaactgagatgcattatatactttaaaactacttagaatttgatgaaaaccagtattttcaaggcttacctgaaaatattaacagattaacagggatagattacaaatgaaattctgagttcagctctggaactttgtctctttaggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagtgagtgccagctgctgtgcaagtatctagacaagtaattcaagaattatgataggccacggggaaacaataatggtgacactgtggggaatggcttgttagagaagacaagacttgtcatgtttagctaaagaggggaaggggcctgtaaaaaactgaaactatactggtaggggaaaaggtagaacttctctggggagtctcctttttcttaaaaaattaataggcccttgatgttttccccatctttgtagcttattgcttgctgtcattctctggctctgatttttcttcttaacctcttgtaacgttgtactaagctctgctttgctgacaaggacatcagtagcttttctctgttttaggaagcaacacatgccagaagtagcctttttcatctccttgatcatgggtaactgcctgccttaagtctctagtgcttcttaatttctgtgatactcacccattaacccctaggccagtcagtatccaga

SEQ ID NO: 110180 - DNA, 1175 bp, Homo sapiens
tttctgtcttctatcttatgcttagtcagaatttctgcttatttataactttgttttattcttgctcccttgctcccaccaacatcatggtctgggttactgcatagtatcctgaactgatttgtgcccctagtcccagctactcaggaggctgaggtgggggaatcagtagagcccaggattttgaggctgcagtgagctgtgatcacaccactgtactccatcctgggagagagagggagaccttgtctcaaaaaaaaaaaaaaatttacaaaaagggagagactgactgagaagaccagtgtgaactagcccttgactgggcccagggaagaatgttggtttgaaaggagaacaccctaaggaatatatagcaagttatagtaatggcccaataacaagcatatacctaaacgagcttttcctaaacattcccgtgcctgttcttcatcatgcctttttccgcaacacagtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggtgagaatgaccattccaaacttcaatgttttctataaccaactctgggaagtctgttatgtcagctcagcatatagttattttgtaccttattttttttttttttttttttggagacagaggcttactctcttgcctaggctagagtgcagtggcaccatgttggctcactgcaacctcagcctcccaggtttaagcgattctctgccttagcctcctgagtagctgggactataggcgcccacgaccacacctggctaatttttttttttttttttttgagttggagtctcactctgtggctcaggctggagtgcagtggcgtgatttcggctcactgcaatctccgcctcccaggttcaagcgattcttctgcctcagcctcctgaggagctgggactacaggcgtgcaccaccacacctggctaatttttgtatttttagtagagacggggtttcaccatgttggtcaggctggtctctaactcctgacctcgtga

SEQ ID NO: 110181 - DNA, 1050 bp, Homo sapiens
ccaccacgtccggctaatttttgtatttttagtagagacagggtttctccatgttggccaggctggtcttgaactcctgacctcaggtgatccacccatctcagcctcccaaagtgctaggattacaggtgtgagccaccccgcccagcagtatgtgtcacttttgtctactcagaacatagtggttcgtacttataattgcagcactttgggaggccaaggtgggaggattgtttgaggccaggagttcaagaccagcctgggcaacatagggtgaccttgtctctacaaaaagaaaaaaaaagaattatgtatataacaaactttaaaaaggatcccacttaatttagttgtcatgtaaactatggttaaataccttttctagaaaagtgataatgtattttaaaaatttaatgtatcatttagcctggtaatagaaagctcactaatctgatacagtagtatctttctcaataattctctattctgatacctaggttcttctgtgtggcagttcagaatgatggatcaagctagatcagcattctctaacttggtaagatattttcagttgtatttctgtgtctgcaagaatgtgaaatatacaagcatgactttaactgagtaagcatgaaataataaccccaatctattatcaggtattcatttacatttgaattggtagtcttgaggcataactgatctcacaaagagttcagccttcagtagggttaattatggaaagtcttggaagaattctcagagtggttctgggtgtggtagacggggacagcttagtagataagacgaattaaagccctgatcaaaatgttttagtaggagaagtaaaaagcaaaggcttgcggggcgctgtggctcacgcctgtaatcccagcactttgggaggctgaggtgggtggatcacctgtggtcaggagttcaagaccagcctgaccaacatggtgaaactcggtctctactaaaaatacaaaaaaaaaaaaaattagctgagtgtcatggcgcatgcctgtagtcccagctacttgggag

SEQ ID NO: 110182 - DNA, 1339 bp, Homo sapiens
cagagtttcacgcttgttgcccaggctgtagtgcaatggtgtgatctcggctccctgcaacctccacctcccccaggttcaagtgattctcctgcctcagcctccccagtagctgggattacaggcatgcgccaccatgcccggctaattttgtatttttttggtagagatgggatttctccatgtttggtcaggctagtctcaaactctcaacctcaggtgatctgctcgcctcggcctcccaaagtgttgctgggattacaggcgtgagccaccatgcccggccatcgctttgtgttcttaaaattaatttaaaacaagaaaacttgaggaatgatggttcagatgagtgttaaaacttgcaagatgttttttcctagaaaaggatgattaaaattggttcagggtggggccttccagttctggctctaatgattgggtccttactgttctggtggagtggtagtgataagctttttgtaacagaaggggcaaaagattgtgcttctggctgggcgcagtggctcacgccttcgatttccttgggatgttcttatcaagtaactaatcttagcactttgggaggccaggtgggtggatcaccctaggtcagaagttccagaccagcctggccaacgtggtaaaatcccgtctctactaaaaatacaaaaattagctgggcatggtggtgggcacctgtaatcccagctactcggagtctgaggtgggaaaatggcttgaacccgggagggggaggttgcagtgagccgagatcctgccattgcactccagcctaggcaacaagaccgaaactctgtctcaagaaaaaaaaaaagattatgcttctaagaatatggtctattgcatatggacactggtttttaaagcttgaatttaaaaagaattttttgtaataggttttagagctttttctttttcttttttattatttttttgagatggagtttcactccgtcacccaggctggagtgcagtggtgccatctcggctcactgcaacctccacctcccgggttcaagcgattctcctgcctcagcctccccagtagctgggattacaggtgcccaccaccacgcccatctaatttttgtatttttagtagagatggggtttcaccaccttggccaggctggtctcaaactcctgacctcgtgatccacctgcctcggcctcccaaagtgttgggattacaggcatgagccaccgtgcctggccagaaagctttttcttaatgccagttataataccctttgctttacaatttgcgtatacctcacagcttgctttgtgccgtgtgtgtttaatatgccctaagtgt

SEQ ID NO: 110183 - DNA, 1004 bp, Homo sapiens
cgtgttacaggcattaattagatacgggtttctgtaaacttacccttcggctctggtacaacctgatcttgccatgctctgcctgttcgccttgtgtgtggattctgttttctcaaggcagaatccgactgaacgccgcaggtgttcacattaagaatattgctagcagttctcactacaagacgggagccataggagtgacttatttgtgaaagatacttggagattagcggtgtggtcagagggctgtgctggattgatgggcgccggagaggccgattgtgtcacattctgctggacagttcttttaaggttgggagggtgggtaagaaaatacattctgattcggctcttttcggataacgctttccctctgcttactgcttgtagagacctcacttacccgggggactggattctgcagctttttccattttcttccccgttgataagaggattaaagtaggaaattgtatttggctaccccatgcttatatgctaagcttactgtgaaaattaaggttaggctgtctagagtacttgtggaccctgctggttccccccgccccccggccctgaattttgggttacaatatgcttctcaagaaaactcagagttaagataatttttgtcatcgattttgcaaggttatatatagcatagcatccttcaatttcctttggatgttcttatcaagtaatggtggctgtaaacctagcctgtgttgaagattgttagatagacagcagtttggctaactccgccctaaggcgaggcagttacttgcctctgataatgtatttaaatgtcatggagcaagattcccagctaaacctgaatcgatcacaatgctagttaaaaatgaccctcggctgggcgcattggctcccgcctgtaatcccagcactttgggaggccaaggcaggcggatcacctaaggtcaggagttcgagtccagtctgactaacatggtgaaatcctgtctctactaaaaacacaaaaa

SEQ ID NO: 110184 - DNA, 1006 bp, Homo sapiens
tggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaaggaaagaaggcccagtgtgacatcacagaggctgggggacctcagcagaactgtctgcagccctgctctagctgcctccggtgacaggcacttcca

SEQ ID NO: 110185 - DNA, 1049 bp, Homo sapiens
agtccaggtctggagaagagaaagtttcatacccaaccttgtggtctttccttcggtagtacattcgtgtcagcacagtcattagaaaagtctccagtatgaggaggtggcaattcatcactgcagtgtagggtgaaatacagcgtaggttatgctgagttacagaggtggtattttactagcagcccgggcacgggagttgagcaacactttctccagtttatccccaaatcaggacttagggatacgaaattgtcataaataacacagcgggttaatggtagagccagaaccggaagttggctgtctacttctgtgctctgaggctggcatacagtccatttcttatgtgtgttcaatcaacatgggcttctgttttttaaccattcccattcctctcccaggagctgaggactgaacccatggcttcctgggttggccctcagggctggcctcaagctgtggggtttcacttctcttctgtgtgatcagagaggtcatagtttccttaaagcctctgttgggatttcccgaagatcccttctgaacactctgagcagaagtcaggctggcctaatgtctgttctggggccccttctttcctgactctccccgtctcatccatcccacgatgggacaggaggcttaacgtgctcaccttgagacctggttttagaggaatagggaggcgaacaagcaatctgcccaccgttggccaagactgagaagatggagggctgtagggcagtcaggatgaggagaacctgcggaacataaaagagaggcaagggtggactgggcctgccctcacggcacagaacgcagccagcccactgccgggccttgcccttccgctgggcaggttccacccaccgtcagatctgtgcagtcacagagggttgaggctctcacttcattaaaaatctgtgggattttcatctttaggcaaatgacattcttattttctacccagtagtttattagagtttctgacaagatataagaactgattaaagggttcatttttaattccctttctcagccatggc

SEQ ID NO: 110186 - DNA, 1354 bp, Homo sapiens
acagcctctctaacacacatgaagtatatgggtaccagcaaactaaacctggagagaggagcttcaagctcctcgactgtgccatctggcatttattcactgcttgtagctgagtttctgtggtcacaggagcagccgtgacttccgttgtccactttaaaacatttgctttagatttcagtttatcattttgaattaactggagtacaaaagtctgccaaggaaatgttaggtggtccagtccagtgtgaataaaacaggaaaacatgtttaaggacttaattgatgcagacacgcacagcaggtttatttcagagtcaaagatcttggtcacctgttgtactgtcccttctccaaagtatgaacatactgtttagtgagtgttgctcctgaaggtatacgctgcattaggaaaagcgttatcacccaggttcaaccacctttagaagacttttttccagttggggaagatggttgcagtcctaagcagtgggagaagatgggagaggtcggtggctgaggaggtgctaagcaaagaggactccaacacacaatttatgatgtggtgaaccagtttgcagtgatgagctcacacacaacttcaaaggcttcacggtgatgaacgagaatgagcgctatgacgcagtccagcactgccgctacgtggatgaggtggtgaggaatgcgccctggacgctgacacccgagttcctggccgaacaccgggtaagaaactggacacatattcccattccttgtttcagaatcccctcaactctcaaagctgctggcacgtaggctggttttccactagccgtgttttacttctacctcttatgtaagtttcgtaggagatgacagtgatattactagtgataacagtcacccctgacgtttatatggggctggatggtttgcaagcacttttacatccattctattccattttctgcccacagcaatcctgtggtgtgtttgtcatttccgctttacatatgagtaacaagggctagagaaaccaaataacctgctccaagttacaccattggcagggctgggaactgaactcgccacaagttacaccactggcagggctgggaactgaactcgccacaagttacaccactggcagggctgggaactgaactcgccacaagttacaccactggcagggctgggaactgaactcgccacaaattacaccactggcagggctgggaactgaactcgccacaagttacaccactggcagggctgggaactgaactcaccagttacgagaccttccccccacaccataggcacatctacccttagaacatgccagtctcctgagaatatccatagccccagg

SEQ ID NO: 110187 - DNA, 1029 bp, Homo sapiens
ccttcacttcttgaagaaggaaaaagtcttcctgattgaaaattggtggctgggtgaggtggctcacgcctatgatcccagcacttttggagaccaacatgggtggattgcttgatcccaggagttcaagaacagcctgggcaacatagtgagacctcatctttacaaaaaataaacaaaattagcctggtatggtggcaggcacctgtggtcctagctactctggaggctgaggtagaaggattgcctgagtgtaggaggtcgaggctgcagtgagctgagatcacaccactgcactccagcctgggtgatagagtgacaccctgtctcaaaaaagaaaaaaaaaattggaaagatctgagatggtgttagtttcagttgcctgtgctgctctcattccctctttagtactaacattctggatgtgtgtgtgtgttgtatttattttttaggacagtttattctgcgttgtagcagcatttggctgtttctactactgaatgaatctttgaaaagctggtaaaagacatgaccatgaagaaatctgaactttttaatattgttaaatatcttgacaaaataaagatgttagtagtttgacaactgaatctgttgtgttttaggccttatatttttaatgttttgattttgttacactatgttctgtttctttctttccttccttctttctttccttccttcctctctctctctctgtctctctctctctctccctctctctctctttctctctttctttctttttttttttgagacagagtctctctctgtcgcccaggctggagtgcagtggcacaatctcggcccactgcaacctccgcctcttgggttcaagtgattcttctgcctcagcctcccaagtagctgggactacaggcaagtgccaccacgcttggctaatttttgtatttttactagagacggggtttcaccatattggccagactggtctcaaactcctgacctcatgatccatccatttcagcctcccaaagtgttgggattaca

SEQ ID NO: 110188 - DNA, 1027 bp, Homo sapiens
ttgtggccccgacccaggaactgactcagcgcaagaagacagctgactccctgtgattccatccctgatcaatcagcactcccggctcactggctctccacacccaccaagctgtccttaaaaactctgctccccgaatgctgggagagactgatttgagtaataataaaactgcggtctcccgcacagccggctgtgcgtgaattactctttctctatggcaattcccctgtcatgacgaatcggctctgtctagacagcgggcaagtgaaccccttgggcggttacagcctcaagtgatccaccggcctctgcctcccgaagtgctgggattacaggtgtgggtcactggcacctggccgtctcccaaatctttcagcctcaggaagccttttgtggcatgactggttttctcagcccaggccctgttcgtcatttatgtcctcagactcccatttgctcctccctaggagcatcaccgacaaagtaacagcaagtagctccatctccagtagagccacactccgcggttattaacacgtctcaaagaggtgaagcttcagtgctttcatggcagcgaccgtgcctctgttgccctaggaggctcgccacatggaaatgaagagatagtcccaacgctagccttacgagacccgtttatctcaagtacatgatttcttaaagaagtgtcttgttcagccgggcgcggcggctcacgcctgtaatcccagcactttgggaggccgaggcgggcggatcacgaggtcaggagatcgagaacatcctggccaacacggtgaaaccccgtctttactaaaaatacaaaaattagccggttgtggtggcgggcgctgtagtcccagctactcgggaggctgaggcaggagaatggcgtgaacccgggaggtggagcttgcagtgagccgagatcgcgccactgcactccagcctgggcgacagagcgagactccgtctcaaaaaaaaaaaaaaaagaaagaagtgtcttgtccataagataatcattgaa

SEQ ID NO: 110189 - DNA, 1027 bp, Homo sapiens; identical to SEQ ID NO: 110188

SEQ ID NO: 110190 - DNA, 1027 bp, Homo sapiens; identical to SEQ ID NO: 110188

SEQ ID NO: 110191 - DNA, 5397 bp, Homo sapiens
ctgagatctaattcctggccaggtgtggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctatctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtattagttttttttgtgttgttgtttttacaagataagactctggatattactttcagtaatacaattgagattccaaaagcttgccccctcacgttctcatttaggtcagttactattgattgacaaaggttactttgtagtcccgttgttatgtgtaacgtttgctagccttttttctgctctttgtggtatgtcaaacattcatggtaaacactctgtaaatattagtccagttgttacagaaacattgggtaagctaggcttgttaggtaagtatgattctgtgtttgacatacttgggcgaatattcagtgtctgttctttcagaccagcagtaattactaatggttaattaaggacttagcttaattgaaggaaagataattactaaattaatgggcaaaaaggagatacgattatatggtatgacagaaattgttattgctgctggatgcagtggctcatgcatgtaatcccagccctttgggaggctgaga

SEQ ID NO: 110192 - DNA, 4684 bp, Homo sapiens
ccagtttctgagaaggcaagaagagattcagtgcacaggtggcaagattgggtgtaggcagaatgaaggacatatcttccttgataaaagggagaaaggaaaacggataaaatgttttaaaatgagaacaataatttaattttatgaatagtgactgggtatatttattggggagccaaataataactgtgtatttcagtatcacttaatggctgtaagtaattggggtcagatttatctccccgtccaaaggtttatattggcccttccccaagggcaagctttggttatatgaaagaagaacttacatttaatagctgatctaatatgattaaaaagagaatgttttctatttaattcactaatatgctctttcctctttttccgtctaatggctttgtctttctcttgtttttataggctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcagggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaagaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatag

SEQ ID NO: 110193 - DNA, 1231 bp, Homo sapiens
ttgggaggctgaggcaggagaatcgcttgaacctgggaaggctgaggttgcagtgagccgagttcgtgccactgcactccagcctgggcaacaagagtgagactccatctcaaaaacaaaacaaaacaaaacaacaaaaacgtgtgtgtgtgtatatacacacacatatatatatctccattccaatttggctgtgtaagacacagtccttgctcttaaagtagaagggatacagtcagcagaacataataatgaatggcaagctattatatttcttatgccgtttgacttgttttttggtttaacttgttctttttcctgtgttttatgactccatctcacaggagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggtaagttacatttagacatactttacttcaaacttagatattggggccgggcgtggtggatcactgaggttaggagttccaagaccagcctcgccaacatggcaaaaccctgtctctactaaaaatacaaaacttagccaggtgtggtggcacgtgcctatagtcccagctacttgggaggctgaggcaggagagtggcttgaaccagggaggcggaggttgcagtgagctgagatcacgccactgcactccagcaaaacacttgagtaattgctgaatggctgtatttatttacatatttatttaaactaatattctgtcttaaactcctgtatcccgttttttttttttttttaaacccttcctttaggaccaaaagcacagctgatgttgcggtatccagatggaaaaagggaacagatcactcttccagagcaagctaaactgctagtaagtacaggcttgctttggttcagttccgaccactgcaata

SEQ ID NO: 110194 - DNA, 1849 bp, Homo sapiens
gttggccaggatggtctcaatctcctgaccttgtgatccactcgcctcggcctcctaaagtgctgggattacaggcgtgagccaccatgcctggcccataatcttaatatattgtgatttattaagatgtatatggttgagagttatgaatgacatagttgacagataacttgagcaggaagaataatacctcatctgaactgggaaaggaggaggaatgggtcaatatgtttatggtaaatttccagagagtgctggaagtgggaagttgaaggagttcaaaccagatttattttctttttagtgtaggagtgagatcttaatacataggccggaggtatatttggagagctaattgatgttggtgtataagaaggttatagttggttcttttcttagaggctgacttttttttttatatcaatgatttaacaggtttatcatgacagtgaggaaggtcagagatacatacagttttataagttaggggatttcccctatgtttccatattggacccacggacaggtaagatttatatcagcacgcagcttttaacctattacttgtctttcagttacctaaatgattgatctttaatatttgactggatctgttttcagaattgcagtaatttaggtgaaggtttcgtttttttccctttataattatttaaacatctattgatgtatgtatttaggacatctttttctggcaacattgggagatggtagtattttatgtttgtgcagttctgttcttttgaagaataactgatatgttcatcttaccttttttaagggattttttaaaagtttttttaccagctgggcgtggtggctcatgcctgtaatcccagcactttgggaggccgaggtgggcggatcatgaggtcaggcgatccagaccatcctggctaacacggtgaaaccccatctctactaaaaatacaaaaaaaattagccgggcatggtggcgggcacctgtagtcccagctgcttgggaggctgaggcaggagaatggcctgaacccgggaggtggaggttgcagtgagccgagatcgcgccactgcactccagcctgggcaacagagtgagactccatctcaaaaaaacaaaacaagacaaaagttttttttatcattaaaatattaagattgcccagatactagttgtaatcccacctgagaagcagagggtggagctggttttattaattgatggtgttttatatagatattgctttgtctgaatctcttcttcctaaatggcagtaagtgatagcagcagataagatagttgccctatcattacgggtgggaatctgttaggtgagtataattgatgtgacttctaggttatgaagacactatgtagcataagctggtggagaggatatgtctttacagtacactttatgcatgtgctgaaagagatacttaatgagaatgttcagaaagatcctagatattatatttacagatcctggtttttaatgtatgcatatgctgaaagagataatgagaatgttcagaaagattctagatattacctttatagatcctggtttttaatctatgcatatgctgaaagagatacttaataagaatgttcagaaagattctagatattacctttatagatccaggtttttaatctatgcatatgctgaaagagatacttaatgagagtgttcagaaggattctaggtattatatttatagatcctggagaatgttcagaaggattctagatattatatttatttatagatcttggtttttaatccttaggtcagaagctagtagaatggcaccagttagatgtatcttctttcttggaccaagtgac

SEQ ID NO: 110195 - DNA, 1026 bp, Homo sapiens
gcggcgggagaatcacttgaactcaggaggtggaggttgcagtgagccgagactgccccactgtactctagcctgggcaatagagttagactctgtctcaaaaaaaaaaaaaaaagaaagaaagaaagaaaggagagagagagagagagagagagagaatcagctattataacaaataactggataaaagagaaatgagttcatttaaatttgagcagtgcttgaaatggacagtatagctataaatgcatatgcgaagtaaatatatagaatgtataaatgctgaaaactctagatgtcgtatctggcaaaaacttagtatttttaatgaaagacaacaacctctgaacaactacggaaacatctgtcactaagtagaaattatttctaacaaatgtgtaactttactcttgcaggccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtgagaaggagagttaatcagaagttttgtagaattttacttttgtagtgtgggttgttgagggaaaggaattgggttataatgaattaagacatttaaaaaaaggtaaagccggctgggggcagtagctcacgcctataatcccagcactttgggaggctgaggccggcggatcacctgaggtcaggagtttgagaccagcctggccaacatggtgaaaccctgtctctcctaaaaatacaaaaaatcagccaggtgtggcagcaggcacctgtaatcccagctactcgggaggctgaggcaggagaatcacttgaacccgggtagcggagactgcagtgagccaagatcacaccattacactccagcctgaacaatagagctagactccatctcaaacaaaacaaaacaaacaaactgtactgttcagtagaaatatattgtaagctgtacacataattta

SEQ ID NO: 110196 - DNA, 1006 bp, Homo sapiens
tacaggcttgtgccaccacacccggctaagttttgtatttttagtagagatgaggtttcaccatgttgcccaggctggccttgaactcctgacctcaggtgatccgcacatctcagcctcccatagtgctgggactacaggcatgcgccactacacctggctaattttttttttttgagatggagtctcacactctgttgcccaggctggagtgcagtggcgcgatctctgctcactgcaacctctgcctccagggttcaggctattctcctgcctcagcctcccgagtagctgggattacaggcatgctccaccatgcccggctttttttttttgtatttttagttgaaacggggtttcaccatcttggccaggctgatctcaaactcctgacctcaggtgatctgctgacctcggccatccaaagttctagaattatagacatgagccaccgcactcagcctctcccatgttacagttagtttctgaatatgtgaagaggttactttgattaagtgaatattttcagttaattttctttgtatccttgggatagggaataccaccaagtcttaagattcctcttatctccctttgcatttttttttttcagagtcaacattagatctttgtatttgaggtcaagcatattgacagcaattccttcaattgacagaagtttgtgtttttttttttttttttttcagtgtgattcatgattatggctaactgaaactttcatccttctgtattatagttcggcaagaacaagaattaagaaatggaggagctatcgataagaaattaactacccttgcagatctattccggccacccattgatttgatgcataaaggcagctttgaaacagtaagttgttggagagtcagtgccttaactatgaatccttttgcattttcaatgcctttttttaaaaaattacttgttttagagcaggtctcgctctgtcgtccaggctggactgcagtgacacaatcatagctca

SEQ ID NO: 110197 - DNA, 1046 bp, Homo sapiens
atgaaaaccttaatatttaaaaaaaaagtccaggcatggtggctcatgcctgtaattctagtactttgggaggccaaggcaggaggatggcttgagcccaagagtttgagaccagcttgggcaatatagcaaaaccctgtctctacaaaaaatacaaaaattagccgggtgtggtggtacgcgactgtagtcccagctacttggcaggctgagatgggaggatcacatgagcctgggaggttgaggttgcagtgagccatgattgtgccactgcactccaacctggatgacacagagtgaggcctcctgtctcaaaaaaaaaacaaaaaacaaaaaaaacacaaaaaaccacctaatacagaaacttgaatagcaaatattcatagttgttttgggagagcatatttatcctcattgtataaaacatgttttctcaattgtgttgaaaaatagttttgataaatgaatatcttttcctaatgaattgccctatatataacttggcttagatagtttgtattgctaattgattaacatttgataatggctcctaattcctaaagtgtgattttctttattcacttttttctgttccatccttccattcttggtagctgacagtcttggtacagataccctcagataatgtagtaatcaagtcttttcgtgtaaggacaagtgtactacttaatccacccctctaattgatgcatttcatcagattaaagtttgtttatagaacaactgagttgtctgagattgagacaattatatatatatacacacacacacacacactgtaaagcgaggtataacaataatggaaagttttgtttaggtaaaagttttctttctttctttctttttttttcttttctttttttttttttgagacggagtctctctgtgtcgccaggctggagtgcagaggtgtgatcttggcttgctgcagcctctgcctcctgggttcaagtggattctcctgcctcagcctcctaagtagctgggactgctggtacactccaccacgcccggctaattttctt

SEQ ID NO: 110198 - DNA, 1050 bp, Homo sapiens
taccaggatatatttttatttccccaaagttttgagcttaaagtaaaagggtggtagagtgtgagtttagatgaggaaaggttaaagggctagctgtgaagttcctaaataggaaaagtacctaaaaagcagtgtttatagtgaagcattatgttttaattacatatgaagttatacataaatagagatttttctctttttttgttagtcttcaaaattttgtgtataattttcacttgtaatacatctcaggctaggtgtggaggctcacacctataatttcagtgctttgggaggctgagatgggacagctatcttgcaggaatctacttctccagatttgtacttcatttgagatcatttaaatttctgccaatttgttctttttctacttttctattcttgttatgaaatattgcaagtataccaaaacgttcagagaaggattgctctttattaatcacttttaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattgtaagttttaggagggaacgctaaggtatggtcatcccttggtatgcgctgctgcagaacccgctcatgggaagagtcagctccttgtatttccaggttctgcatcccacaaatattgtcttttccaccccaggctggttggatttgagtgtttggaacctgctgatacggaaagctaactattaacattccgattgctttgactgtggttttcaaagaacagaagagatggcgttgccataattagaagctattgataacatttttgctttacttaaagtaaaattgttttgcatattgttacatatttgctctaatccaggtttttggggttttttgttttttgagacaggtcttactctgtcatgcaggttggagtgcagtggcacaatcacgact

SEQ ID NO: 110199 - DNA, 1010 bp, Homo sapiens
gtattcctgtttgcctgaccctgagagcgcctttttgcttcaagacgtgttggatgctcctgttctccgaattctgatacgcttctgggcataatactgaaacacaaaactgcttttgctctctctgtggttggccgaaaataggattctttttcgtgcaggtgtcgttgtttagtcggctttactaacatattgaaatggctctacccaaagacgccatcccctcgctgtccgagtgccagtgcgggatctgcatggaaatcctcgtggagcccgtcaccctcccgtgtaaccacacgctgtgtaaaccgtgcttccagtcgaccgtcgaaaaggcgagtttatgctgtcccttctgtcgccgccgggtatcgtcgtggactcggtaccatacccgaagaaattctctcgtcaacgtggaactgtggacgataattcaaaaacactatcccagggagtgcaagcttagagcgtctggccaagaatcagaggaagtgggtgagtaaaccatggcgtgtttgttggccaaaagccgcaagtctttgaaaaggtgaatcatcacttttccatttaaaaagtaaaaacaaaccaaaaaacccgactagtatttgtctaaatagttctcagaggttagggggtttatgggtccccaaatgtcgatggattataaagtcaagggcaagattttgtccattgtcaaaatgcccgcgctgtgttcgatgggtgtttgttgtgttaaaaattaaagaattgcccgtctggagccttcttttttttttttttgagacaggatctcgctccgtcctccaggctggagtgcagtggcgcgatctcggctccctgcaacctccgcctcccggtttcaagcgattctcctgcctcagcctcccgagtagctggggttacacgcgtgcaccatcacgcccggggaatttttctgttttttagtagagacgggatttcaccatgttggccaggctgatctcaaactcctgacctcaagggatccg

SEQ ID NO: 110200 - DNA, 1307 bp, Homo sapiens
tgacctcaagtgatccaccagcctcagcctcccaaagtgttgggattacaggcagtaagccactgtgcccggcctagatagttttcagatcaacaaaggtgaatctgatttgcaaccagggttatgaaccactggtctcagaagacgtagctttgagggaagtggccacagtcaatgatgggaagagacaatgggaatacacagtgggatagtagagatgaatgatgtttcataaacataaacaaggatgccatgaccctgggaaataacattttttggaaaataatttttaaacttttgaaattatttttttctttttttgagacagagtctcgctttgtagcctaggctggtgtgcagtggcgcgatcttggctcgctgcaacctctgcctcctggattcaagcgattgtcctgcctcagccgcctgagtagctgggattacaggcgtgagccaccacgcccggggaatttttgtatgtttagaagagacggggttccccttttacctcgttgcactcctgagagcaagatgggtcaccagcagctgtactggagccacgcgcgaaaattcggccagggttctcgctcttgtcgcgtctgctcaaaccggcacggtctgatccggaaatatggcctcaatatgcgccgccagtgtttccgtcagtacgcgaaggatgtcggtttcattaagttggactaaatgatcttccttcaaagggttatccaaggcatctactcaatgaaaaaccatgatcattctttgtacataaaataaacatttgaaaaacccaaaaaaaaaaaaaaaaaaaagagatggggtttcaccatgttggccaggctggttttgaactcctggtctcaagttatctgcccgcctcgtcctcccaaagtgctgggattacaggcatgagccaatgtgctcagccctggaaatttaaaatagattgattgtaaagaaatctacttgggcaaaaaaattttaaatttgaatactgaaataataatggttccttagagccataaagtgtttattaacaagaaatacagttgataaaagatatgtatgattgcccaacttacatagaaaagaaaaaaatggaaaaagttcaggtggtgactagtcaagttaattgattattaaggatatcaaaatctctgggcggggcgcggtggctgacgcctgtaatcccagcattttgggaggccgaggtgggtggatcacctgaggtcaggagttcgagaccagcctggtcaacatggtaaaacccccgtctctattaaaaatgcaacaatcagctgggtgtg

SEQ ID NO: 110201 - DNA, 1049 bp, Homo sapiens
gtcaattaatagaatagaaactagatacaggaaggagaagcgggctgaaataggaaagccttcttggaggcaccaggactgagcttaagccccttggatgggtaattgggtaatgtgaaaggaaaggaaggcattccagatggaaagcatttcaatgatagtccagatcgagtttatttagttgataggccttttgacctataaccagcatagactaaaactagcaaatttgataatctttggttttacttgaagagatgagagcagaaaaacctttagaaactggcagctgcttaacaattacactttaatggagtttattaatcaaaaattattcaggatcttgtttaattctacctaaccgcactctagttttagtcccggggtagcattccactggcatgttatggcagcatttgattattttttaatactgctgagaacgtgcactactgctcattctcagactactttaacgattttattagaagctgaataagcatgatagttgagcaaattggctagcattttgtatgactgtgtaatttcttcttatgtaaaggtgatgctgtggagtcttcaaaaagcccgaccactctggattacaaatttacaggaggatgaaacagaagaaatggaaggcccacagtcacctggtcagctcttaaaccctgccctagcccattctatctctgtggcttcgtgtggtaatatttttagttgtggtgcagaagatggtaaggttcgaatctttcgggtgatgggagttaagtgtgaacaggaactgggatttaagggccacacttcaggggtatcccaggtctgctttctcccagaatcctatttgctgcttactggagggaatgatgggaagatcacgttgtgggatgcaaacagtgaagttgagaaaaaacagaagagtcccacaaaacgtacccacaggaagaaacctaaaagaggaacttgcaccaagcagggtggaaatactaacgcttcagtaacagatgaggaagaacatggcaacattttaccaaagctaaatattgaac

SEQ ID NO: 110202 - DNA, 1024 bp, Homo sapiens
cgatggcggcgccggccccgggggctggggcagcctcgggcggcgctggctgtagcggcggcggcgcgggcgcgggcgcgggctcgggctctggggccgcgggggccgggggccggctgcccagccgggtgctggagttggtgttctcttacctggagctgtccgagctgcggagctgcgccctggtgtgcaagcactggtaccgctgcctgcacggcgatgagaacagcgaggtgtggcggagcctgtgcgcccgcagcctggcagaagaggctctgcgcacggacatcctgtgcaacctgcccagctacaaggccaaggtgagagagccccgggccacaccgctgcccccagtcccgctccccggcgtcgttcgcggtgtttctcatccgagcttctgagtcagaagcttcgcctcaccagcccgcctttccacggctccagtcagtatcttcctcacctccccccaagataaagattctcttttctttggatcgaagttctgctccttaacccatcccacttccgtgatccacttttcaaacaactaggtagtttgcctcactcattcaacttttgacagttttccccgttaaagacagaccaccactcttgtaccttttaatgccctcatcctacttttctccccggcctccagatagacttcattatattaaataatcccggccaccttaacatgggcttagtttctaagtttctaagtttctagtttgctttcactccacgtttatctcatcttttccaagctctgatttttaaccatttgttttcattattttcccccaagttctctttagttccctccactatattggaggcttacaagtgagtgtagttctagtcatcctgctcacttacaagatacaggcttttatagaacgtccacgggcaccacctaacatactgctttgtcctgctgttattggctgtttccttgctaactttttaatagttccacattgatggtgtctctctttttctatttgtcatctaacgtgctgat

SEQ ID NO: 110203 - DNA, 1008 bp, Homo sapiens
accaatcactgttcattcacacattgtaggacttcccttgaatattttgaggataaaagattaattcaaaaggagtcaaatagtctagtaggaaatctttcagtctagtagaggagagaaaaatgtatagaaagaactgctaatgtgtggtagaaattgctccttactgttacagacataaaaaagtatactagaagttcagtgaaaggaggaatttacaaactgagtggaggattggaggagatttgaggttgagcttatatttgagctgaattttaaagatgaggaggagtttagtattttaggaagaggaagtactctgagcagaagcaggacaagaggaaagtaaagggtttgtacaacatatatttttatttaaaaaaatgagtgccaggcactatgctcatttgcagatgcaatggcaaataaaacaaacacagtctcttaatggatgtcttgccttatggagcttacagtctagtaggggaaatggatattaatcaaataatcacacagatgtaaaaccgcatctggtaagtagtatgaaggaaaaatacctagtgctctgattgtcagtagtggaggatttaacctggtggagaggtgagggaaggctttctcagatccatgtactgagacctgaaggatgataagtaggcaaaggggagagagaacagccttccaggagggaaccttatgagtgtgagggatggaaaatatgtcaatgtggctggagcacagagagcaaaggtgatgctggtttgagataagatggaagaagtggactgggaccaaagcgtagggaagccattttgagttgtaagcaagaaggatttgaggtgtggggattggtgatatgattattttgcattttaagagattatttctgactttagtatggagaactaaattgttggttggaagaggaccttagaaatatggtagatcaattaggaaataggtagtggaggagatagaaatgggcagatttagtaagtaaaatctata

SEQ ID NO: 110204 - DNA, 1050 bp, Homo sapiens
ccacacccagctaatttttgtatttttaatagagatgggttttcaccatgttgcccaggctggtcttgaactcctgggctcaagcaatccgcccgcctcagcctcccaaagtgctgggattataggcatgagccactatgcccggccagatgtatgtcctttttttatagatgtttcttcctgactagaaagcttcccttctgatttttctagatagctttcaggataatattcttaatattttcaacttcttgatttgtgtcttgtttcttctagctacacccttggcagattttcttctaaccttttgatatctgtttgcagataggagaaagaattcgagtcatcttggacatggaagataagactttagcttttgaacgtggatatgagttcctgggggttgcttttagaggacttccaaaggtctgcttatacccagcagtttctgctgtatatggcaacacagaagtgactttggtttaccttggaaaacctttggacggatgacagtggctttcttgtgatgacagacagaatggaggagagatctgcttatgggaagtagaaccatgaagtgactgtcacacatgcatgtccaagaaacatcctgaaaacacatgaagtcgtaaactggagaagcagctctacagcagagattatcttcgtgtttcctctttctactgggccagaaaaatcctcagggttgcagttggttgagtgggcagttgacatatgcatgttgcacccgatgttgtctctaagttagcaatgtgttatttccagctttaaaggtgagattgtagagatgctgtcaaagggataaggaaatagcaagatttttaagtagtgtgtttgtgaagactgatcccattttacaactgcctgttctttctccagtccttttttttccagccagcttgactattagaaaagtatgaaactggttgggttttatttaatatttttaatatattgagaagcatggtctgcctggactgcacttctctaaaagtgagatataaaattgtgcagctattttaaaagttg

SEQ ID NO: 110205 - DNA, 1062 bp, Homo sapiens
tcactaaaacccagtagtagctctacaaaatcttaaactgctgcagtgctcaaggagatggaatatctttgtcattggtgctgaggagagcatttcggtagaagacagttgcgcctgaagattgagtgtaaatcattcaaaccagtggttctcagtgttggctgtatacactttgtagtcactttggaatgttggaagacacatcgatgcttgggttccgtatgccaagattctgatgttggtctggaatatgagctggtcataaggatttttaaaaactttctggtcatttcaatatgctgccaaggttgagaaccactgttgtaaaattcaccttgagttttctcatctgcaaaatagaaaaaaaaaaatccttgctccctcccttcactacctcacaaggatattgagggtaaaggagaaaataatgggaaagtgcttgtgccgtggatgaaaagtgctattaaaagtcaaaggagtgttctgtttcaattcatagtatgatcagggaaagtgtaactgagtatactttgttgacttgggaaacctggagcactttctttggttggttaacgaagcatgcagatgtggaagcagacgttactattatccctactatggtcttctgtcatactgagacaggctgttttaattacctggttttacataggaaagaagaaatattaaggcttaaagtttgtaatgatcaatggctcataattcattaaatcttttcatacaaggaatttgtggttaatgtcatttcatagttgccattattttctcattatttgacttaaatgttaagccatttatttcatctccctcattcacataaagtgtagatatggattcaataagacaccaaaagaaagtaagatttacccagttaatatttaaaatcattgttcagtgattaggcattttctgccttttagaattatttgactggagaaagagtttcaaaaatagcagagccctaaaccataaagaaactactactgtataatgaacttttgtttgtttttggagacagggtttcactctactgcctaggcaggt

SEQ ID NO: 110206 - DNA, 1621 bp, Homo sapiens
aattgtacacctaaaaatggttaagatggtcactttcggccgggcgcggtggctcatccctgtaatcccagcactttgggaggccgaggcgggtggatcaggaggtcaggagtttgagaccagcctggccaaaatggtgaaaccccgtcactactaaaaatacaaaaattagctgggtgtggtggtgagtccctgtaatcccagctactcaggaggctgaggcaggagagtcgcttgaaccttggaggcggaggttgcagtgagccgagatgattgtgccattgcactccagcctgagccacaagagcaaaattctgtctcaaaaaaaaaaaaaaaaagataatcgctttcatgttttgtgtattttactacaattaaacattttctaaagaaaaaaaggaaagaaagggggtgattttctcaaaggggaattgaggggttgttaccagaaggagaaacgaatgtgagtgagtaggcgaaaccaaccaatttccagagcgaacggagtcaggtgctgaccccaagccaatgtgtcttttctcactttaatgcctgagggatttcagagtgaacagagtgaagaaaggaggaagtggaacctcgtcatggtcctcacccacgaggtgggcgcgaggagcaggctggtactggataggctcaatgtggccacaaagcctggtgaggtcacagggactcccctcctccagccccaacccaaaaggttgcctaaggcaggtgctgcgccatgtgcaccaagcaactttctgctgccacctccaagaaagagaaggaccgggaggggatttctcccaggagagagagcacataacgctccgtcttttcacctgtctgttctcaagcaggacctaagtgtctaaggcaaccccacacccacagtgcctggcaggggcccacccatgggtacacatcgtgttctcctaagctcatgtcactccatttcagatgtcaactggacatggactcctgctgatcctccctactgtcattcactcctctcctgctccagccctgatccctgaggtctcttctacccttgcagtgtctcccctctgtggtcctcaggcaccaaggctgagccctttccctcggccctgcagtgtctcccctctgtggtcgtcagacaccaaggctgagccttttcccttggccctgcaggctcagtggggagcagggctttccctgcctggccctggaccacctccttcaacttcagcaagttagcggtctccctgtcaccagccagcctgacaccctgagacctcctcatgggcctcggccgttctcttgttctaggttattgggcccttcctcaggtccttaaactgatgcttccattcagcttctcatctccttccaaatccccagttttcttctaggctctctggctagagaaggttagagccattttgaaggcctctgacagcccccgtcttgctttgtctccacagaaggccatggtcccatgatacactcaggggtgctgttcagaatatcaggcaccgcatggcacagctacttgggaggctgaggcaggagaattgcttgtaccctggaggcggaggttgcagtgagccaaggtcacgccgctgcactctagcct

SEQ ID NO: 110207 - DNA, 1074 bp, Homo sapiens
attatatactaggcgttgggaagacaaattggatgtcagggctaacacttacattcaagtatgtattcttaaagcatagctgtcatggtttttaacctcttttagtaggaacctataaccactgtgctagagtctattccaatatgacatagaggttacaagctagactggcctggtttaaacccagccccacccttagctggtgacattggggtcactctaggtcatagtttctccatctgtagaatatatacgtaataataatatctaccaataacatcatgctgtgttgactgatgattaaatgggttaatacatgtaaagcactcaggacagtgcctggtaggtagtcagtgctacgcgttttatccgttatcactcatattattattaatctctgctatgtttgacctccagcattctcttacagaggcaataaaggattaactacacagtagttattcaggggttaccaggcacaggaagaggagagataaatgaacagcctttcagagttcaggcaaggccctctgcttgacactttctggcccagtgggcaggagtagagaattggctgccaggaagcccaaagagtgggtttcctgtggctcttccgagttgaggactgagaattggagagtctgggtgccctccactggccctcatcacattatccatttgaccttattagaaagtggacgttggccaggtgcggtggctcccgcctgtaatctcagcactttgggaggccgaagcaggcagatcacctgaggtcaggagtttgagaccagcctgaccaacatggtgaaagcccgtctctactaaaaatacaaaaattagccaggcatggtgacgggcacctgtgatctcagctactcaggaggctgaggcaggcgaatcgcttgaaccagggaggccgaggttgcagtgagctgagatcgcgccactgcactccagcctgggcgacagagcaagactccgtatcaaaaaaaaaaaaaagaaaaagaaagtggacatggtaagcttttctgggatggccatatggtccttctacatcacttcagcggggccaca

SEQ ID NO: 110208 - DNA, 1048 bp, Homo sapiens
gtccctggcggggaacaccatcatgcggctggacgactccgtcttcgagggcctggagcgtctccgggagctggatctgcagaggaactacatcttcgagatcgagggcggcgctttcgacggcctggctgagctgaggcacctcaacctggccttcaacaacctcccctgcatcgtggacttcgggctcacgcggctgcgggtcctcaacgtcagctacaacgtcctggagtggttcctcgcgaccgggggagaggctgccttcgagctggagacgctggacctgtctcacaaccagctgctgttcttcccgctgctgccccagtacagcaagttgcggaccctcctgctgcgcgacaacaacatgggcttctaccgggacctgtacaacacctcgtcgccgagggagatggtggcccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagcacgagccccccggagcgctcaccgagctggacctgagccacaaccagctgtcggagctgcacctggctccggggctggccagctgcctgggcagcctgcgcttgttcaacctgagctccaaccagctcctgggcgtcccccctggcctcttcgccaatgctaggaacatcactacacttgacatgagccacaatcagatctcactttgtcccctgccagctgcctcggaccgggtgggcccccctagctgtgtggatttcaggaatatggcatctttaaggagcctgtctctggagggctgtggcctgggggcattgccagactgcccattccaagggacctccctgacctacttagacctctcaagcaactggggggttctgaatgggagcctcgccccactccaggatgttgccccc

SEQ ID NO: 110209 - DNA, 1026 bp, Homo sapiens
acggggtttcaccatgttagccaggatggtctcgatctcctgacctcgtgatccgcccgccttggcctcccaatatactgtggccttctattttaactatcctacgaccactggctctgtgggccagggtttcaccctcacacaggtgctatgcacttagaaggcattctttttttttttttttttttttttttcagatggagtttcgctcttgttgcccaggctggagtgcagtggcgccatctcagctcaccacaacctccgcctccgcctcccgggttcaagtgattctcctgcctcagcctcctgagtagctaggattataggcacacaccaccacacccagctaattttgtattttagtagagacagggtttctccatgttggtcaggctggtctcgaactcccgacctcaggtgatctgcccgcctcggcctcccaaagtgctgggattacaggcatgagccaccgtgcctggcctagaaggcattcttgctgaagaaattcggcggagggaaggattcatgcaggctggagcaacagggaaagcttcacaaaaggagttggagttgagtgtgtcctcaaagggagatttgtctgtgtagaagggagaggaacgagcattcctgacaatggctcctggacataggagcatttgttgggatgacacggaggaacagactctcactggaacacacatctcttcaatgaggtggtgaaatacatcatgggaaggagcctgtctgtaccagaactcttacaacctattaagtgcaattagcctcgctgtagccaaagggatgttgattttgctcagcagattgttattcaggatccccagggacagtggtgctgtgtgggcaaagcagcgtgggcagcagcagcgtgggaatgggtgtgttcactcccgaagcccaggacagataactccacttcttgtttctgtagaaagaagtgtggcaagagctgacccgaggaagaagctttgctcaataggaaatgagctatgatgatgaaatgaggaa

SEQ ID NO: 110210 - DNA, 1024 bp, Homo sapiens
aaaagctataatatcacttttcttctcagacatattctccagttgaaagtgtttaatatctctacaaagtgatttttaagttaaagaagtcaaaactgtatctgtccttctcccaccacactgaaagctcaatataaaggaatggttctacaaagtaattcattccaatcaagccatttagctacttgactataatggagataatattttcagggttcagagtttttgttctgttttggctgttgcagtagtttatggcgtatatgatgtacgtggtacgtatgtggtatatagttttcttctctctcccagattgcaccagagctgctgaacaattaaagaataatccgcgacacaagagttacctagaacaagtatccctgaggcagctagagaagctattcagttttttacgaggttacttgtcggggcagagtctggcagaaacaatggaacaaattcaacgggaaacaaccattgatcctgaggaagacctgaacaaactagatgacaaggagcttgccaaaagaaagagcatcatggatgaactttttgagaaaaatcagaagaagaaggatgatccaaattttgtttatgacattgaggttgaatttccacaggacgatcaactgcagtcctgtggctgggacacagagtcagctgatgagttctgataccaaacactcaaaacatgcattgggctagcagaatatccatgtttattaccagactggttctggaagaagctgtaaagaatactaaatatgttgggttataggggattgaccatgttacttttcaaaaccaggacatttaaagcatctactatgtaggtgcatgaggagtatgggaaaaacagaataaaggaatctgcctttaaggagcttacaatcatgccgggtgcggtggctcacgcctgtaatcccagcactttgggaggctgaggcgggtggatcacctaaggtcaggagttcgagaccagcctagccaacatggtgaaacctcgcctctactaaaaatacaa

SEQ ID NO: 110211 - DNA, 1034 bp, Homo sapiens
gtaaatatccagttgtttcagtgccatttgttgaaaagactatcctttccccattaaattacgttggtacctttattgaaaattgtgtgaatgttattggattccattccttttcattgatctttgtctatttttacaataatgctatagtggcttatgacatgaattatgaaagatctaatggatgattctgacatgttataaatatttcatttgaccttataatctacttttggaaaatgaattttgaaatacagtgttttcactaataggaatacagtgttatgttatctcatttaacagttgaatgaagagatttactttcaatgtacttgtcttacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggtacagttattaggggattttttgggagagaaattaatttaggggtgctgtagtttggattaaggaaaaatagtaggttttcttttcattttgttaaagtgtataaagtgacatttttagagatagactgggcatagtctttgacaagtgagtgactcttgtcaggaataagccaactaaactgagctagttaaatgctttttaaggtggttcatagttcagtgactaagaaaattatctgggtgtatgtgtatgtcttgagaaaattaatgattaataaatagtgcctcaacagtaactttgttaatgagaatgacatataccccaacatctgggtaagtttgatatgtgaggagaagaaactaatatttaatagatgtctatatgccagatatcttcattttcttttaaaaagaaagatcgtgtcctgcaccctttacataaattaatctttataacaaccctggaggtggaatctccattttatatatagggaaactgagggctgggtgcagcgtcttacgcttgtaatcccagcactttgggagg

SEQ ID NO: 110212 - DNA, 1049 bp, Homo sapiens
tatttaaaagaaaaaggaaataaaaatatccaattaaaaatcaaagaaatagtggtctcaccttatgacatttattttattttactatttttatttatttatttatttatttgagacagagtcttcctctgtctcccaggctggagtacagtggcacgatctcagctcactgcaaacctccgcctcccgggttcaagtgattgttctgtcttagcctccctagtagctgggactacaggcacctgccaccacacctggctaatttttgtatttttagtagagatggtttagtagagatgttggccaggctggttttgaactcctgacctcaagcgatctgcccgccttggcctcccgaagtgctgggattacaggcatgagctaccacaccgggcccatgacatgcattttcaatgtctaacttctctctctctctccataggtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaaga

SEQ ID NO: 110213 - DNA, 1123 bp, Homo sapiens
tttagataacttaggtgaagttaagattggtttttcaccatgtttggctctcttggaaacacacgcacgcacaaacacaaaacgttgccactcaaccttttaactaattctttaaagataagtcatccaagaacagaagcgtgtcatcgtcagtgggtgtgaggttgtacccatccttgtatcttaattttagtagtactctccctgggcagtgtgagcgtgatttgttgtcccttgataaataacgaactccggttgatatcattatctcacttctgcgttacaggcgatgtgtcctttctttgttttcttttttaacctttataaaaagacaaaatggttaggcctaaaattaaactacgaagagctgtgttttggatcaaggttgtgcacgtcacgttttttcccctgctgtgttcgactcttccgctcttataagtaggcaggatattgaaatgtacaagaatttgctctggggattttgtttttgtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggtatttcacttcccttaggg

SEQ ID NO: 110214 - DNA, 1019 bp, Homo sapiens
gaggctgaggccggagaatggcgtgatgaacccgggaggcggagcttgcagtgagtcgagatcgcgccactgcactcccgcctgggctacagagcgagactccgtctcattaaaaaagaaaaagaaaaagaaactgggtcaacttcaagactttaagtcgtaaaggtttccatcagtttggtataagagttgagtttccagactaatcagagggagggtgttaattgcaaattgtgtgtccaagctcttcctagtatcctttttgtgccttaacagagcagaataggaaaggaaaaaaatccctcattgcccccaaaaaataaaatactggttgttttcttctgtgatcagagttgagtttcatcacttcttcccttctagggtcacctgcctggttaagggtagtcagtctgaacattcattcaggatttcagtgttccagcctactatctctgagtttctttagtacttactccatgtatcccatgtggttaggagctagagtcctgcgtttgaattcttgctgttctactttaccctgggcaagatatacattcttttcaagacttgcttttctcacctgtaagatggggataataataataataccaatttcacagggatatttagatcaaatgagggaatgcaggtaaaggattctgtaattataggtcttaataaacgttagttaatagtctgttcttacatgctgtagagtcgatactcctaaacttagaattaaaactgccttctaggccgggtgcggtggctcacacctgtaatcacaacacattaggaggctgaggtgggccgatcacttgaggtcaggagttcaagaccagcctggccaacatggtgaaacctatattctctactattctttagtagagaatttagtattctctactaaaaataaaaatattagctgggcgtggtggcgggcgcctgtaatcccagctactcaggaggctgaggcaggagaactgcttgaacccaggaggcagaggctgcagtgagct

SEQ ID NO: 110215 - DNA, 1057 bp, Homo sapiens
ttgaggtttttgtgatcatcatgtactacttttattatataagaataaaaaaaaattaaccccaaacccctcaaatttccaggcgcttcctgttgcccagaccctgcaccattctggccccactcagcctagttttatttcccactgcttgccagctgtgccctgtgatctccttgctgtctcatgagctacgtggtacttatgttcctgttgcctggaatcccgtcttctggtcaggaagatgatctgcgataaataccgagaatactcgcgttagatactgaatagtgagagtttagactcacgacctggggtgtcatcttgaacatacggtgcttaagggatgaggtttctgggtcagttttattggttgtgatgaacaagataaatggagcatttgtcttagcttctagaatagtgaccttaaaagagatagaacagtgaatgtatcttcaaacttgcctgggtctccactagcctaaagaagaaaaaaccctttaattctgatgctgtcacagatgaaatcctttcattcactgatttattcattcaagaaataatgactcatcacctactctgggctaaacacagtgtccagtgtgatggtgatgtaatggtcaacaagatagatactcactgggtccttgcctgtggagtttatacgtagttagagaagacagacattaaaagaagaaatccagtgtgatgaatgttgagataaaaggaaataaaccaatacttgtggcagtgaagaggtatcagaggtttcctgagagaatgacatttaagctagtacttgaagtaggtgtttgccaggtggaggtggtgggcagaaagtagagtcatcagttcattctggtttgtccacggctttcctggttttagcacgacacgtcccgtgtccggggaggtcatgtgcgaaagcttcagatggcaattaaagaaacagtaagaatagaaaaaacttaaagcctgaagagggaaagactaaagtgagatgagtctagaaagttagacaggagcctgatgatgcacgcactgttgggctttacctaag

SEQ ID NO: 110216 - DNA, 1046 bp, Homo sapiens
aagttgtaactacaaggttggagtgaaatcagattggaggggtgctgtttgatacccttaatagccaagcatctgtctctgctctagaggtgcacctccccaagatatcctataatttgctggtcagaacatatttttcctctttggaattaaaaaaaaaaaaaaagatttcatgttgtctgtctttctattgagaaggtctcttagaatccattgattagaccagtagcttttggtagtaccatgatgtttccatttgacttttcaaacatttttcagctgaccattaccagctttgttgggggtaaactcaagagagttacatcttttacacattgatttttccagattttgcaaatgtcactataaatggataatattttctaattgggagttgtggcaggggtagttattactgttttttgcttgttcgtgctattttttactttgttactaattgtattttttccaattccaggccatttcataattctgaatcatgtctgataacggagaactggaagataagcctccagcacctcctgtgcgaatgagcagcaccatctttagcactggaggcaaagaccctttgtcagccaatcacagtttgaaacctttgccctctgttccagaagagaaaaagcccaggcataaaatcatctccatattctcaggcacagagaaaggtaaatagcgcttctggctttcagagtctcagcattggtttattattgtatgttacccatgttgataacttttatggtgagaacattaaaacagatcatgaaaacaatcggtgctaatatacaggcactattaaaaagactagtttattttaaattgtgatttttaaaagaataaaatgtaaatttgtttctcaccctgcttgttatggccaatgaatttctatattcatctcctttgttttctgagaccttggccatattttaatgagatttgtgacacttgagggagacctgctattataagaatggtgagatagggcccacagtcccctgtctgaaatccctggagccaactgtgtt

SEQ ID NO: 110217 - DNA, 1191 bp, Homo sapiens
tcctcgtggattttattctgtgaaacactcggttttggtgtagaagggagagaacttcagtatgtgctcagtacatcatcttgaaacagaagagtctaaaaggcaaacaattgtatttccattttttaaaaatcataatgaccttaagacttttgccatctctaatgtaaggcctgatctagagataattcattttattccactaaaaaatttacatcccttactgctttccttactaaaaaaacagctaatatttttataaaaagaaaataaagactctaggatgttttcacttattaattactggttttaattggtatcaccaaaaaactcgaaaattatccttttggatcgtgccgttttaaggcaacttgacagaacagatcttttttccatgcttgctaatgtgtgtactatgtgaataatcagagatgagtgataaagcagatagtgtccctgctcccacgacagcaatctcaaaccatggtatagaattacaagccatgaaaagtggtacagaggcagtgcacaacatgtgtccaatctgcagtgtctgggaaggcttcctaaggaggtcataatagagctgaagactgcaggatgggtaagggaaacgatagttacaaagtgtgttccatgcccgggaagagcctgtttcagtggcccacctacaggagggatcagagcacatccatggagctgagtgccgcccggtgttactggaaagcagagagggaaggacagagaattacagcagggtgtatgtaggcactacagacagcagaagaggctgaagaggtaggcagtgaccaggtcataaagggccttgtattctatgctacagagctcacattttatcctgtttcctggggaaccattacagatttttaatcaggggaaagacctggccatctctctgttttagttaggagagaatggtaggtatatagaaaaaaggttttgttcgaagtgtgagagtgaagttggaaactagttaggaggcttttgctgtagcccaagtgagaaatggcctaactagtctactagtttaaataatgaaaatgtcagtgagccatttgactttttaaaataagctttattcatacagctagagttggatggtattgtctttattaactaaagcaattttcacatctagctattcaacctataagcaccttcacttctggt

SEQ ID NO: 110218 - DNA, 1074 bp, Homo sapiens
tctgctttacttcatttactagtttcctatcagccagtttttaggggaaatcttttctagaataactttgattctagtgtgttttctagaataactttgatcctaatatgttttaggaaaaatataaacataatatgccgggcatgcggtggctcacatctgtaatctcagcactttgggaggccaaggcaggtggatcaggagtttgagaccagcctgatcaacatgatgaaaccctgtctctactaaaaatacaaaaattagccgggcatggtggtgggcacctgtaatcccagctacttgggagactgaggcaggaggatggcttgaacccgggaagcagaggttgcagtcagctgagattgcaccactgcactccagcctgggcaacaagagcgaaactccatttaaaaaaacaaaagacaaaaaataaaattataagtgcctttactagtcttgtttaaataggctgattctttctctttttttctaatgccccctaggaagtaaaaagaaagaaaaggaacggccagaaatttctcctccatctgattttgagcacaccatccatgttggctttgatgctgttactggagaattcactgtaagttaacctagttcgggcccatttataacgtttaaaatagcactcaaacattttccttcattattaaatttgaaattaacatttcaggccaggtgcggtggcacacgcctgtaatcccagcactttgggaggccaaggctggcagatcatttgaggtcaggagttcgagaccagtgtggccaacatggtgaaaccccatccctactaaaaatacaagaaaattagccaagcgtgggggtgtatgcctgtaattccaactactcaggaggctgaggcaggggaatcatttgaacctcggagatggaggttgcagtgaacagagactgtgccattgcactccagcctgggcaagaagagtgaaactccgtctcaaaaaaagggaaattaacatttctatctatacgttaactatgaattcttactgctttttgctttttataaaagtgttagtggttggatatatcgtt

SEQ ID NO: 110219 - DNA, 1110 bp, Homo sapiens
caggtcatggtggtatgcatctgtaatcccagctactcgggaggctgaggcaggaaagtcacttgaacccaggaggcagaggttgcagtgagccaagattgcaccactgcactccagcctgggtgacagagcaagattccgtctcaacaaaaaaaaacaaaacaaaagcaatatgtattgcatttataaccgaagaaaaaccaaaggtgaatctgatttcagaaaagtaacttaaggaaatgtaacatctaaaaataagaggaaagtatcaaatctaaatttaaatgggataatgataaccccagtttagtatttatggtgattttctttaaagaagaaagaatcccttagactttatggagtgctctgtgaccgtgttgagctatcttaagtggatcaaagatgttcttctatttttaggccttgtacctaatagcaactaatggaaccccagaacttcagaatccagagaaactttccccaatatttcgggatttcttaaatcgatgtttggaaatggatgtggaaaaaaggggttcagccaaagaattattacaggtaaatttaaaaatgatttcatttgggggaatagttgacttttttggtaaccgacagaaagctttcctagggctaataagtagatttcactactcattgatcaccagcggtatggcagctgctgcaatttagggtttcatcctaccatgctgagcaaactaccgcaaggacagaaaaccaaacactgcatgttcccactcataggtgggaattgaacaatgagaacacctggacacaggaaggggaacatcacacaccggggcctgttgtggggtggggggagtggggagggatagcattaggagatatacctaatgtaaatgatgagttaacaggtgcagcacagcaacatggcacatgtgtacatatgtaacaaacctgcacgttgtgcgcatgtaccctagaacttaaagtattaaaaaaaaaagtgagggtttcatctgctgtgaataaaattctgacaaaaccgtaatgtgcagtttgtgcatcgtatcaatcctcagacctgtttacagtttgtgcatcgtatcaatcctcagacctgtttacagt

SEQ ID NO: 110220 - DNA, 1723 bp, Homo sapiens
atttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctcttcttctcctttattcattgttttgcttttggagtgggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattct

SEQ ID NO: 110221 - DNA, 1056 bp, Homo sapiens
gtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactg

SEQ ID NO: 110222 - DNA, 1051 bp, Homo sapiens
tttaataaaatctaatattagcgaaggctctttagtctagaaagaaaggcaccagtcactgcaggtagagtggaagaaagactatgaaacagaagccaatattctaatttcagcttgacaacagtttactcagaagtgctgtattacctttctgtgtataagttttctctggggaaaaaaatggaggactgaacacatgtttacctcagttccctctccaaatcacactgaggttacagaaatcagtttttttttgttttttttttttttgagatggagtttcgctcttgtcacccaggctggagtgcagtggcgcgatttttggctcagtgcaacctccacctcccaggttcaagcaattctcctgcctcagcctcaccaggagctggtgtcaggtgtgaggattacaagcaatccttgcaccttggcttcccagagtgctgggattgcaggtgtgagccactgcgcctggtcgaaaatgattcttaagtttatttttctcagaggcaggtgtacagcaaatggctttttgttagactactcatgtcctccctcctctccagttttcattgtgatgaaaaccttggtcagataagatttcattgtgtccaatagtctaaattgaagtatatgtactctttttttttctcaattttctgccttagttactgtgaatatgtcttcatgaccttatttttagatagaaatataacttacttctcttctttacagctgcatccagatctcattatgcatcagaaaaatgaaaaaacagaggaaaattctatggaggaaaggaatccacttagccttttctgagaaatggaatactgggtttggaggctttaagaagttttattttcaccaacacttgtgcattctgaaagctaagctgggaaggccagttacttggaatagacagttgagacatttccagggtagaaagaaagctcttcaaatccagaaaacgtggatcaaggatgaacccctttgtgctaagaccaagttcaatgtggctactcaaaatgttagtactttgtcctctaaagtg

SEQ ID NO: 110223 - DNA, 1045 bp, Homo sapiens
cagtcatagctcactgtagccttgaactcctgggctcaagcaatcttctcgccttagcctcccaggtagctgggactagaggcatgtgccactgtgctactatacccagctagtttatttttatttttggtagagccaggagtcttgctatgttgcccaggctagcttgagctctgggcttagctaaagtaatcctctcacctctgcctctcaaaattgctgggattagaagtgtgagccactatgtctggcagctctttcagtctgtatgttaagctgcatggttatcaaaagaatgtgcctcagaaccgtctgaaaggtttataaaaccagattactgggccctgccttcagagtttctgctttaataggtctgggatgaggcctgataatttggatttctaacaagttcctagatgatgctgacactactggtcaggtgaccacactctgagaaccacagtgctaagggaacagttttatcacctcaagttactgaatgagcactttaagatcacaatatgtttaccctctaagatgagctgatataccacttacttataagtcagaaattcaaagccaaggacgcaggacctgatactctgtacagccagggtaattctgtggtactagaaataatcatgccaaggcctttttatggttactgtaacaacaggagtctctaaatccacatccttcacatggagttagttttgtaatccatctcccttgagttcaaggtaattgttacctcattttttcatagcctctttcagctttttcacctgatttagagagatttgtcaggttgcttctctacttgattggattcaggtagtctatttactgccccattccaaagctgactatagaccacagctgtaaggtcattccaataaaactttggaacagcattttctgtaaaccatgtaatgtattttctatattttgatcattattatcattattattattttttgagacggagttttgctctggtgcccatgctggagtgcagtgatgtgatctcagctcactacaacct

SEQ ID NO: 110224 - DNA, 1054 bp, Homo sapiens
gcctattttttcatttattttgtaattggccaaatagcatcttagctctagatagaacagcagcagtcaaaaccatataggaacagtttatgtcatgaaaatcctccaaagtgttagctgagaaaaggactagaagaggaatctctggctgaggagaggatctgtctaggatccagatccccctctgagatactccacttggattttctctgcttttcccttaaaactacatcttgaatgtggttagaaattgtttttctttgatcatcttagagctaaaattggcctgtatctgcaaaataactcctgtagaataaactataacctaatggaatcaattgacaaaatattagtgttcagctaataaacagatggtgggatacaaaatcaagaaaaatgagtaggtttccggattttcctgcactaccaagaaccagtaagaaaatgtaactgggaataagattccatttataaaagaaacaaaacataaataacccaggaatatgccctaggaagaaatgtggaaattctttattatgaaaactcctaaagctttaagtacttaaaagaaatctgtacaaaactgtaaaagtatttgaatgaaatatggaaaatgttatgttcacagagtggggaaggacttcttaacatggaaccaaagaaaagacataaggaacaattggataaatttaaccacctaataatttaaaacttctgtatatcataaagttaaaggacaagcaacagacttggagaaaatatgtatgatgcaaataacagacaataactatccagaatacatggaaaactcctacaaatgaataaggggaggataaaaggacataatagaaatggacaaaggctaatttagtaaattttaggaaaaatgcaaatgaccatttaaaaacacagagaggtgttcagccttaccagaaattatagaaatgcaaatgaaaactacatcagttaaattttttgcccattatgttagaaaaagtgatgctattcaagtgtctatgtaagtgtaaggaaataggcattctcatattttctg

SEQ ID NO: 110225 - DNA, 1052 bp, Homo sapiens
ttctgaattgggaggaaaaccaaccaatgtatgtatgagaaactcagaagtctgaatagaaaaacaaagtaaatggcagaagattctcgagtttatgcccgcgtaggtttggagtgttgaaaaagctaaaatgtttagtttcacttggccctgaggtatggttgagaaggctgactgccagcagttgaggattgagtccgaccatgtttacatgcagggttcccaacaccagtggtgacactgggaagcagccccagcactttcctctcctgagtcctccagacccaaaatccttaatgtcaaaccaggtcagtgtttcttactgtgtttcaagtcgttaaaaagactgagagtagaggcactttatgctgctataggtggggttctgtcagcgttaggaaaaaatgacagtttagggtaaggaagatctcataatgagtttttcaaacataattatgcaaacatgagatttttcaaaacatgccagaaatttgcctctgattttttttttttttttttttttttttttgtgggggtgtggtataccaaagtagccagtcactgggctgtcagttcaaaatgtcttgtacttcagagtgaggaagtgtttcagttcctcagtgacagaacctggcatgcagaagagacagaattgttcctgtaagaaaatcaacgccgagagagagctgcccaaatccagtgactcttccacttccagtctcatgcttcatagggcaccttgaggtgtgctgcccagtgtggcttagactaaatgttgagtttgggttttttgtttttttttttttttgagtcagagtctcactgtccctcaggctggagtgcaatggcgcaatcttgcctcactgcaacctccacctcccaggttcaagcgattctcctgcctcagcctcccaagtagctgggattacaggtgtgtgccaccacgccccaccgatttttgtacttttagtagagacaggatttcaccatgttggccaggctggtcttgaactcctgacctcaagtgatctgcccgcctgggcctcccaaag

SEQ ID NO: 110226 - DNA, 1021 bp, Homo sapiens
ccttctcttgattagggtgccttggaatgtacagaacctaacttgaatatacagcactggtttcttggataagaagtgtacagtgatctaaacttgcaaaccaaaatacagagatgatgggaccaaaaattatcaacaggaatgtccaagaaatatgatcagtgtagccatggatacgtgtcatatttgactctatgtgcttccaaaccaatcgcaaacaggcctgggcaagctgaattactgtctttgaactccatctggttggattagctcttgtactttttaacaactcagcttcatttacatgttgttcccctatttccagaaatgtttggaaaaatgctagtgttccttaatacttaagatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggtatgcaagaagggtctctgggctcagccattgcctgggattccagtcacaatgacaggtgttttggcaatttgtatttactcttttgtaaataactttgtgtctataaccttggcttgaagtggatctgaaaaccacccaacggtttgggtgaattttttttttaaaccgtgaaatggtatgttctgtacgtttctaacaagcaaccattcttgaacttctgctagggctaggtatcttccacctgcaggaacatctaaaatgaaagcaaaacgcactgaagtgagctgaagtgcatatgtcctgcttgaaatgttcacattgtggcatctgaacaggtttcactgtttgtctaacatgtttgtgggaggcatatttgttacaccattcttttccatactgtaactctggattctttccattaaaggttcgggatgagtatcggcaggactacgatgctgggagaggaggctatggaaaactggcacagaaccagtgagtggtgagagctctgtcag

SEQ ID NO: 110227 - DNA, 1089 bp, Homo sapiens
gggtacctgtgaggacgtcacagtccttgggccggatgaagcctctctgaataagggcacccacggggacatcccagcctgcagggctgccgaaaccggcgtggcaggagcgcttgccccgaagctcatccaaggtgaaggcgtgggagctgtcccgtctcaccacggccaccacgtagtacgagttgctgctgtcttccgctggggagagagggactcacgtgaggggcccctcatctgagagcccgggcaagtgcctgggggggtccttccttcaaacccactccttcctgtctctttgcctgagctatgcaggccaaagagtacccaggcctgaggccagggtgttctgggagcaggcccagcgggggcccctgcctgcgtcccctgtgagaagcagcctcttgcctccactttccagccttgtcttcctctggccccagcagtccttccccacaggggcttctttctttccttaaacccaggtggtatttttctcactacccaggaggaaagtggaggcgcagctgaggctgcagaagcattttcctacagcccagagattgctcacacccaggtggaagggacccaggcctctgaggtcaccagtaagaggacagaggccaaagccccagcccaggcccctgagaaggtgcaaatgagctgccagggggactctgaagggccactttccatggctgcttagggccagaagaggctgaggaggccccagtagtccaagatggcaaactacgaggcctgctcttgtatggcctgggttgtaagctaagaatggtttttatattttgaaaaggttattgaaagagagactgtctgtcgtctgcaaagcctcatgtatttatcctctagtccttcacagaaagtttgccagccccttagagacgtttgttgaatagttggggaaactgaggcctggggcaggaggggcaggcctggtgacaggcagccactatccccaggagagaggcatggagcttttgaaaatggctgaggggggcactcttttatatttataaaaatatccccacctcccggctgaggccaggcggcaggccctgcactcacggg

SEQ ID NO: 110228 - DNA, 1039 bp, Homo sapiens
agggatggaggtggagacggaggccgggtcccctcgcgtcggcgccccggggagtcagggcccgggatggtgggacgggaggcgggacctcggggagcggctcgcggggatcgcgggcggcgaccgccgaggggatggagttcgtggcaccgctgtggccgcaggcgacgcactcatcaatgcaaacgatgaagccaccgccacccccgccccgtctgaactttgcagtttcccgcctgggtggtggggggcttggagcgctgcggaggggagggcagttcgacttcccaggcctccgccaggagtggggaggggagggctgtggcggaagcttcagtctcggcccttgggctggtggggctgccacgggagggtgacctggtttcgggcggagtcatgcgtttccctccctcctgcacaggcctctggcagtgctggctggggcagggtgaatggcagaggagctcaggcctgaaagtcatcggccccaaggggctccagcaccccttcctctgggcccctagcctgggagctctcggggactctgacccggtcagatcctgaggcataagcagaagtccactgaggatgtgggtgtctcaggctctctacaagggggtttactttcaacacagaaggtggggtttttatctgctctctcagaagatgaagcaggctcagagaggcttgaacctaccctgatgggtcctcagcctcccctctgtgcctgccgtcttcccttggcagggcctggcactgtgcccaccgagggtggctttgcagccagcatcatcgcagacactccccgaggggacagggctcctggagggcagcccacccacagccccctcacctcactctcccgtcccagttcatgaggaaggcccagggacactgctgggtgagggaacctacacgagcaccctcttcgggaggcctggagaggggaagaagcttccacttccagggcctgccgagactccctagccagtgctcccaccaggtgggggtagctgagaagcgacctgtagaccctccc

SEQ ID NO: 110229 - DNA, 1028 bp, Homo sapiens
aatatattttgtttcttttgccacctactcctaactttttgtttggtttttaaattaaatattaattgaatagacttatcttccttaatcatgtgaactgaaaatgggggcatggtggtcatgaggaggaaacatttagggaaattagattataagtaaaagtgtgggcatattctcctcttttctacaaaggttttcaaatggttcctgaggttttttgttgttgtccgtgttgttactgttgttcttgtcatcaggtttgattttggtccttgccctttccttctagttctccttttattaataggaaggcaggcaaaagccccatttatgtgtgtgttttcccctcagacagctttcatccactgctctgcactagaattgcacaaatcttcatggtgagcaattttaagaaatgttagtgaaaggtagaaattatttcacaaatcagtttctctggtccttcatattaataataatatttggcttcccattgctctttggagttgtttattaaatatgtgtttttgacaacctcctcattagtttcttaaatgagtactggtttgtaaagaattatcaacattatccattccatttatgaagaagaggagaacagctaataaactgtattgtaaaatccatatgttaagtgtgtcttgaattttgaaagaaaaaatatattttgcaagctaacattttcttgaaacaatttgaggcatcatgtaacttataaccgaatccaagagccgttaggcagcagagtgtgttaccacattgaaatacacagtgctgctgttagactaaatgtcgtaggttgttaaccacatagaaacacactagtatgaagaaaactgttgtaaaatctcaagagcttcagaaactgccttacaagaccgcagcataagctattttgaagtatttaccaaatagtcacatgttgtaaaatatcaagtggttataaaaggatgccatttatatattaaaatttacataacattgttttctggatgtccttgttaagtgat

SEQ ID NO: 110230 - DNA, 1034 bp, Homo sapiens
ccactgcacccggccaaagacccattcttttataaaatgtccctccctcaatttggatttatctgatgttttctcataattcgatttaggttctgcatttggggcaggaatagcaatgaagtaatgatgtgtcctctgtgtatcatgcaaggaggtttacaaagtctacttgtgccgttacttatgatgctaattttaatcacatggttaaggtgtctgcagccttatgctttcccagtttccctggtttactaaccattccattaatgaatttacaaagtaagcaaaatgtatatttcccaagtcagttcctgactgttttctcctaaaataaatccttgcgtgctgttgtcaacctaaactatgaaatgctctaaaataaatccttgcgtgctgttgtcaacctaaactatgaaatgctctgggattctgtcctgtgctgttggggtgcatcaagatgccaaacccacgaaccaagtattttgtcaaatgaactgagtcttcagggacattgaggcatgtctgcatttagctcaaaaggtagaagtctcacaaaactgatactagcgaatatcatgttactgaaaattcttggttattcaggcgttcctagctatgtataagtgcttcctacctacatacaacgtctttcttctatgcacatcatctcaggtaccaaatagacagtattatttaaaatccccctttgacattttatgctcagtttttcagaccatggaaatctacacctatgatgctcttccaagatcactgggcatttttttgtagtttagtaagtgacttatttaatttgcaattctcaattatttcatttatatgtaaacttttttacgagacacaaggttccactctgtcacccaggcaaatggtacaatccaatggtacgatcatagctcactgcagttgtgaactcctgggctcaagagatcatcctcctgtctcagcctcccaagtagccaggattacagacacacaccaccatgcccagctatttttttttttttttaaataca

SEQ ID NO: 110231 - DNA, 1374 bp, Homo sapiens
agtctcactaccaatctccattattccagcatgatcccagaccacccagagtttacacttctgttagatcatctttctagaatgctactactgggattatatcacttcctacatccagtttctgttctgcccttctttgctctgcttccttacaatttctacttcaaagccatctgtaaaacactagactttattctgtcatttgcaatgtaaagaaacattatctgcgaaaacaccaaatttaacttgattgaattatcaatatgacttctagcagaagactaagtaaagtttaagatctgagtcaagattataaaagagcaagttacgcatctttggttgatggtagagtgagatggagagggaagaaaaaaattagtcataacagttaaggatatttttgttcgctggtgaaataaaatacattgatatttgttgaatgtttattccttttaacatgcagtttatctttatagttaattatactcgaccagtgatcatattgggacctatgaaagacaggataaatgatgacttgatctcagaatttcctgacaaatttggatcctgtgttcctcgtaagtaaaccaaacaaaaacatttaattgttactcttaacatttcctgtcactgtgtgtgggaaaaatagatataaccattttttaatggtttgtacttattttatcagttactcttccatcctccatattattgtcctttctcagatttaaattaatctgttctgttgaactttacaaaacgatgtaagtagaaaatggatttattgtggttttttttttaatattaaacactttcccaagtttttttctgttaaagatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcagaaaaggtaagcatcagactaatcccagaatatagcttctaatcagatatgcctttgacagtatgcaagactggtaggatagatacagcactaattagttttgttaatgtgatgaatttgcttacctaaataattaattttccatggcttaggaaagtgcatacaagataaaacaggtaaataaggtaaacaaagaaagtgaaaatagaaatgataacatgaatgtaagagaagttattttcaggtcatttgctagagatagaccttttgtttaggcctagctctccagcatatattaaaaggagataagggccgggtgtggcagtgcacccttacagtcctagctactgagaaggctgagttgagagaa

SEQ ID NO: 110232 - DNA, 1854 bp, Homo sapiens
ctttaattaaaaaaaaaaaaaaaagttaaaataaaaattcagatttccctgtctcattgaaagttttatttttattttttaaaaataaaagtattagtctttgtttaattgaagggagatatttattgagagaaaacttgagatgacatttacatggatgagaagagtgcctatggttttaccaaacaataaagtcgtgaaatggagtcacttttaaggagggccaggcagtttctggctgggtgtgtttgttctcattgtcttttttatgttttgcaaaagccagccagtgccagtcttatcaaagcagagtttctaagaaatattagttggttttaaaatgcaattgccaccatcggtgccttcccttccagctgagacatctgaatttatgacttctaatattagttggttttaaaatgcaattgccaccatcagtgccttcccttccagctgagacatctgaatttatgacctttacaatcctttatctatatgatctcagaaacatggattttcatcttcagaaacaggagcaaagctggattgaaaataagatcatctatttatttttaattacaaagacatcccgtcattaaaatgggcatctatttgtttaaatatagtttgtcccctttgccagttaacgctgtttcaaaaactgaaatagtgccaacagtattttctcctttgagttttatgtctacatttggactaattcagggtcacttagccctttttgtcatattctacttgctatttataatagatttgttcataaactgtgttgtacaaaaataaggcattgtccttaattacaggagttttcctttgctaatatatatttattatttgaaaaacttaaacgtttcaaagaaaaagaaaatgcttttaaaaaattattttgttatatatggcttatatctcaacatttcattttgattatttgctttttaaactcatgacactgttttattttttttcattgtcctgcaatttcagagcatgtaacttctaatgccagcgatagtgaaagtagttaccgtaagtgttttaagttacttgttcttttgtaatctcgagtaatacatcctctgcaggggtggagggattctgagtgatatgttataaaaacctgaagttatatgatcgttattttaaaatcagggagagacaagtaaaattctgtacttgaaaaataaaatcatactatatatgtagaggttaatttataaaattttaataaaataaaaatattatttgtgtacatgatacatatgtatatgtatatgtattttttgtaagaagtaaatatctagttaaatgggggaaaacttgtattttgaccttctgtttagtaattggttttaacatgagcactaaaataatatttttcagtaatgctaaattatcattagctttatttccatttttattctttgtcaccaatactgatctgggtcatgtcattgtttatcaccagcacttggtgaacggaagaaataaggaaacattttcaatgatcacctgaaaaataatactaatttttcttttgctgttttatattacattcttggttttattaagtgaactgcacaagcatgtgatgttttaaaacagacttgggcatgggagaaggggagggtacataatatcagttgtagcaccttaaaaattaaaattacttttctaactttctttttttactgctgtctaatatgaaagtaatcttgattacagatgagtatggctgctcaaaaggtccatcctgttaatatcagtccctaatactttttcatgttgacagtatatacttttaaccgtcattcatttggttgattatttttctacaca

SEQ ID NO: 110233 - DNA, 1019 bp, Homo sapiens
acgctttgtgtagacctgaattcatttgttctttattctgagaagaagagagtcaaataaattattgatttccctgttaacagtagagaaaacagtgagagaaatcgtcttatcaaacctaattttgctaaacagaactaatgagagtacaatggaagtttgggagaatgcagctaagtcatcatttgcgaaaagctagaaataaaaacccgtgccgctttcatgctttaagggaggtaattttgaaaaagctcaagggactaaaactaggtaagattcctttaacagagactgaaaggaaacataactcaataaaagatacataaggtgctcagaagtaaaattatgacataagatttgagacaaggtttgttcttattacatgtaggctttccatttttacaactttccatgttgtacaacacctcaaaaatttcctcaggcacgtaggtttcctgttacatatgtcttttctttcttctcactttaaagacgtacgcatagttgtgcagagcttctaaatgccaaaaacagacttattttcatttgcattacgaataagatgtaagagtagtttcattgcttcagattgatgatgtagtattagaggagagcagaagagaaacatgatgtactgtatcaggaagaagcatttgagtacaatgataaaacttggttagagagatttgagatagatctgttcatcaaacatcataaacaggctgggcgcggtgactcacgcctgtaatcccagcactttgggaggctgaggccagcagatcacctcaggtcaggaattcgagaccagcctggccaacatggcaaaaccccgtctctactaaaagtacaaaaattagcaaggcatggtggtgcacacctgtaatccaagctactcgggagggaggctgaggcaggagaatcacttgaacccgggaggtgaaggttgcagtaagccgagatcacgccactgctctccagcctgggtgacagagcaagactcaggttttttttttgttttt

SEQ ID NO: 110234 - DNA, 2070 bp, Homo sapiens
taatgacttttctgttagctcatcgtagccacaaaaaaagagataaaggaataactgtggtcaggccaaaataaaatgaagataatgaataaaatgtaattgagcagcaaagtaacattaaataacttttgctgtagagcacttaatacttgaaaatttttctggaaaaacatggattagtataaacaaatgttagcttggtttgtactgtagtagtaactgatttgcctttttttgtcaagtagcatttttatttttaggtataaatgaactatgctgtctgaaattcttaagtattttcagttgcaaaatgttagaatttatacaaaagtagaaattcactttatatgagattaaagtaaaaatcatatacaaactgcacactgtggtcataggagtcagcttccacagagctgctaggctgggcctttgtacacacagacagtagacatccctttgttttgcccctccttctcttcttcagcagtcattcaatgacaagcgtaaaaagaacctcttttcccgaaaattccccttctacaagaacaaggaccagagtgagcaggaaacaagtgatgctgaccgtaagtatgtggatccagtggtcaactgaaaataaaatggagagggacctactgccctgcagttggttgttaccatggagacagtttcaagagctgcagcaggttgctaattgtcttcaagggcaacttaacagttataaattaatttgtatgccgatcttaactttttctggcaccttaggaattcttaatttaaagcaaacattatttttcagttatatgtttataacttgaacatataaatatgtataaatgcagttatttgaaggaaagatttttatgaaaaacacattcatacattcaaagaatattttagaggaagaacatgaatacatgagaagctacctgttgatttctaggtataacatggcgagtctgataactggattctctggaatcattacattttaccctatttcttcattatatgtagacaatctggattttacttttaaaatagcaagaaatggtctaaaattttgcttctgtacctgaatcagccttcatgctagaactttcattcttttggtagattacagttagcagctagctcatttcaaagttctagaaatatgtaaaaatgctctgtaagatatatgtacctgtaatggtcttggaactgtctcttactgtagcaccaattttatgcattactgacaactattttctttgattatctttttattgcttgctctctggggactaccctctacaggagatccctgacgacatgggatcaaaaggcctgagtaagtgatcaaaatactcccaagttattttttaacctccatctgcagacctaccttattcagatacattttgagattcatggtagtgcctttctggcataaggaggtgtatgatttagattgcttttagaattttcatgtttatcacatgcttgggactttatttctgtaatacataactttttgtttttatttttcacatgtcatttgaaaaattctcttgctcgtaactatattttcctttttgtaatttttacgacagttacttttgctaggaacttttaaaatataaaaacttttaagatttttttaaatgtaccctcattattagaatgtagaaatatgcttccttggagttttatgttccccttttttttgttaaaataatttaaaataattttgattatgtgttagaaaagcattactataaaagtataaagcacaatagaatactacgcaagtagcagtttattgaggggataggttgtgtatctcttttttttttttttttttttttttgagaaagttataagttaccacaagagtataagaactattttgtttttcctttagctaagatgttgcctttgtttttggtttttgttgctgctgttcttgtttaattttctagctagttacttaatcttcatgtaaagcttcacacagggtctagtatgtagaagacattcaataaatgttggcatgaatgaatgaagcaagaagccattttagcaaat

SEQ ID NO: 110235 - DNA, 1052 bp, Homo sapiens
caggcagatcacctgaggttaggagttagagaccggcctggccaacatggcgaaaccccgtctctaccaaaaatataaaagttagccaggcatggtggcgggcatttgtaatcccagctactcgggaggctgaggcacaagaatcacttgaacctggtaggcggaggttgcattgagcccagatcgcacctctgtgctccagactgggcaacagagcgagacccaatctcttaaaaaaaaaaaaaaaaaaaaaaaggtaaaaaattagccaggcgtgatggcttgcacctgtagtcccagctgctccagtggctaaagtgaaaggattgcttaagcccaggaggtccaggcagtagtgagccatgatcatgccactgctctccagcctgggtgacagagtgagaccctgtctcaaaaaaaaaaaaaaaaaaaaaaaaaaaaaggaaatatatcaattctttcatcatatattttagaagtgtatttatttttccttcactttaagtccttctgcttgcatctaaatacttgggctgtcgatagatgagaaagatggtacaggcttcatcccgtattggtggatgtaattcttaataatcctgaactcactgcagtggaatattctagcagtaagcctggagaacaaactgaatacatgttatgttaaataccatttatagcaatgttttatgtttggggttttttttaatactaaacaaaatttttataagtcttctgataatatttgaaatgaatgtggaatgttaactcagcaaataaatttactctgtacatctctggtatcactaagcactcagacttaaagctttaaaatttaaaagatgagaaatatctttggttcaagaagttaaatctgagaaaattatgtgttacattccattttttagaaatgataaattcctttaaaattgtagctttcagaaaaattccaaattatatagtgtgatctgaagcaatattaaaatagaaatttgtattagaggaaaaatcccaggtaaatgctcaggatttgaaaaatgtgaattttttaa

SEQ ID NO: 110236 - DNA, 1031 bp, Homo sapiens
gaattcccctgagatagcttatttatgagatctgcttcatccaaatcattgtctggaagttcttctttaagagctttttaaagtagtagtagtaagatagccagcaaaaatagttaatgagatcataaagaaatgtttattataactagttaattcattttaagtcgattatgctgtaataaacatctttttcttattagttgaatttatacctatttcgtaactatttctagacctttatttatttacctgtttgtagaagttgaaaagtaatattattaaattataatcaagatttataattatgattttcgggcttataactgctgttggctgtatccatatatttagcatgatccaactatttggctagatctttcagttgatgacaaatcctcttttagcaatgcagcaatcagcataacttttttccagaaatagaacatagtctgctttaaattcggaaatgcttcctctatgccttgttgagtcagtagaaaccttacatcttaaatatcaaggtcagagctcctaaaaattgtcttggttcttggagtctcataccttacaaaggctttctgtgcctacacccaataataaacactgttggcttcactggagagatttttttttcattttgtacaaaaattctataagattgtgttttaaagcaagcaataatgtaagaaagatatcttgagacctctgccaatttccacattcatgagtagcattgcagaatataatcttactcccgtaaaatacagtaagaaaccacaactaattatgccatttcgttcttgaatgtattcaaaacttaccttttcttaaatagaactatctctttcttagacctcttctaaaataacataggaattgtaattcctacaattcttggctttcaggaataatatttacaaatatagacaatttaagttgctgaattatgtactaaacaaaataatgattagaaaacaaagttgagttgtaaatgctcacccactaaatgctagttttgtggtgctgttgat

SEQ ID NO: 110237 - DNA, 1046 bp, Homo sapiens
tgtgaacaaatggaaggaataattaatggacagaatagtcactatgttgatctagtcgtacagtccacaactaataaatcaaatatatcagggaatttgttttcctacatgtatctaatcaaagtaaagagaagaatgtatcttaatactttttgtttattaatttcaaactctctggatttgtctattttagaattcaatataacttaccattggattacaatccaagagcgtttttaaaatttgtcttgtgatattgaaagaaacaaataatacaatacagtattttcatagcaagttgattttgctatttcttttttgtcttatcttgtatgcagtgcagaattgaactgggcattatttggcctactatgatatatttaattacccaaattacatatactttcagaaccctatgatatgttgattaatattataacaagtgattatggactttttttcttctgactctagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcaggtatgcctgtttcttaccacttgaatgtgaggcaacataaataattgatgttcttttaaattttttttaatttgtgacaacatggatggacctggagtgcattattctaattgaaaaaagccagacacagaaagacaaaaatcgtatgatcacatttttatgtgaaatctaaagtagtcgaagtcatacagagaagaatggtggttaccaggggttaggaggatggggaaatgagatacaaagtttccgtgacacaagatgagtgagttctgcacctccaacatgtaagcatggcaactacaggtaatagtactgtacttgaaatttgttaagagggtcggtcctaagtgttcttaccccccaaaaaaaggcaaccaggtgaggtaatggatatg

SEQ ID NO: 110238 - DNA, 1050 bp, Homo sapiens
caataatcaaagcatctagtgtattaattattattataggtttcttccttaatataaaaattagaataaatcctgatttttaaaatttacacttaaattcaacagtaatataagattactgctgtctgatgcatggaaattgtcatttaattgactaaatgtggtataaactttaaaagagcatgtagaaaaattctaactcagccaattctaatttatggtacatttaggttattaataatttttttttgaaatttatgtgttgggcaaaatctttcgcatattactattttaaggttctaaccacatttaatcaattataggacagtttacatatttaatacgttatcttcaaataacttattttttgaaaatatatcaatttatttctctttttcttccatcagaatacagtcgttttgaagctaaaatacatgatttacgggagcagatgatgaatagtagtattagttcagggtcaggttctcttcgaactagccagaagcgatccctctatgtcaggtaaatttttttacttctaattatggcaaatcttaattagttatgcatgtaaattattttgtatttttcactataacttacttagttttaccgtaagaaaatatattgccaatcagtgttgttttttattattgattctctctgacagtgtgcctttcaagaattggaatattattgtattaataattttattaatgaaagttatgtaatccttgaataatgatgatataataaaggaagaaatttctgtggaccagaaattgttttcagattgatgtgttagtagtgactacaagcttgatgatatcatgtctaacacttagatttaacctctgtccttttctaatatattttccattcaagtaacatttaattacctggcaatttccatagtagcaaaggaggcatatgtaaataataatttaaaatgtgaatagcctcggtaaataatgcatatttggaaaatttctacatgcattttttaaacacttgggagaaggcaaatatgttattttcctataatatata

SEQ ID NO: 110239 - DNA, 1036 bp, Homo sapiens
aaatagtaaaattaaaaacaaaggtaatattgaaaagtcatcacttcctagttgttttctaggaagtaaaataatagaaacataaaccagtgagactaacagaaaatacaaaaagagggttgggcgcggtggctcacgcctataattccagcactttgggaggctgaggtgggcgactcacaaggtcaggagtttgagaccagcctggtcaacacggtgaaacccctgtctctactaaaaatacaaaaattagctgggcgtggtggtgcacgcctgtaatcccagctactcaggaggctgaggcaggagaatcacttgaacccaggaggcagaggttgcagtgagccgagatcgcgccactgcactccagcctggatgacagagcgagactctctctcaaaaaaaaaaaaaaaaaagaaagtacaaaaaaagatagtagatttaaaactgaatcgcccaaaactcctcctctccctcaaaaaaattaggaaagccaaaccaaaatttgttaaaaatctacaataaaactagacaaaaagatgaaagatatcctatgaaccccaaatataagctgatgtaaacaaggtattaacagctacaagaccatctgatatcagcatctgtgcaaggggatgcaacaggagaagcccaatgttaaccagtcctcacaagaaaatgcagtaggtaaatttgagaacaccaagtgaactataagagtttttgtacaatctgcatgttgagtgcaaggaatctacactaagatatgaaggggccacgagcagtctgggccctatgacacagttaaccagctgtagttccctttccatttaaagccccacactaaggaagaactgctgggaataaaatccaaattgagtaggatagggataatagagccaaaggaaatagaaggttcagattaatgggggtaagtaaagtttcaggaaatctcacagtgtctgaggtcatgtctttaaacacttgagagaaacaacaaaatagagagttctagagctgtgaagttagaaaacctatc

SEQ ID NO: 110240 - DNA, 1019 bp, Homo sapiens
agtagtgtgattatcaaaagggagtggttcatacttaaaagtccaatgcaatattctagacaagagactcaagtgaagaagcatgaggaacagtaatcaaggtgcaaatataacttattttttagtttgtaaaatatgcaaagagattaaagactagataagccattcactattacagtttccctctttacggccttaaataggcactattagaaagtaataaaaataaatggcaatgaaaggtcactctagaagcactgcctgaagactagcagccttggatattcccatcacaaacaaataagaacactattctttctgctaattttcatcccaaacacaattactgacaacctattaagtttccaacattgctaattctttatgaaagaaaagagacaaacactcctatctgtcctaaagatcactgcctagaatcaggagtctgataagtaaaaaataataataatgctaacaataatgtaatcaataaacgttaagaacagacattacttagtacacattttaatgttgaatctgtaatataaaagacgtgtacaaattacaaagcaaactctatagtgtcttattactatattgaataatatgaaaaagatctacaatgctttttcaccaatttttttctacctcattagaattctttgggattaaaaagacagttaatctatacatttcagtgcaggtagtaattttagatgaaagtaaattttgtgtgtcagaatatcaaggatatatagcaaacaaacaaacccacccaccagccaggcaaaggggatcacgcctgtaatcttagtacctagggaggcagatacgggaggatagcttgagtctaggagttggaggctgcagtgatgtacgttcatagcactgcactccagcctgggcaacagagtaagaccctcctgctaaaaccaaaccaaaccaccacttattgaattctgaacacaaatcaaataactgccatatttttatggtatatattagataaggaacatata

SEQ ID NO: 110241 - DNA, 1080 bp, Homo sapiens
aggattcattgaagagcctgaaatatacatgttttatttttacaaataaattaccactccttttttaaaattaatactgcttttctttgaggcttggtaaattgtccttaggaattagcttagtaaaactaagttaagaaaattcttatgcatattttaaagtaacattttatatgttccttatctaatatataccataaaaatatggcagttatttgatttgtgttcagaattcaataagtggtggtttggtttggttttagcaggagggtcttactctgttgcccaggctggagtgcagtgctatgaacgtacatcactgcagcctccaactcctagactcaagctatcctcccgtatctgcctccctaggtactaagattacaggcgtgatcccctttgcctggctggtgggtgggtttgtttgtttgctatatatccttgatattctgacacacaaaatttactttcatctaaaattactacctgcactgaaatgtatagattaactgtctttttaatcccaaagaattctaatgaggtagaaaaaaattggtgaaaaagcattgtagatctttttcatattattcaatatagtaataagacactatagagtttgctttgtaatttgtacacgtcttttatattacagattcaacattaaaatgtgtactaagtaatgtctgttcttaacgtttattgattacattattgttagcattattattattttttacttatcagactcctgattctaggcagtgatctttaggacagataggagtgtttgtctcttttctttcataaagaattagcaatgttggaaacttaataggttgtcagtaattgtgtttgggatgaaaattagcagaaagaatagtgttcttatttgtttgtgatgggaatatccaaggctgctagtcttcaggcagtgcttctagagtgacctttcattgccatttatttttattactttctaatagtgcctatttaaggccgtaaagagggaaactgtaatagtgaatggcttatctagtctttaatctctttgcatattttacaaactaaaaaataagttat

SEQ ID NO: 110242 - DNA, 2820 bp, Homo sapiens
agggtaggcatatgtttagtctccagcggatactgctgaacaatttcaacagtataggaggcaattaagaccccagtttttctacatcctcaccaacccttggtattatccatctttttaattatgaatagtatgtatatgtataaagttatctcatgattttaatgattattatttattcatttattgctggttgttcctgatgattaattattttcagcatttttgcctgtgcttattgctttgactcttgttcaatgcaatgtctgttcaaatctttttacatttttccattggttttattattgatttaaaggaagttttatgtatttgagaaataactctaatcagttacatctgttgcagatgtcttcactgagtttatgttttccctcaaaacaatggtactttttgatggataaaattttttaattccttatcagtcttttctattaaggtagtgcttttagtgacctgttgaaatttttcctatccttaggtcataagggacttgtaggagctttattattttgcctttcacatttaggtccgatccattttgatctaatttttgcatgtaatgagagattttttaatatgcagatatataattgatctagcatcatttattgaaagaccatttctgccactgaattgcattggtgcttttcttttaagtgaccacatatatatgaacctatttctaggctcttctgtttcattgaactatttgtctttgtaccacctgcagtctcttaattatcataattttataataaatattgatgtaaagtaaatcttaattttgttactgttcaagattatgttgggtctttgaatttcctttttaattttaggatcaaaaacattacagatcggtttaggaagaattaaattgagtttcttaatcagtccattaatatgaatatctcttcttttattgaagtccttcttacattctctctgcagtgttgtatagtagaggttttatatgttagatttagtcctggctatttgatgtttttcatgctattataaatgtactactttgtaaatgtttctaattttaactgatatataggaaatatctgttttgtatattaattgcttagtcaacaatcttgctaaatttgttaatgttaggttttataggtctttcagatcgtctacgtatataaccatgtcatctgtgaacaatgaattttacttccttctttcctatctttatactgttcattttcttttttcttgtctgatgcattggtaagacctccagttcagtgttgaacagaaatggtgataataaatatcactgtcatgttcacaaactgggggacacagtatttcaccattgtatatggtgttaccagcaggtcttctgtagataccctttttgtattaagaaagttaatctttattcctggtttatggggagtttttatcctgtaagtattgaattttatccaattatttatggagatgatttttctcttttattttgttaacgtgataaattacattgattttctaacgctaaaccattcatttgtggggggaaaaaacccacatccttataatatatattatatatcattgattttgaactgcttatattttgtttaggtttacatctgtgttcacaagcatgaacttaacgatagtgtcctgaaatttttctgtcttgtaatgtttcagaatgttatttcatctctagatgttttgttgaattttccaatgaagctatctatctgtctggccctggagttttcttgggaaggattttagttctgaatgcattttccttagcagacacaagaatgttcagattttctttctcttgttacctaagaggactagataacatttgatttttttttttttttttttttgtggtgattgtcaagcattgatggaggggatgtttctcacagaggcagccttgcaagtgagcagatgtcaaaattggaaaacaatttttgtactagttagaaaaatatttttagcaagaatagtaaaagaaatagggaagatcatagaagttatacatgaactatagaagataaagagccacaatgtttataaccaaaataaggtagtcaaaatatgatactcaggaataaaagtaggaaaaaaaagaagtctgttgaatctaacagagaatacagtttctctgccgacattaaaatgttcctgttttttacagtatatattttctcgcttttaacttatattctctttagctgcatggccttgctacttctgatttggacaccagtcttttcccattctcacttcaagctcttctacttgcttttctataaaatcttatagtgttgaatcattcatcttaatatataagaaaaatgaattaggcactcttgtgcttctctgggggacctttttacataagatttggggtataagaaatagtactgttttatctgatccttctttgaggccgtcatttctttcataggaacattaatttttagtctctgttgtctgagagtatgtggtacatgtgagattaactgccccagaaaggatgcattgactaaagggatagtctggatgtgtcagggaaaatgtatattttctggtttgggcatttgactggatttcttgtctagttgttttttttgtttcatctaaatatgaaaatgcagcaaaagaatttaagagtcaaaaatcagtaaactctggatttttaacaggctagtgattgtagaggttcacgtgggtatctattgattgagggctacataccaattcacttgaaaatcccatattcttactgaccacccaggaaagactttggac

SEQ ID NO: 110243 - DNA, 1026 bp, Homo sapiens
cttaggcaactgtagatgtgggtttcgttgtacacttctgcatatgcaattcataaacaatctgtttgtgttttttgaaaagcacttgtgtttaaattttttttacataagtgagttttacttgtcagttcttctgaagcctgcacagtcaccctgctgtcaggctattcagcttactctctatccctggctgtggtgatctggtgttctcttcatcagtctggctgtagtcactgaagactttagtgcgaaggcccattgtcgttttgccactgttactcatgctgtcattcctggtcatgtccaaaaaccacactaatgattcatccaacaccctgactttttggtttcttcatctctttctgactatcctgccctccacttcaactcagttacttgcttctaagataatactttagattttgttatctataattattaactttcatcacctctaaaataccagtttgatcatcccattgtgtgactacaaccctcagttcattcacctctattctagcaattccatctcattttgaccttcagtcatttgacattattattttgttgccccttgtctcaatttttctatttgtattagcttagattccatggtttctcatgttcacttcattgcacatcttcaagtcctttgcccccttcttcttcgcagcagaatcccccaacactggtgcaggcaaactctgctatttcatttatggttcctaaaaagcagaaccatggagaaaagcacaaaattctgctttttacgtatggccataaatcatagatagtgccttactcttgcctgcagtcctactacatttccctaattcactctcccactctaaagaatttttctctcccctcaaaccttcacttgccatctactattcatgaatgatgatctcacttcatatttcatataagcacccagaagagaatttccttatttttccactttcagatatacctatgtaattatatttttaccccgaaactcgactttcacttgtgttttaatgg

SEQ ID NO: 110244 - DNA, 1049 bp, Homo sapiens
tgtttatgcatgacccttttttattttacttcacttaatagtataatgaaacctagtaattacccagcccaagaattagaacatcaaccattttgtgtttcttattcctttgcttcttaaaaattgtttaatcaggccgggtgtggtggctcacacctgtctgtaatcttagcactttgggaggctgaggtaggtagattgcttgagcccaggagtttaagaccagcctgggcagcatggcaaaaccctgtctctacaaaaaatacagaaattaaccagacctggtgatatacacctatagtcccagctccttgggaggctgaggtgagaagatcacctgagcccaggaggttgaggttacagtgagctgtgattgtcccactgcactgcagtctgggtgacagagtgaaagcccatctcaaaaaaaaaaaaagtttaattatatacatatgcctaaataattttgtttagtattatttgttttgaagctttttcaaaacactattgcactgtatgagactttcatctccagtatttttttcactcaatattgctttactgagacttacccatatcattgcttagagctaaagttcattcattttatctctacatactattccactgtatgtctgtactgcaatttatttgtccagtcttcatcagtgtattagtttgttttcacactgctatgaagaattacccgagactgggtaatttataaaggaaagcggtttaattgactcaccagactcaggaaacttacagtcatggtggagggtgggggaaagcaaacacgcccttcttcacatgccagcaggagagagacgtgccagcagtggaaatgccagatgcttataaaacaatcacatctcatgagactcactcactatcaagagaacatcatggggagccacctccgtgatctaatcacctcctacaaggtccctcccccaacacatggggattacaattcaggatgacatttgggtggggacacagagccataccatatcaatcaataactgtctcagtccatgttccttagg

SEQ ID NO: 110245 - DNA, 1053 bp, Homo sapiens
cagctctgtcacttattatctgggtggccttaggaaagttatttacattctttgtgcctcagtttctccatctgtgaaatagggattaaaatatatattaagcttacaggtgtcatgagggttaaaataccaagaaagtgcctggcatgtggttagtgctaaataaatgtttgctatttttataaagtgtgtcttaatgcctacacagaataagcatgcaggaagtatgcaaatggtagctgtaattattatttaacatttttatataatctattattttcactatttcttttgttccttttgctggcccttgggaaatgtttgtatttgtttatattagtttttgatatactttcttcatttatgttttctggaattactccagaattatttataattctctttaccttaaaaaagaagtaacaaaaaattggtaaagtggaaaatttatatttaaattatatttaatttttatttttaatatttaattgttttctcagggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtatgtggtaagtcaaactaagataaatctttaagaaatctctgagttaaatatacctatgaactttatctgtgacatacattccaagtacagtattagtaatattctacagaacttgagtggattttaatttctccgttatttctactgatttttgtcttacgtagcattttagaatatttacatttctaccaagattgcagcatttgaaaagttcctttttttgcggggtttttttgtttgtttttttgaggcagggttttgccctgtcaccctggctggagtccagtggtgcagtcatggcttactgcagcctcagcctcctgagctcaagcgatcctcccacctcaccctcccaagtagcttggactgcatgcacacac

SEQ ID NO: 110246 - DNA, 1861 bp, Homo sapiens
tctcctaactttttatattattgattttttatcttttcccagggccttttaaattccttttgtttagttaggactatacattgtatttttcactggttgaagaacttgagtacctaagtaatttggtaacctcccataatccactggtactgttcttaagattcaggtaattcatgaagttagattgaaaaacatttttttattaaaatagaattttaagacaaatggtggtagagtgggtgtttacactgtttaatactaacagttaaatgataggtccacatatatttgcttacttgagttgcctgaaattcagttagaacattcttcaagaaataaacattttttaataccattggttaaatcaattatttttaaaggctttttgtagcagtcgaaccctttctgtgaagaacatattcagaaatcttgtttctccagttcataaaacaagcaaaaagtagagctgctttggcaaaatttactttgctgtcaagaaaattcaccaatgttaagttctcaggttggtctttcagtcagtgtgaaacaatgccttttgctaatcgggtatattggttaaacatgtcagggactgatggcagctatcacttagcagccacaatttggtcatttaaaaataagctgatgtcaagttagcagaagaaaagcaccatcgccacccccttttttaaaggctaaaacagtatatgggttttgcctactcagaaataacagcgggaagatcacttcagcatttgtctcttaggagagatgtgccctaccaaacatggctgaggtgcagtctaaaagaaacagacttacagtgacacctctgcagatgggtgactaatccaacgacaagttgcacatacttttaaagaaagaactgtggagtatacttcaaaagtccttggtgtattttcttgaacctcacctgttcagcagtaatgcctctgaaaggactttcctccagaacaagtccatttaatttagaatctttatattactcacccatatacctttatttgttgtgttccttatgttagtacagtttctgcgtcctttaatgacaggaacctgtccataaagataaatcatattcagtctcaattttttttcttctatcctcagggaaattcagggcttggtttcagcattgcaggaggtacggacaacccacacattggagatgactcaagtattttcattaccaaaattatcacagggggagcagccgcccaagatggaagattgcggtatgttttgcgctttttattgtgatgctgaatccactttgtgtatttttcttgaagcagactggataagggataaatacaaataacaaacacgatcatgataactagcatagggtagatgctttaacaacattcaagtcaatgaatgagataattatgctctaagcattgtgttcctgttttcatttagactccagttttatcttagatattataacattttgaataacaaatttggttgatggtttaaatctttgtgagcatatttatagaaatcatgagtttccctttgtgttttcagatacactcacagaatattttccatttcctctctggctgggaaacatgtgtataaacttatttaagtacactcacagaatattttccatttcctctctggctgggaaacatgtatataaacttatttaagatacggaggatagaggatcacacatccatgttgaatcccacaccacaaagactatatgcaaactttaaataatatattttcttattgactagatgaaaataacatttgtctctgtttaaatttagtgttccattttggaagatatattttgcaaactttgattttttgagggtca

SEQ ID NO: 110247 - DNA, 1764 bp, Homo sapiens
cccagcactttgggaggccgaggcgggtggatcacgaggtcagaagatcgagaccatcctggctaacacggtgaaaccccatctctactaaaaatacaaaaaattagccgggcgtggtgggcaggcacctgtagtcccagctactcgggaggctgaggcaggagaatggtgtgaacccgggaggcggagcttgtagtgaaccaagatcacgccaccactgcactccagcctgggcaacagagcgagactccatctcaaaaaaacaaaacaaaaaagatccagctgtttaaaacagtgatttgggcagtggggaatactaatctaagcgattaggcagactgcattgacagtattccattccagaggaggttgaacaaggcctgaacaaaggtattagaaatgagagtgaagaggtgatgattttccaaaaaattaaggtgttcaaatcagaaacagttggtaactgattagatgtgtggatcaagacagagaaggatcggaggttgaaactattaaaagctgaatgtacctatcctggatttgaaagtcatgataccacgaatgttgtcaactcattaatcacatttgtatttttccattccttgaaaatcttccccagaattattaaaatgaagctattgtgtttgattactgtcgcattcaacaggttttcattaataaatcatacaaaaattttgccttgccattttggattttacactctgaagtttctgagctgcttttcttttcccctgtaggttaatggcacagatgcagattatgaatatgaagaaatcacacttgaaagggtaaaaactattatcttaatctgttgttctagagaactttgtaatatactgctttttcatacagaatccaagggagatctctcaaaaacagaactatatgatattttctaagttcccagttcataaaattggccaaggtattttcaaaacatttgccttttctttagtaaccttatttttttaataaactttttattttacaatagttttagatttacaaagaagttgtaaagatagtcccaagagtttccatttactctggattcagcctcctctattgttaacatcttctattactagagtacatttatttcaactaagacacctgtattcatacattattattaactgaagtctctatttccttactttttatgttattctctctcagaggcccatccaggaaactacattacgtttagttatcctgccgccttagacccctctagattgtgatagtttctcagatttttcttgctttttaattttgtttatattgtttatatgcatatgataatgaagtattgttcgtattaagtaagtagtatactagtaacatggtcattatatcaattttcttttctagcaaaataaccatacttctaacagacagagctgtattaaaaactaattatggtatacttgcccaatcagaaaatgacttgaaggtgcaattcagatgtgcaaattttcttaagatatgtttttccctcaagaatatctgcactcacgcctgtaatcccagcactttgggaggccgaggcgggtgaatcacttgaggccagaagttcaagaccagcctggccaacatggcaaaactccgtctctactaaaaatacaaaaattagccaggtgtggtaacgcagacctgtaatcccagctactcgaatcaggagaatcacttgaacccaggagtcagaggttgcagtgagccgagatcgcactctagcctggg

SEQ ID NO: 110248 - DNA, 1064 bp, Homo sapiens
actgcattccagcctgggtaacagagtgaaatcccaactctctctatataaatgcctttataacatataatctctaagaggaaaatgtctatagatgagaaagaagagggaacaaaatagtaatagggtttgaatctaggagaatcacaagagttaagaacccaaaagggtagtagagatgggcttcaaaagttctcaaggaagaaactcctggtccctatattagacctgaattaagggctacattttatagtatggttaagaaagcaaagtagcttatgtaggttttgttatttctcttgcagttatctatcattgcataacaaactaccctgaagcttaggggcttaaaagaacaacagttcattttttctcataatgaattggatggctctgctttacatggtgtgggttagggcacttgacaaggttgggaggtccaaatagccttattcacgtggctgatagttggtggtgctgactgctggttaggagtgtagctggggcttttggccaagggttttggttctctgttggttagatctctctgtaggctgtttgagttttactcatgttatagctgctgggttctaaagaaaatatattccaagcaaaggcaaataatactatcaggcatcagatgacctagtctcagaaatcacacagcatcatttgtgccacatttattttagtcaaagctagtcacagggcttgcctagatctaattgaagaggaaagagactccttttgatggtagggtgatttagttatattgcaaaagaatgtctggaatggaagatgtgagccatcttcagaagtagaatttatcacagtccacatttgatttagatagagttttgcccagcctcatatcacgagaaattttaaaggaaggattcaaacccatgttcatctgattccagggacttgtttcaccagtggcctttactgtaggagttaacttctttcaggagagactaggaaataaattggagggagataaattgtgaccaagatatcttgaatggtgactgattttgacataaaacatgtaagtgaaattt

SEQ ID NO: 110249 - DNA, 1072 bp, Homo sapiens
tgcacgtcaggtactggcacataatcttagccgcccatatttttagtgttatctcatatttctctgagacagcaaactaaggaacaagttttgttttgtttttttaaatgaggatatttattgaggatacacacaaaaaagacctatttattctgcatagcttcactttaggttttaaatacactacggaagttcatgaaagatagttttaccatttttgttgtgttatgtgagaagccaatgagtgcacctcattttccagaataagtgtgttcctaattagtgaagtacaatgtgtacattataaaattaaaataatggactaaaatatccgtccccaagtaaaatttaaaatacatactaacatataacccaatttcaacatattaagtgaatatgtattcttaaaagatccactactttacatttagatgcgttaggatgtattagaaataaaaacagaagaaaagatttagaatctagtctgtctttgccactcaagctagttaccctctctgagttttatacccccttcatctattaaaatggggggtaacgccaacctgactcctttaaaatgagtttgagagtcaggcaaattagaaagatacatagatgaaaactttttaaaaagtatatagtctttcatgatttgtagaacacttttatacttttcagagtactttcacattgatcatattgtttgtactttatgaaagtcttctacaaatcagaattatgcttattatacagagtggcacagataaaggtaatatttaatggctgcttaatattgcagaaagaacgtggagtttatagtcctacccgactccaccacttcctagcttcacctgtttctacgtgtgatggtgtggaaattactcaacttctgagagcctcagtttctccacatagaaactgagtacagagtaggtgacagttactagttcttcttactgggagtgtaaacacataatctctgtgatactagcctattaaatccagaggcttatttgcaccctagagtaaatactctgctttaaaactagatgttttaaacctttatttctat

SEQ ID NO: 110250 - DNA, 1482 bp, Homo sapiens
aatttccttgtgacggtgttaatatcatagcctctgttgccatggaaacaagtctctgaaggcagcctcagaggctaatgattccatgatgttgctgtggatagaaacaactgagaccgttgctagtcacatggtcaagattttttttaaaacaacaacagaaaaactttagatctcatcttattgagtgatacaaatggagcaaaacaaggatgatggcataacagtcactgtctaatgaaatagttatataagatttttcaagtttaaaatgccatactgaattctgtaataaccaaaatataatggttactgtatattgctgcttcattatttatgttagaatcttaagtttgacattttctaatttagaatcttatacagctccccggagttttaccctgctctaaaacctttgcccaaagcatcctgtgatcagatctgatatctttgctgttcctcatcagtcagccttcatttgattattatttgtttagagctgcatttttgtttcaagtgaactaaatgaattactttgttgttctgtaattgtttgttaccagaattggttatcagttgtgattagggaattgtgtgtgttgatgcgtcgttgactttctcagcggtgttggccttaaggaagaggcaggggcctatgttcttcaaggaacttggtcagtgccctgtagagagggggatgggttaagatgctgtaaactgggaatttttttaaatggtattcacatcctcgtctaaagaaggtgattctagaagaggctcagagacagagggttacaagtgggattaaaatgtaacattaaaggattcatggtttatcataaagggttttggagagcacctgcccagtggagaaaatttttgtgctttgctttgaaatttgacataagcatgtacttttgtcttattttggctatcaaagtagattattaatcagctattatcctattgttagggctggagactgttaataagaaaacatattacatttgtgacattttcaaacacttaaaaaataaactttagtgtccttaaaagaaccaaaccaaaacaaaaaacaacagaggcacaaggaagcttttagaggtgatagatacgtttgttactttgattatggcagtggcttcatagatgtatgcctatgtgcaaactcatcaaattctataccttaaatatgtgcagttttttatatcacttctacctcagtaaagttgtttttaaactagaataaaattgaattaaaaataacgttagactttcatgactttgacacttttgatgactgcagctagttactttgtaatgtatcactcaatttgggtttgtctgatgtttaatgattagattcaagttatatacctttggtagaaatatcctggaagtattgtactctcattacattttatcacatgatatatgattttgatttttcccgttactggtggtgttaactttgatcacttg

SEQ ID NO: 110251 - DNA, 1684 bp, Homo sapiens
ctgtatagtgtcttgattgtttagatggcgtttctgtcaaggatagataggcaaaaagaagtttcacaggctataatttatatattctaaatatattcagagaagttttaaagttaacctttaaaataatgtgttaataacagtgctgaaaagtgactgaaccatgcttatgggatcagggcaagtcagcctgagcaacatttttctcctgtattttcaagtaatgtttgtttgcatgagaattgtacttcatacctcttatcacgactctaattcagtagtcatttggataatgattttgtttaatgtcagccactaaactgtaagtttcacaagagctgatgctacagggtgtgtggttttttcccttggtatccccagagcctcgcatggagaatgcacttgataaatatttgttgaatgaataaacagatgttatacaggtgttaatttttatttaatctgctgttgacgaagtggaagtttggaacttctaaatattgttggatcactgtaaatttcccaagccatttttatgtaacactatggcttaaaaactagcaagtctatgttaccagattttgtaaagttgtgaatttcagaagtaattcagatccttctgtgaaaaaattgtgaagcatttatactcttacatatctgaagaacttaaatttttatcatgaaaattttacttagtatcagtctctttaaataaattttcttaaattattccttgtacttcctggcactattatttagataacatttccagccctccatttttatagcaaagtttagaattttgataaaggtaaaaatagttgttcagactatgtagagaacagtagcctacagttaccaccttttaaagaaaactttaaaccaactgatgtggtaattttaacaggcgtatgcaaatacaaaccaactggcagtgccacctgggagcagtggaattttatagaagcctatacacgcaacttgcccctccaggcatttatttaaaagattttccctcctcacttcgtaacaggagcacttcctattcattctttttcctttaagccccaatttggtagcatttctgaacagtattttcagtatctgtgaaatcaaaactctgacttcttgactggagcagctttgaaatgtgaagaagttacagctgtgacagagtggaaccaaatgattgctttacaatttgtgttgttttgttgttctgagaaaaagaattggggattataacctggtgtttaattatttgttaatttttttttaacagccacgttcaagagcaataaactggcatttaaattaaaacagatcccaccctcatttatctgtatataaatctgactaatcttggtaggatgatctgatgtatcaaagggttataaatttggaaagaaatcagttggaaagtattttgtaagatagaaagaaaacaaacaagatgcatatcaatattaagaattaattgctttagccaaactaagtaccatagcaggattttgaagggagaacaaagaaaagagaataaaaatcatatcattttaatcactttttttccaaactggaaggctatattcagtatagaggcaaaattttttcagttgtaagagcacagctttattatatagactttttaattaaagatattttaaagaactgtaggtgaaacttg

SEQ ID NO: 110252 - DNA, 1340 bp, Homo sapiens
gtggatagtactgctcttttaatattctaccagcctcattttcctttatagtatcctcctttttcctactgctaaatgttcaaatgtctcagggctcagtctttgaactctctttttatactcacatttcaggtgatcgcatctagtcctatgcccttaaataccatcagtatttctctttattccagagttaatccctgtacattagacttttatatctaactttctactcagtatctccacttcggttaagcatctgaaaggtaacatattaaaaagagaatttctagttttattggtctcaatcttctttattcagtatgccattcactaagatgctgaagacaaaaacccttaaaattatcttttattccttttttctttgctccgtatccagtctgatgccaaatcctgttggctttttattcaagatatatttatgatttggccacttttcaacacttctgcaactactgattcaataatatgttgcctgaactacagcagtagacatctaacttctctcgttaatattttttgcttcctctaaggtagcaccccttcactccagacattactctgtcttcttacctgattctttattatacattttttactgtctttttacttgactgtcagctccatgtgggtgggatttttctgttatgtttattgttgtatcctcagtttctgtgacagtggctggcacactgtagataaccagaaaatatttgttgaatgagtgaagagacagggacatacgaacttgtgctaaggagggcccaagcaggtgtgtttgtctgtcttttcccttagactttctgtgaagcgcgcatcacactttatttagcattgtaatagttctctaactgatgattcttacttgccctctgagaagaaatacacacaaggaaatgaggtagggagagaagagaattcaatttcctcaaaactgggataactatataactcagaccaaactaggatactttaatgaaaagagggaatcattaataattaaagtgagacaacaggcataaatacagacttcccaagtaaatagaggcatatggggtcactctgttataaccatttattttctgactattcccaccaggcaacaggtctgaaattcacaccaagacatctccatcttggaccatcctagattgattgacctaaccgtgttatcggtacataccacattcattttgtctcatgtgtaatgataattgtgttttgataaaatattttttcttcatctccaaggaatggaattgttcatattcattagtgtagtgcttttgtactaaaaagtagactacgtatagggtaggtag

SEQ ID NO: 110253 - DNA, 3248 bp, Homo sapiens
taaaaatgtcttaatatagattttttatttaaagaatagccttgaaaccttggatgtgtagaaatgtatgttttctgtccatccgtgtaggtctttagcacaaaagggggaacaagaaatatttttccttatgctcttatgtaataccaaacaaaatagcctcagattcaattgaatgacttttctaaaaatataagcccattgatacataaaatatgaattaataatgctcatctcctttttagactgtgctaaatgctgtagagtatgatgtctgaccaaagaaaatgctgatttgtttagtttttgtatgttattagataaccttagggagactgttacagtaaagaaacagaagatactttgaaatattttcatttttcagtgttttgaaaatagattcaatttaatataattggctagtattatatatactgacatcttagctatattatggcttattcaagggatttaatgaatcgttttttgtaaatattatttatctagcttaatttgaaattaagtgaacttgtgcaattacacagtcatggaatattttttcacatagtcaaatcacaatttaaagagatgagcaaatactaaaagtctctcaaaattaaaaaaaatcacataacaccactttttgaggaaatgagctattgtctatgggaggaaaaataaagaaaaattaataattgtttgaaatacctattgtttgctacaagggtggtttgaggaaatattcatatttctaaatatttttaagcagtcagttcaactttagtaaaaataaaaggacgagaaatggtctaaaaacaagttgagaatgcatttgtcctctgacatcagtgatatttaaattaggaaaatacatacatacacattccttaggaccttttaaaataaattcccttaaagctgtcttttaaagaaaataatagaagcagctcaataaatataaactataactgtcaacagttctatatttctttatatgttttttataaatttctttactgtttttggttactagaattgtcttttaatggtgttgatttaaaataacatcagctttcttaagtaagaaattctacttacttttctcaaatatttgggagaaatggaattacctaggaagggggagtcattatgtaggcattgaggttaagttacaatcaaaacttattgaatgggcaacgattgatttaactcttaaattgaatactgccccaagaattttactaaccttattttgactgcaattacatatatcacgaaaggatgcaaagactaaaggttgacaatgttattcattgtagattaatactagatgatattttccattgtcaacaagacagatatctttagaactttttatatatatatatggtttatgtaaatgcacacccttctatatatgtatgcacagataacactagcattgatatatctgtcactcggtttattaaaagcaggcaaatgaaaagacaggaaaagtagttcatgtataaagtgttgaaaccacagagttacgttatagccgcttgggagtaggagcagaacgttgctgtgattgcgccagaagagagtcatgacccctgttcgcagtcagctctgcaaagccattttacatgacagcccccacccagtttggttcagagcattcctgtatgctagtatatgagttattaatagtttttatttctttcagacctctttcctgattctcatcttgtctttttcattacctttctattttatttctagaaataggagtattagggtagaggttttagcttctgtttttcttgcactggagtaccaacattttgtttttcattttatacatttttgtaactgatacattggatagtttatatatcttaatttttttataacttactggagttgatttgacaagttaaaatataatgggactgaaaaataacttgagatataattggatcttacttgatactagaatacttttttaaattgcacttactgactcatggctggcagctttcttttgcagcactaagggatttattgttagaaacaacgtagattgaaatttcatacttagagcatataatatatacctatgaatataataaggtcatagtgttttgtactgcgattggtaaataacagaggtctcttatttcactgatgtcaaaaatactctaagatttgacagaaagattaactttgaatctaattccatatgactaagccacatgatactttttgcagattggagagttgttataaatcaagttctattagtatgaaaactatctggtttagtatcccccccaaatacagtatgaaaagtatctgatttaatatccccccaaatatacacaatacataaaaagaacctgtacttattttacagattcatttaaattgcttgtctgctggaggtattcatgttcataactaagattatgtgccattttctactatgatactggaactcaggaggaagtcattaatgttttttgaatgataaggaaactgagtggttataaacttttgcaagacacctagcttctcagttagggtttggcatgtagttggtgttaataaatgcttatagaattaattaatttttattccattcacctcaaatgttatctcctggccttccaaaatatgacacctaatctaatacctcttcagtacctgtattgattggatcttctctcttccctcacaagtgtctttggtttttcacagcagcccatctccttttccactgccttttcttcccctccattcttcatactatcctccagtcacactgccccgattcccctgatttcctcacccctttcagtccccactcagtagtgataaccaaatagcttacacactgtctctcagttttatcatttcattgtatctcattttacattgtgggttttttgagaggttgttttattttttaatgttaaataaaaatgagtttcttatgaattacattggtgaaactttttcagtttgaggcttcatagtgtttttgtccttaatttcaaacgattagtatagaaaaagttctctatgcattgcgaagccctccttggttccgcaccctcagcgtccctcctattcttgtgttgagggtcactcaataatcggccccgtcctacttagcatacacagtcctgttccaatctgggaccagtttttatattcagcagggttttatagaactccagcacagtgctgctagactttac

SEQ ID NO: 110254 - DNA, 1013 bp, Homo sapiens
ggaagcattttaaacataaaaattcccaggttccccctgcccgtaaacattttgatggggagaggatacaccaatctgcatatataactagcgccccaggcaattctcaggcgaactattatgttaacctaaatattagatgttagaatatgttcctttagcaatcaggtgatagtatttggtgaaccagagtggtatttatgtagagttggataaaacacatttcactgattataaaacgaaaaatttaccagcgttaattctttctcatttttagaaatttatgaccttgtaatatgaatgtttataaaatactagagagatgatgctgataatttcttgaaagttcttttttatcataaaggttccagaagcaaaatacttgttttagtaattaatctaccttgagacccagttgttaatcattaaaaaccaatacattacataaaatgataaaggaaaatccatttgtaatgaagcgctatcgttagatagtcagagtttaatgtaggcagcacctttgaacaacttagagccagtgccagataatgtgtaagatctgcctggtgtagaaatttggatatgaatgacaaagattcttttagtgaaatcattttaacagtcagaactatttgcagagagaatcctcttatatgttttaattcagttcatatttataatttatataagcagtgaaggtgccattggattttactacagactgtggttgaaacttggtaatccagggtttttccacgcagtgcattaaatcaggcagccccacagggtcttggtagtccagtgtttatagcatccttctttacctgctaatcgacctcacttcctggatttcaatccatctagttatcagctaacaaaagaacagcttttggttcctgcagacgctggtgaaaaaataatcatgagaaagaaatccaccttatgtcgtcttttttgtctgcaaaaataaactcagccatcatacagctaacaggtacagagggaagatacga

SEQ ID NO: 110255 - DNA, 1030 bp, Homo sapiens
gaaacccctcttgtgatttaggtatagattttttgtgtgcatatactgactactggccaatggatgaggtgttcctagatttttgtaggtcatgtaacaggacattttcataaagaagtctttcccaaaacttgaagttgttttcttgatgtgaatggatttggataggaaatttgcatcaagaagtatttcttccctgtacattggggaaatatgggaggcagtgatctgtcaactttagattgtaccctaagttctttggctctgtagggtaaatagatgcacactaagagcctaccattgacccctaagttctctggctctgtaggataaatagatgctcactaagagcctactattgtatgtcttttggtactgtttacagtttgaggtaggagatttgcattcaacagttgtattcagtatcttcatccatactaattcagaataacagaacccatatcagttttctcctccccttgaagttttcatcagacatggatcaaggcacatattttagggccagaccaattaccgtagcatttatataaaccacactaatcaggtctttactaggtacctggtccataacaaaacttgaatttttttctgggaggtttcattttttccttcacaagaggattcttagttacctgtccgcccttagtattttcttacattctctactccgaattagataggatcactctggggccataaattgtcagctactgccggcacagtccttgggaagaagcaccaaactttctggtataatctctgtcacaaaatatcttgccctcaagagtcccacatggctctcacccttactgagcacatgttcacttctcagcagacgcatcatagagacagcattagcatgttttcttgcggagtcaagatttgcagtggacctcaacattgtagtttgacaaaaggctgcatccagttggtgctggtaagcacgtagacaaggaagattctgtcagtccacatccgaaaaaatatccatggctgaggttgggactta

SEQ ID NO: 110256 - DNA, 1007 bp, Homo sapiens
ttcttatataaaatattagatggaacaaagagcgggtgcatttttacctgatttctgcaatcaaaaacaacatatgctgaggcaggtagatcatgaggtcaggagatcgagaccgtcctggttaacacggtgaaaccccgtctctactaaaaagtacaaaaaaattagctgggtgcggtggcgggtgcctgtagtcccagctacttggggggctgaggcaggagaatggcgtgaacccaggaggcggagcttgcagtgagccaagatcgcgccactgcactccggcctgggccacagagcgagactccatctcaacaacagcaacaataaaaacaacatgtggtttaaagctatttgtaggaagagagccctctaacgtagtatttgggggaataattacttattttgaggtattgttttgaatcgaacttttttttctttttagtttttgtatgactgaaacttttcaattgctgatgtgaagaggtctcaaattgctagctgattaaattaggctgaaaggttgttaaagaatatattgcttttctggtcacccaagcatttttccctctttacattaagttctttgttttgtcagagaattcttattttcctactgagatttcagaaattttctgaaataggaaatggaaatgattgcacaagaaaaagtatgctgctgatagaaacagatttttaacaaatttaacattcgtattggttgttaaactatgagccagtaaaaaattcatatgcattgtttaaatagctaaggctacatttttttcccctaggtgttaagcctgttttttcatgtggtatgtacaacagagtgttttaggaaaaggattttaaattttttaaggaatatttttataaagctaatcactgtaaaaaatgttcctccttatatgtaggtaaattaaacatcttatgtatataagatgtttcaaaatactattattataaaaggttttaagaagtaacatggcattgctcatgactag

SEQ ID NO: 110257 - DNA, 1062 bp, Homo sapiens
ggtatagatatacatcaaaattggttcagtaatgtttttccagattttaagtgattttgatgtattagaaaatactgaactttttttactgtccaagtttaatttgtaattattctacttaactttgccagatgattgatttttgttgttgttgcttgaattgtttatagagaggaatcaaactacaaaatgtgataattgaggtactctttttaccattaaaactatattttaaatcagactacagtgtttagtggtgtagtaagaaagcatcacatatgacaagctctgggctcatctcttattgaaccgtgtaatgaatcccttgctgcaacatctttgcccctcccccaaagcagccagcatatatttgagcatagtggctctgctcgagttgtatcttattctcatggaggagatagcagagcttgtactgcagcaagtggagctctgtggtgaatccgatgctggattacattttaaggatattagcaaggccctgacaaagtggtgctaaatgagcactttcattctggtaatttgactataattttagtgaagcagttttattatgcaggaaaaagaaacagcattttaattccaatcatagtataccgacctgatctctgctgtgggggtggaaacaatgaagaatgcaacattttaatacaattttttttaaaaagaatgctttggatctagattaaatgttcaagacagtcagcaaacaacatgcacaaaggcatttttctggaatttcagtcttggatcgatttaaatgctcagggtctgaaaaaatgtctcctagcatcaaaaacttggattgcttttctccgatgttatgccactgtaaagtagcatgctccaacagcacaatatccttaatgtttggatgtaaggtgggtttgaataatacttccttaaaaagcttggttttaaaatccaatagtatttcagcaaagaaatgtaatttaggttagatggtttgattgactttaattcatgtaatagattcctgtcctttgtgtgtctgacatgagtaaagaattggtctgtgcacag

SEQ ID NO: 110258 - DNA, 1026 bp, Homo sapiens
tgaatgaatgaatgattttttgaggttaagacctcaaaaccacaggcaaccaaagctaaaaaagacaaatgagattacatcaagctaaaaagcttctgcacagcaaaaaaacacaatcaacaaagtgaagagaaaactcacagaatgggagaaaatatttccaaactacccgtctgacaagggattaataaccaggatatattaagagcttaaacaacttaatagcaaaaaaacaaataatcatattttaaaatgggcacatttaaaatgggcaaatgatctgaacagacatttctcaatagacctgtcgagtgtgggaaacaatgcccagtacatggtaagattcactaattgttagaagatctttttgataatttttatgaaacagtaaaatatgtaggttcctggctgtacagaacagtcttttctgaatcattctttctcttttccctcttttatagttcttgttccttgctttttatgactagtgtgctagttgtctctccttatgagaggtggtggatggtttaagtacaggtctatcatcgagacaagctggaggtaggaataaaaggaatatgaaagggaggagatttaaagatgcttctacccatttctttttctactttataaacctcttcttttactgcttttactttggattttaaaagcagtgtctcaaagagattatactgttttcatagcaatattattcacaatagctaaaatatggaaacaaagtatccattaacgaaataatggatacgaaaaatgtggtatagacatataatagaatattattcagctttaaaagggtaggaaattttgacatatactataacatggctgaaacttgaggacatgatgctgagtgaaccaagccagtcacaagaagacaaataccatctgactatacttttatgtggtacttacggtagttaaaatcagagaaacaaagtagaatgatggctgagggaatgaggagttattgtctgatgagggaatgaggagttatgtctgatgact

SEQ ID NO: 110259 - DNA, 2171 bp, Homo sapiens
caaggttgtgagatgtgatgactaaaccatcactgctactgaactgccaaatcttggtctccatttacagtagtattaatgccatttactaatttaaggctgtcataaatagctctgtattccttttctgattaatatgttttaaatccaagtgtaatgtttgttttgttttgccttttagtgaaaatgaaaatgtacttctcttcgagttaaaaaaaatactcttctggatttagatattttgtgggacaaaaagatgctagtgagcatttctagcatggcagcgtttctgattattgttcatacacttatatacatttttatgtactttaatcagcttggttacagtattttgtgcttttccacataatgtctaagagagatttatttttgtgtttgtaagttcttgtgttcttagctagctgctttgcaaacatgtccgttgaggtggagttaatattgttagaggccaggcagtgaagtgtcatttttgtcaggctcgtaatcactgtaggaaaattaactcagagcataaaaggcccaacaagagtgatttaggattattgttatatatggtatattttcttatgttagcaataaagcactctgcttaaaccgcagctgagggcatttcgtgttctttagcatggaggtttcccagctgtcaagtaacttctgagagtaactttagtaccagaatttcttgtaataggatcatgtctttctttaagttcaggtgtttcattaaggcaagctggagataggaataaaaggattatgaaagagaaggagcttgaaagatgcttttacccatacctgtttctgctttgtcagcctctttttgctgcctttattttagattttagagtgatgctttgccttgtcttctgaaacagttccctgaatctcctacttgccaaaagttcatgattcttttggtgattctttatatgggtaaagaaaatgtatgcccgtgtgtggggatgtttgtcattccagtgggtgcccagcaaatttgttttaacataactgatagaattttaggaattaagtcaccagagaactgttgaattgttttggtttatcagtttgggaattatgaatacaaaatttgactcctttgggtaaaacagctatcttttatttaaatattcatatttatattagggtactttcacttgtaggttgtattaaaattgtatgttagaagctttgaaaggggtattaaatatgttaaaagaaagtctcagtacaggtatttcagattttttagattttttttaaaagacttcaaattttttaagttaggttttaatagtgaatagaaatgctgccctctactgttggctgattgtttgactgccacgtaaaaatgttcagtaacctgtaatagaattttttagtgtagatcatattactgtgttgaagtataattatgttaaacgttttccttataatttagttaagttataatcaagtgtttcctaataatgctaactactattaaataagttcattaccattttggcttttagaaaaacttgagtcctggagaaagtttcgtttagtcttagctcctcattttatatggtgaggttttagtacttcctagattgatcccttatggttgtgtgactgaaagctcgtattgataacttataaccaaactataggtaaagatacatttttctaaactaattatttttagtttatgctatgtaaaatgtctgaacttctgaaacttatgttttacatgtaaaaaaatttggaatttaaatcactattaaatctttgcatgtttattaaaatgaggcactgctttaaaaagtagtactgttgagcaaatttaaacctctgattgatgtttttcaccgtgagtggagggattagaagagacggttttaaagattccttttagcttcgctgagtgcctactgtgtgtgaagtactgtagaaaataaacacggaaaacaaaggctattatagttcttcctttagatcaggagttggcagactatggccagtgggccaaattgggccacactcactcatttacttaccttgtatggctgctttagtgctacagtggcagaattgggtagttgcagcagtgagcatatggcctgcaaagctgaaaatacttactctctagacttttacagacaatgttt

SEQ ID NO: 110260 - DNA, 1426 bp, Homo sapiens
catatttttagtgattttttttttttttttttttttttttttttttttggtggttgtcatttgagtatccaaactgtagctaacgaggagaagcagatttaaatttatatcgggggaacctctttgtggagcatttcatcagatgacttcctgtcaacctcatatcttgaaaagagggattaatgaaacagcatctgaagaagcagtggactcttgtggaataaaccctgacatcttccacagtgttttgtgggataatttcaagttcttcagatacagattacataaagaagattgtagggcacgtgacagactctggtttcttgtattttagatagtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaaggtaagatataatatgcttttctgtatttcattgttagtgacagatgtgagagaccctttgttcagtgtcttttaaaaataaggtgtaaccattgttatagatttgaaaatagatgtgtgaatccatgtgatgcttagtttatatcctttagaaagggcggtattttgaaatgtgttttagatagccaaaagcgtgttgcacagatgttttttccctgagatttacaggaagcctttctcccagcagcaagggtctgtaaagtcctgattatatttaaatcttctcagtgtattctcagagctactcttctcccctttgtgtcccaacatgccatgctagttgaaagtataactcgttttgagagcattttctggactcttccatctattataattatagttaattttttgtttttttaggaagaggaaaatagtcaagtgctgattgtgttgcctttagaaagatgttgatgtggatttaaaatgattagacttgtacaagcactccttgaaagtacttgttttgaagtctgttttgctcattgtgttcaaagtgcagcatgcttcacttaatctctaagtttggcttcttttatttttgagcaccagtttgcagacattgtgtgatggtgttatagattcagcgtgcttacatttaaaattcatccattggtttttaaaatatggaataatttacctttttttatttctatgcacttacgatgtctcatagtgattgctagacaaacttgttgagattttaaaattacattcagtaataaaagagtaggtaaatttgtaaattctgaaagtagaggctattactctttctgtataatgaattatttttcataagaggaaaagcaggaaaattgatggaaattagt

SEQ ID NO: 110261 - DNA, 1562 bp, Homo sapiens
tttggattagggatacccaatctgtagtagtaattagggataaatggtcaagtgacgttgtagttcagaaagggccatatctcaaacaacttaaaccgtataaaactgatgtttgaggtcacagagattagatcattaaaaagtggttgtggttatgatgaccctagacatcggagatgaatgtgaggagtttaactaaaatttgttctttgaaatgtgactggaataatatattagacatactattttaatgtgttgttaagtaattatatgttaactgattaatttggatatttgactatttcatcttattcttacaggtttgtaattgagttggcaaacttctatttttactgggaaaatggaatgtctaattttcaggattgtttcaggctgttttcaattttgtaatcacctatagtttaaatattagaaaggccactcattaattcagcaaacattgtggtcaccctgctatcccccaagatgatggggataaagtggtaggtatttgagacatttcttttcttttttttctttttcttttgagatggagtcccactttgtcgcccagcctggagtgcagtggtgagatctcggctcactgcagtgtccacctcctgtgttcaagtgattctcccacctcagcctcccgagtagctgggattacaggcatgcgccaccacgcctggctaatttttgtatttgtagtagagatgggatttcaccatgttggccaggctggtctcgaactccggacctcaagtgattctcccaccttggcctcccaaagtgctgggattacaggtgtgagctaccatgcccagcctcatgagacattcttgagtcttgtcctgttggaccttagaatccaacggatttaaaaactgaaacataggcatggtataaattcaaggactcttaggagtcattgagtttttttattttacaaaagaggaagttgagaccctcctcccacccccccgaagaaaatgactgcttaagttacacaggctgaatgatatttctaacttgccgtagtgattttcagccttttctattatgaagtctgccaaacttagggatgcctgccctctctgggctagactactctagatgtgataaaaatttcacaagagaaacttcagaatactaagagagcaaccaggtaaagggttttacatacctccttatttttcttcgcaaaatgcaatgcctagtcagtacttagatatcacttccattgttttcagtattctgcttaaaaatgataaactttatttagggagttatgagccttgagccttatatgagctttactctttcatgttgggagcaaatgataattgcaggggtggggtggggaaaagggagtactcaacagagcatgtaatttccaggctatatcctgcatgggataagggatgtgttggcccatgatgacatttacatagctacatacatatgtatttaggtctgagaggagaaaaaccattttttccctctgctctcaacacagcacacttctgtgctgactagatgtgtgaggaggtttttggtga

SEQ ID NO: 110262 - DNA, 1053 bp, Homo sapiens
gggtttcgttgagtttcccccttctgctacagccaggaaactttttctgggcatttacaggactcacctcattagtttctcttctcacagggtccagtgtctgaaagtcagtctttttttttattccattatggttggcagcaattgcttgtttatggaaagccattggtattctaaaatactgttaattatcttatgtgcctattaggtgaagtgttgccatcccaaaaggcttatatttcaagtccttctaaagtagctcatattacagggtgatttctaaattacttttaacagcaaatgaccatctgaagagaacacataggcttgaaatgtaccttactcagtgccagttgggtacttacagatacttacagaagatgcagttagtgtagaatttaacacaaattgaataatcattccctgagtacagccttaaaacctgtaagtattagatctatgcaagcttttttgaaggattattaggtatattaaaaaataatatagtaaggggttagttacatcatgaaggttataaatacacgcctacagtacaggggaaagtggcttcctcttctgtgaatgagcactacaagttgagtgttccttatccaaaatacttgggaccagaagcgttttggattttggatttatttggattttgatatttgcattatacttgttggttgaatatccctgatctgaaaattcaaaatctggaacgtggctaggcacagtggctcacccttgtaatcccagcactttgggaggccgaggcaggtggatcgcctgaggtcaggagtttgagaccagcctggccaacatgtcaaaaccccgtctctactaaagatacaaaaattagctgggcgtggtggcaggcatctgtaatcccagctactcgggaggctgaggcaggagaatcatcgcttgaacctgggaggcaaaggttgcagtaagttgagattgtgccattggactccagcctgggtaacaagagtgaaactccatctcaaaaaacaaaagataacaaaatctgaaatgctccaacgagta

SEQ ID NO: 110263 - DNA, 1027 bp, Homo sapiens
tttttaataaggaaggcttttctaaccatgaccaaaaaacaccacaaaaattaaaaggttaaaaatgctgctgactttatagaatttctttgtggactttgacttcaaattttgattgtagaacttctgaatcttgaaagatataatacaaagataaattatatattaggatgaaaatttgtcacatatatgaaaaaggattaattttaatttccagtcctttcaacttaagaaacttcttatagaaactaagaaaaaggcccgtgttcaataggaaactgacttaacagtgtgagtattgtagtttgaagaagaagaaataaatgtgggccaataagcctatgaagaaatgctcagccacacttaaaaatgcaaattacattgacagcaaggatatttttaacaaatttgattgtcagagattaaataaataggaggaaacagaagctcctgtacagttagtaagggagaatacagtagtgcaactaatttgaaagacaactttatattcgtatcgtttgatccagcatatgctccagattcaccacagattattgaaggtatttgtacagggatgctcactgcagccttaattagtagaaaccaacaagggatataaaagattatcggtaagagatcggataaacacattatggtagagccatttaatgcaagataaagtagcaggcaaaatatattctgtgtatccattatgtgttattaaatgagtgaaagcaggttacatgtcaggaggcatagtatgactgtgtgtgaaaagaaaaccatgaggttaggcatgtctggaagaatatacacatagtctgctttcaatagtactcttttaaaattgataaataattatacatatttatatggtgcttgtggtattttgatacatgcataccatgtttaatgatcaaatcagggtaattgggatatccatcatctcaagcatttatcatttctttgtgttgagaatattccagattttctcttctagctattttgaaatatacaataaattgtt

SEQ ID NO: 110264 - DNA, 1042 bp, Homo sapiens
ttttttttttttttttttttgggacagagtcttgctctcccaccgaggctagagtgcaatggtacgatctcgtctcactgcaacctccacctcccaggttcaggtgattcttccacctcagcctcccgagtagctgggattacagcacccaccatcatacacggctaatttttgtatttttgtagagatggggtttcaccatgttggccaggctggtctcaaactcttgacctcaggtgatccacctgccttggcctcccaaagtgctgggattacaggcttcagccaccatgcccgaccccaaaaccatttctttaaacagttttttgaagactgggtctcactatgttgcctaggctagtctcagactcctggtggtggtctccagcagtcctcccacctcagcctccagagtagctgggattacaggtgtaaggtaccacacccggctctctctcttaattttaaaaaataacacatcatttttataagaacaactctattctaaaataagagtgagttagttttagagattataagaaaggatatagacttaaaaaaaagcaagagtaaagagtaggaggaattgcctgatttaatgggatatttcagtagaaaagggttgatttataaggaaggatagatgactcttaaaaagatgaggccaggcctggtggttcacacctgtaatcctagcacttttggaggcccaggcaggtgaatcacctgaggtcaggagttcaagaccagcctgagcaacatggcaaaaccccgcctctactaaaaatacaaaaattagccaggtgtggtggtgcgtgcctgtggttccagctgcttgggaggcagagacgtgagaatcgcatgaacctaggaagcggaggttgccaaagaacccaggaaggcaagatcgtaccactgcactccagcctgggtgacagggtgagactccctctggaaaaaaaggcaagatgaaagagtaggaggaatttcctgatttaatgggacatttcagtagaaaaggatgcaccctactcctaacatc

SEQ ID NO: 110265 - DNA, 1044 bp, Homo sapiens
tatgtattaggaaaaaattagattttggttgactcacaactgaaaacattaattttgttgaaacctactcggtcaatcttatcacagtctattcctcattttccattcataatctgcaagtgctttccctgttttggcctaaactgggtttccacaagtccgattcctgaacgcagatctaaacaagaccacacaaagctctaacatgtacactaagaaacctccaaaaatcaaacttgaagaaaagcagttaggtccaacagaagaggccagaatcattcttatctattaaaaaaaaaaaaaaaaaaactggaaatctccaagatcacacatttcagaagccttcaaatatataattttcttttacataaaaatttttcattacctttgttattttcttgctagaattcaaagtttgcaaacaatgggagtaaagggaaagtgcagaatcccagaaatactctcaaagggggtgaggaatgggagaaagggaactttcaaataggcaaagaaacattctagcttttggtgacaacttacataatcttaaacagagaaacccacaagccaagaaacatttctcaaactaaagaaataaggcaatactaacttagggtcaggggagaaaatctaaatacaggcccaagagtatgtaataatttaacataataccggtgacatttctaatctatgagaagataataattttatttgatggggaaaagagaatgaaaagataagccacagacagggagaaaatactggcaaaacacatacccaataaaggactaatattcaagtggacaaaaaattctttaagactcaacaataagaagacaatccaataaaaaaataggcaaaagatacagacagacacttcaccaaagacagagatggcaagtgagcatatatcaaatatcaccagggaatttcaaattaaaacaagatactactacacacctattaaaatggctaaaatccaaagcaccaacactaccaaatgctggtgaggacacagggcaacacattgctgacaggaatgca

SEQ ID NO: 110266 - DNA, 1065 bp, Homo sapiens
attttttgagggcccaccataatgttttccatagtgattgcagcattttacagtctcaccagcagcacacaggatttccagtttctccacatccttgccgatacttaatttttttcctttctttttttgataatagccatcctaataagtgtgagtatatgactcctcttcaagtgtatgtaaaacataataaccaacatttattgagcactttctatgtgctaatacaaatatatcatttagtcattgtaatcctgtgaggtgtacattcacctgtatgaggtgtttgtactgttttatagactggaaaactgaagcactgagaaatgaccaatcttgcccttggaccctcagatgctaaattgcggagccagaaattgaactcaactaatctgaatccatagatacttctcaccgtcaaccattgggatattctttatcgttgtttttcagaactgagtattttaatctgataaagaatactaaatgacaagcatgcttaagacagatagcaatctttagggttagtaatctttaaatgattgtcactttgaaggaaaatatttataatggtgcattatgtttatgatgatggaaatcacacattttgaaaacagtgtttagtaatcagggtttgagatcttccagctatagtggtaaaatgtcaaaatttcttaaatttcttttgcattatattagtcccactgatgttacattttagtctcttgctaactgtgtgtgtgtgtgtgtgtgtgtgtgtgtgtgtgtgtgtgtaactttgtaggctagatttgagtaaggaaaacaggatatggatcacatcgttggctgaaacttcctgaaatggagaattttagtaacttctcacttgatggttttgattcaattagattgagttctttgctcatagtttgcttactactgctctgaagcagtgttttgattatgttgaatctggctgaattctctttagaaccttggaatcagagttgtaaaggcatctaaatatttcttctaagccatttcctctctgcagggtcatatttttcctcagtgcagaatcca

SEQ ID NO: 110267 - DNA, 2671 bp, Homo sapiens
tccttaataaccctgaattggtgttttagtatttcactctatcattcttactaagcactattctgtaagcaactgtgggatactaagaatttgtattttgaaatgttaaaaatttggattatgatgacaaattgtagataatctgcttttgcattatcaggtaatctgaaactgttgctaatactttgatcttttactttggcaaactaccagtacacatttattccaaactgctcactctcctccgttttctaatgtgatatatgtttaaatttttcttgtatttctttaatttttttttttattttttggtcattctaaggaatatgtgtacatgaacatagtgacatcaattgacctgaaggatttgcggaactatttagatgtcatgcagaattatttgcactagtatgtgatactttttttgtaaatagagagttttaatcaggctctgctttttcttctcagatacccagagagcattgcaccttttggaggaatatcgttcaaaactaagccaaactgaagacagacagctcagaagttccatagaacgggttattaacatatttcagagcaacctctttcaggctttaataggtgggaattaaaacttcgtaactattatgccagctaggctttatgctcctctcaattcatttattttaaacttaagaaaatgatgtacttaattctctgaggcattcggtaacttgaacatcttcagtgagttgtgtgtttttcataggccagtgtcctttcttaaaataactagtaaccaaaaaactttcaggattatttcagtggcttttgagaacattgtttcacatcttaatagcattaactattaaaagatgttgcacagatgtttaaggacctaaaaggtatgactgagttactgtgagcttgtttctgtatttgactggcatgtctctgaagtcattgaaagcgtgtgaagggttctgctgtgttgaagaacattcattcccttaatgtagatttctgtttgagcttggcattcatggagtcagaattttagacctggaaaataatcttagagatgatcttgtctagtaaccgtattttacaggcaagaaaatggaaagttttattcttaattgtaacttaatttgaagtggtgcattgtttgaaagaactggaaaaataagagtcctgagttcttttgccactaattgaatgatatatcccaagtcatttaatcttttctatgccaccatattagctgtagaatgtagctgttgaaatgacagaatgggtttaaagccttttttaagtagataaatcatttttaaaagcatcatctcatattttgtgtataatctcctatgtataaaacaaggtgacttgtctggctcttttgtccaggtacctcaaaaagtttgcaaaccaccgaactagaaagtttgtctcttccaattctaagaatgaagttttttttttttgttttagttatcaactatataacattttaacataagaagacatatacttaattatattacatttatttcttcagtaacttccagtcagatatggccttacatctatctgttgatagaataattgttggtgtgatttgaagactactttcaagtcagtgtgtcctgtcaggtacattattgataaatggatgctctctacggttttagaatgaaagatttttgtaaagaccacttgatgcacctgaacaattttgaaaaatgtaacattttaatagacttttaaaaacataaggatacatagcacagtgtaatgaactgccttttaactgttacccagctccagaaattcacattttgccatttttgtttacattgatggacattttttacacatttgaatttctgaggtttaaggtccgaatggatgatcaaattggattcctctggaaaaacagcaaaaagcattttttagttatttgttttctaaatcaacattgagcctagtaatttggtgcagttactgttgcaaaaaaagtatgttttttcgcaacagtatagagatatatatatacatatatgtatagataggcagatagatagactgcagacttttctttgtgtgatggctgtaacttaagaaaattaaatcgttagtgaaataacagaatctacatttatatttctgtctagattggggatgggtttgctgtgttcagagacatttttgacctattctgccttgcctgttttgaatgtgtctattcttacgtacaattgaactttgatagagttagctttcttctctttttttttttttttttttttgaggcagagtctcactctgtcacccaggctggagtgcagtggcgagatctccgctcactgcaagctccgcctgccaggttcacgccattctcctgcctcagcctcctgagtagctgggaccaaaggtgcccaccaccacgtccggctaattttttattttttgtattgtatttttagtaaagacggggtttcactgtgtaagccaggatggtctcgatctcctgacctcgtgatccacccacctcggcctcccaaaatgttgggattacaggcgtgagccaccgcgtctggcctagagttagcttcctaattactaagtttatatttgtgaatcttctaatttcattggttgtgaatttactttgacatttaaatttacttat

SEQ ID NO: 110268 - DNA, 1046 bp, Homo sapiens
agcctgggatatccactcaggctgggaacaggtggtctaatgtgctgagagcattacagagcagattcaagatccttttgaattgagtggatctcagagtatcagggctgggatgctggccttctacagataagaaaactggagctcagcatctgtggctggcaggacccaggggtggggaatggccccacagggagcggagcccgggagagtcaatggtgaggcccccagggtacaggcaggatcgacctaacaggccaccctagcaaggcattcatgcaatggggtggcaggtttctggaaaagacctgggaagctgagggccagagagcagaggggacccactcaatctcgtccagtgtcagggacagagacagatcagaggcaggatctggtctcttcacaggagggaatggctggactggaagagagaggaggagagggaacctatgtaaatccctgaggcaatggagcctacccaaagcatgctgggagtagggacagagggtattggggagctattaagggagccgagcccgtctggatcattctgcgttgtcctagaccccgctccactttctaccagctctgggaattcacctgctctctgctctttgcacagtccccactttggaaatggggaggggctccgagttgggtatgaccctcttctaaacaaccttcagcttcagggccctgtcagtgatgtggccttctgcaacatccagtcactcactgggtatccctgtgtcctcaattagtgccggacccaagctgggtccctgccgcagcagtctcatgatcttgttggggaagtagggggacatttgaggcacccagcacaaggcactctaaggcaggcatggctcctggtataaccagtgggttgttagaagaagcagagaagagcctcatgggcacgttggcttttggaggagatgaggctggaactggagtttgagcattacgtgctgggatgggagtttcgagtaaagtcactgcagtaagaatacacacgttttctcgcaagggtagagggaaggaaa

SEQ ID NO: 110269 - DNA, 1029 bp, Homo sapiens
ctattgactgagaaggctcctgggtggctcagaagtggttccagccaagcctctagagacatgccagacttctgcccgctgtgtcatagggcagtaacggcttagcaggtacctctgtctccctctgtaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgcca

SEQ ID NO: 110270 - DNA, 1119 bp, Homo sapiens
acatacagcaggaagtgactgatggggtcggcctgagggggggatggagaccatagagcaggaaatgactgatgcgggggtcggcctgagggggggatggagaccatagagcaggaaatgactgatgcgggggtcggcctgaggggggatggagaccatagagcaggaagtgactgatgggtctgcctgaggggtggggtgaagacggaggtggaggagtgagtgagacaaacagacccaggaggcttctccagcagcccaggagacaggcagcgaggacccaagggaatgctagtggaaacaggaaggaagaactgacccagcagaggaaaccagcaacagcctggggcgtggggactttgtcctcagagagatctgggtccaaatcccaccctccctgcctgttagctgggtgacattgaccaaggtgcttaacctctctgagcttcagttgcctcaaccggatatgagacaatttaggatctattttccagggtggttgtgaggatcagggaagttaatgaatgtaaagggcttgattaggggtctgccagctgtcatgttgatcttgagctgtaatattagcagtactgggtgactcagtaggtgggggaggggtggaggagctggaggagtcacagacaaaagtaaaatcattaacaaagaggaggagcaggcttgggcagcttggaaacttgacgtgttggttgtggttagggtgagtcagggacccgtgggacattcaggtggaagcgagacaggagatgggatgaggagagagagccgtgactcccaaggagaactgaggggccactggtgcggaggcgatcttggggatgttacaggaaagttgctgtcacccaaccagcgggcatgcctccgtgagtttattcagaacattggctgaggattccagatggcaactaggtccaccactctcaacactcattaaagctgtaatccaggggctgtgcactttcacaggtcatgtttcattaaacttttttggatagtagcgtcaaatgtcattgttttatttttaggtagagaaagggctgtatgcattttaagtcatgggatattgtccgttatgaatcaaacacaaaacggctgcaaaat

SEQ ID NO: 110271 - DNA, 1261 bp, Homo sapiens
accttcagaattacaaacttttgtctttgttttccctcaagaatgtgatttaacttgttggaaatcttgaggagaagaatctccaaatcaaagcctgtcttcccatgagctttcttagatgtgaagatgactgggctggaccctcacttcacatctcctgctgcaggcctgatgtctgccatactccaagccactggcctttgagcatgtaaaactttcccgccccattcttgaatccatatggattccagtggaatcctgccttggaaaaagggagcccgcgaaaatgtgtgcggaaggatctgaggaaatatgggtcacgcacagcttcttggacaagccatccgtccttcacaactggggtttcctcttgggagttccatccccacttctgctgggtaaaatttaggacactttttttctctctctgtattctcattgctctatctggactctcctctgcacctgtctgtctaccggcaggaggccccaggaatatcaccattatagttgaagatcccattgcaggtttgggaatcggtcctccacctcctctttgttctgttttgtgaccacctttcttagttcagaacctccttcagtctggtgtcaaatcaagtctggctagcctggtcttgttgtgatgcttggaactgtctataaaatgataccagtatttcatatgatgtgttttctatacacaattccaaatgcctcgttcagtctctcaacagcttctgggaggcagagtcaagacttatcaattcagttttgcccaaaggtgaaactgaggcctgctatttgtctgaggcatcatgatgaatcagtagcagacttttttttctttttttaaattttttttactttttttttttttttttttttgtagagacagggtttcaccgcattgcccaggttggtcttgaactcctggcttcaagtgatcctcctgtcttggcctcccgagtgctgggattacaggcgtgatccaccacacctggcccagaatttttcttataactgaatacttcctatggattactttattttccttgaattaacaccagaatgtattttatcccctttctgtggtcttagatatacttgcatgtttggtttttttgttttttgtttttttgttttttttccctctcctgcagttccgtttcctttttctttcacctgttttcatttccctataaatccctgcaccccattccagctattgcataggattcttctagttatttcagtctgtttc

SEQ ID NO: 110272 - DNA, 1115 bp, Homo sapiens
tgcactagccagggattcccctttgaccccaaatgaaatgagctccagtactctgaccagccccatagaggcatcctgggtcagcagccagaatgattccccaggtgatgccagtgaggggcctgagtacctggccattggcaacttggacccccgaggccggactgccagctgtcagagtcacagcagcaatgccgagagcagcagttccaatttgttctcctccagcagctcccagaagccagattctgctgcctcttccttaggggaccaggaaggaggtggggagagccagctgtccagtgtcctccgcaggtccagcttctcagaggggcagacactcactgtcaccagtggggcaaagaaaagccacattcgctcccattcggataccagcattgcctccaggggagctccaggtaatgaggaacaccggctgctagttagcaagatgaccctgaattgagagtaagagagggcttgttatggggacttttcaggtggcagaaagagatgttctgtttctggtgatacaacatcttattttgtaatgaaagaagtttataacgaaatactgagactcaaaatctctaagtctatttatgtttgtttctttatacattgctaatattaaatgttttcctggattctttactagtttggtaacatcagaggatagcgtgactcatagtgcgagttttcaaagtatctcttggattggggaaagtattattgagctttaaaaataatcccattaagttctgtcatttcctgtgacgtcttagaagtttgcccagggtgtaataataccaatgtgagagaggcagagagatactggggtttctaattaaaacgaaggctatagtgagtgcagggtgatgcgatccagcaactgagtcggtggggctgacggccgcatcactgattcagggtgagaggccgtcagataaggaggccctggcagctgggacctccctcaccaaacaccagctgatagcaggggcagcctactcgtggggaaggtggggctccttgcttttgccatctccctgccatcatccttcccggcttgtggtatccggcaggctttggttgggttttgtttgtagtaggat

SEQ ID NO: 110273 - DNA, 1089 bp, Homo sapiens
tgttggccaggctggtctcgatctcctgacctcaagtgatttgcccgccttggcctcccaaagtgctgggattacaggtgtgaggcactgtgcccggcctgattcgtttaattttgattgttggttactatccatttaatactttgtatgtgccaggcacggtgctatgtatgataaatgtatcatgtcattgactcttcataaccctgtgaagtgggcattgatctcattttataaaggaggctgctgaggcacagagtagatacgtggtccaaagtttggatcaaatagctgataagtgtcagggcctggatttgaaccctagtctgtctgacttctgattccacatacatcagcactttgttgtgctgcctctgtaataaagtactcctggtttaacacctggaaggattccagtgcagatgctgtggtttcacagttgtaaattacatactgtagtagaaggtagccttgctgtatctacaggctctggctaaagtccaggcctactgcaaaggtagcttctatggcatttctgcagtactgcgttgcccccactctgaggccctttgtccttaactctgacacattttttggttttgttttgctttttagtttgccagaaagcacgagagcccgctcctggtgacaaagagccagagcctgacagccctgcccagttccacatacacccctccaaacagctatgctcagcattcctactttgggtccttctctagcctccaccaatccgtgcccaacaatggctcaggtatggggacaggaaaaagtggtcattacatttatccccagccctggaaagtaagaagactttgtggttgctcataggcttggaaaattgagacttgggttggtagtttttcttaataagggacatctttacaagttatatagtgactagcttgaaataattcagtagaatcatgaagtaacagaagagagagatgtttgtagattcccctgggtttctaatccacattgccaagaaggcatttcaatactagctaacaccgaatgattgccaatcatgtactaggctctgttgtgttcagtttgtatgtgttatcc

SEQ ID NO: 110274 - DNA, 1001 bp, Homo sapiens
ttgctgtttgttttttgtctttaaattagtattgttcacaactttaattctctcagagttgagttttgtgcccaagtaaaaattaagaggggagagaatgttaggatgtggggcaggaggctcctcggcttagactttctttgatatgatcaggatcaagtacagcaaaggtaactaacgattggtgtaactgatgcccttgcaggagggagcactggcagttgctgggtaatttgaagacgacggtggagggtttggtatcaaccaacagccccaacgtctggtctaagtatggtggcttggagcggctttgcagggacatgcagagcatcctctatcacgggcttatccgtgaccaggtatgcagaactcctttttttgccagattggctgactcgcttgttgaaaagaaacagtcgcattggcagggaggagatgaaggccactggtctgtggactcctgagagcagctgtgacttaattcatttttttaatatacagaacgtttcacatcgtgtctgatggaccatagatgttaatggaatgaataaatcactgggtaggacagcaaatcagcaacaaaagattaggtcaacttaaaactttcctattgttgctgtaacaagtaactacaaactaaatggcttaaaacaacacagatttatcatcttacagttcttgagatcgaagtccaaaatgagtttcacggggctgaaaccaaggtgtctgcagggccacacaccctctggacgctccacagagaatctacttccttgccttttccagcttctctaggtttcctgcattctttggctcttggccacttcctccatcttgagagccaacagcatagcaccttcaaatctctctctgcccccccctttttttttttgagacggagtctcgctctgtcacccaggctggagtgcggtggtgcgatcttggctcactgcaagctccgcctcccgggttcacagcattctcctggctcagcctcccga

SEQ ID NO: 110275 - DNA, 1041 bp, Homo sapiens
aagggaagatttatgagatgttcctgggtgaagacttgctatttttaagggtgactctacttttatgtgcaaagtggcctgttgaacaaaacctggactgacaggactttggggctcctgcctgagatctgagaatgatttgtgctaagtgaaactgaacatcttacttcccttttccatgtttcagtttctgctttgcctatttgactatttattcttcctgcagatgtctgtgacgtgcttcgtgtgaaaggtcccatgtaaattctaaacacgttttaggattgttttgatttccctctaccacttcatgtgagggaggctgggttagttatttttttaatgtatgtaacaaatgctatttaccacatgccaggaattgttttaaggtattaagatatgaatactgcgttaacttctttaatccctataactattgtatgtggtcggtactactgttattgctgtgtcacagatgagaaagctgagaaatggacagggtaagtaacttgccaaggttgtacagcgaatccctggcagaactggattcaaacccaggcagttcggcaccagagtctgcgcttttttttttttttctttttttagacagggtctcactatgttgcctaggctggtctcaaactcctgggctcaagatattctccagcctcggcctctcaaaagtgctgaggttacaggcatgagcgaccatgccggcccaagagactgcacttttttttttttttttttgagatagagtcttgctctgtcgccaaggctggagtgcagtggcaccgtcttgcttcactacaacctctgcctcccaggttcaaacaattctcctgcctcagcctcccaagtagctgggattacaggtgcccgccaccacgcccagctaattttttgtatttttagtagagacggggtttcgccatgttggccaggctggtctcaaactcctgacctcagaggatctaccagcctccgcctcccaaagtgctgggattacaagcgtgaaccaccgtgcccggcccgagtctg

SEQ ID NO: 110276 - DNA, 1048 bp, Homo sapiens
gagtgaggaaggaagagaaagctggaggaggagatgttatttttcaaacctttctctttatttttggtcttcagtttattttacgtcttcagtttggcctatgtgtggtttttctttgtactaatcctataaattgtaaagttatgttttcaccaaatataggaaatagcactaaaaatgtgattattaatgtcttcagaagatatatgggatattagaggattgaatatttggaagataaagtggtttgaaattaacacgtggttatgtgctatgcttcggagggaggtatttgttaatcaaatctcagtagcttcatgttaataagcaaataattcagagttgtttgtttcttgcacctcatgtttgcagcctatgaatttaactatttttgcttatttttcctcaagatgtttgaaagtagttaaatggcttagcatggcctatgtgtttttgttgcagaaataacattccagctaattttaccaggagtggaaataaattaaatcatcagaaagatactcgtcaggcaacttttcttttcagaagaggcctgaaggtatttaaaaactttggcagtgtttttgtttgtttgtttgttttttcccaaagaggatcctgagcagccacctttagtaagcctcagtcataggcagcattgggttcaggatgtgaggcacgtggtagtagattagttcttcctgttgtatgttttttatttcccatcttttcttaccctcaatagcaatgtcttataagaatttaactcgttatttgggaataaacctgtatttgccactcgttctcatgtaggaattccaacagggaactgttgccagaatagcgtgggcccctctgctgcactcacgcacacaccccactgggttaggaagttctagaatagcacgggcccctccgctgcactcacgcacacgccccactgggttaggaagttctagaatagcgcgggcccctccgcagcactcacgcacacgccccactgggttaggaatttctagaatagcgcgggcccctccgctgcactcac

SEQ ID NO: 110277 - DNA, 1193 bp, Homo sapiens
aaaaaattttgaccaaatttgttttgcttatttttattttgttgctattattgttttccagaaatggtatagtttgtagatgctgttgttaataaaaaaaaaaacagattttcatttgaatttgatttgaatttctgtgttgaactcaccgtaattcaagaaaatttgctataaaatatttacaggtctgaagagttcttacttttatcagtgacatcatgagttggtggcagtgtttacagagcctgaaaataattcagataggggctttgggtgtatgacttctaggcattatagcatatgtgtgttttatatagtatataatgtaggctttatatgaggtcatacatgtaaatatttaggaaattttagctgtcattacttgtaattaatcataagatcacattattgttccaaagcaaatatggccttcagtaaagttgttaattgttgctttgttgttgtttttgtttttttcttttctctagacagggatgacgttgaatgagcggtttgggatcctgaaggaacaaagagccactctcacatacaacaaagggggaagccgctttgtcaccgtgggataggtcccatgtcaaaggaacttttgagtgatgactctgagaagttgaattgcttgaagagttcatcacggaaattcaagaaactttacttcaaaatattcacaaggctaaataactcttatttttatttttgaaggtttttttttttaaaaaaaaaaacgtataaaataatgccctgaaagaataatagggattatacctgtctgttcttaaagatttcatggttggctcagacagaacaatcatctgtttgacttctttggttcctcatgcagcagaaggaagacagaaagatagaaattgattatttttatgatagcagtattcaggatctcatcacctttgcccgtgttttagactttgtcatggtaaatcctggtcttcataaacatgagtaggtcccttggttgctgtcacttgccctttaatagtgttgatgtagtcagtgccgttgccttttcttcattagagacacagaacaatgtattagaatttccagctgtgggtttgaagacttagggggacatccagaacgtgcttcctctttcagacggtgtaaagtcccctggaattacacagctttagtgctgagcttttaacaggaaatgt

SEQ ID NO: 110278 - DNA, 1107 bp, Homo sapiens
gtaaattacagtataatgccaaatgcagcaaaatcttccagctgtacgttacaagtttggtcattttgaagcttgacattttagtttgccattatgttaaaaacatctaaataggtgttagtttctcaggagtagattgttagtgttgacttttcctgtaaagcagacatcgttcttggcctgccctgcattgtatactagatttcattgttgtctctcatgcttcttgagttgcttcatggtttatgctcgccatggaaagctatcagtaacagtttcatgcttataccaaagaattaaatctgatctttaatatctgatattttcctggtactcgtactgataagggattattggaagtcagtcacagaatttggaaataaattctagtctctccttagctatttgatgcttttcatataggccaagaactcattgcaaaacatttttgcaaggatgaatgcctgtatttggtctaggaacagtacattttagtctgatttagaattactggtagcttattttaaagcaaggaaaagcagctgagctcaagtttgctgtctttagaatggtttgtgaaaatatggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggttttttttaaaaacaggatgcaacttaaacttttctttgcatcaaggtatatgcaaaacattggtgccgtgcatcaccaaatgaaagtttgtatttaacgaggaggtgctttacactgtactttttggtgttttttggaaaagttacatttagatctattctgaagctgttcatttttaacaaataaaatgttacaggtttca

SEQ ID NO: 110279 - DNA, 1106 bp, Homo sapiens
gtacataatctattttggtttctactgctttccactcatttttattattttttaaaattatttttcatttttagagatgggatgtcattctctcctaggctagagtgcagtggcacaatcatagcttgctgcagcctcaactcctggcatcaagcaaacctacctcaccatcccaagtagctgggactacagtcaggcaccaccacacctagctaattattttaaaaaattttagagaccagagggtgggaggtggggtgccctcactatgttgctcaggctggtctcgaactcctggcctcaagcaatcctcccaccttaccctcccaagtagctgggattacaggcacaagcaagggttgactaattttttaactcctaaaaatatactcagtcctatgatagcatagagtttaatatattaaggaccttaaaatcttgttgaatattcaagcatcaatctataagcttggtcagttcagggctagcatagtatgttgctattacaatgggatgtattcatacatatagataggaatgaggcctattacagagaacttgacagaatttagtgtagatgtggaaggtaataagcaatcagatgacaatggtgcatttgaaaaggtacatctggcaactaattctacagcattgtagcattagtgtggagtatatgaatagataatcagtcattgtagttgaaatctccctaaaaagtaaaaaaactgcccttaaatagcttaatatctttcgaagaataacagttttaggaagcccaggataacaaaaagctatatatgcattggataaatgttatttgctggggatgacaaatacgtcacctgccattgtgacccacgctcataacatgtatgagctcataacatatgtatggttatgtatcatggaacttgttgctgaagtaactagaatgtattgagagtttatagaacagctctctgggcagctgttactaatcaactttggcactgggattaaacatttttataccttctagcatttagcaattcatgccaattgaggtgtcattgaagagttggggcttgaatgagaggatctctccatccttatttttcttttgctct

SEQ ID NO: 110280 - DNA, 1003 bp, Homo sapiens
cgtctctgcccgtcggagacccggcgccgggagccgccccggccgggggaggcggatgcgggggagttacagcagctcgtcccgtaggcgccgggtccggacccgggtaacggggagaagccgacggcgccagccctccgggcctgcgccagacccagagcctggggagaggcggcgggcggcggcatctctcggggaagggggccggagtgattgatggatgattttttaggctttctgaggaaaatcagtttctgccacggcggaggtagacccttgccccgccccggtttctgcaggccctttcggatttggggtgccgaatggacctgctaagacgggaacgttagcgcgagctcttcacagatcagagtagcaggggtgtctggacgagctgcattgtcaggaagggtcggtctcagccctggagttttttcgaaagaagtgttggggagcgtgtgtttaaagtggacccgaaagaagtgttggggtgtgtgtgtgtttaaagtgaacccgagagaagtgttggggtgtgtgtgtgtttaaagtgaaccccaaagaagtgctggggtgtgtgtgaagtgaacccgaacgctggaacgtctttcttcgcctccatctagttgacttacaaaataaatacgcttgtaaaaataactagagcccactttccgactcccattagtttcctcttccactcctcatgtcctccaaaaaaaagttgaagcaaactacttagaaaagatagtctaacatatttgtacttgctattcctttttaaagcattacttcgtgttatgtatgttttcgaacacaggaaagagaataagaaagtaggtattatttggctttcttagttgtggcgaacagtgtctggtgcccgagttgttcatcatcatgtttgcagtgccgtcatcactgctcactgcagcctcgacctcccgggctcaggtgatcctcccacctcagcctcctgagtagctgggactacaggcagccgcca

SEQ ID NO: 110281 - DNA, 1010 bp, Homo sapiens
gcttggctaacatggtgaaacccggtctcaactaaaaatacaaaaattagccaggtgtaatggcgggtgcctgtaatcccaactacttgagagggtgaggcacgagactcgcttgaacccaggaggcggaggttgcagtgagctgagattgtgccactgcactccagcctgggtgacagagtaagtgctgtcttaaaaaaaaaagaaaaaaaaatattaatcttttggaaaaggggaatatttatttgggaatgggtgacttgatccagtggacaaggaaagtcttagaagacatcacagaagacttcttgaagcagaaaggatataacttggatttgggcaagcagaaacaagaaggaaagctattttaggcagtggtggacagcacgcaaaaaatgttaagagtataagggacatcagttaattttgccagtccattattcagtcccttctggtaatagtactccaattttcctagggaaccacccctctcagttatatgaaccccaccctggcatagggtatgccagtgactcaggcctagctaatggtcagtcagtatatagtccattgctctggccatagtgattgttcagaggtgggcccattttgcaatcagcacacatgagtaactgaattttttgttgaactattgagaaagaggcatgctttgagccctggggttgctgagacaataggatgttagcctggaagttaccaataagtgggaagcagagccaaaagatggaagttctgatggcagtgtttgtacctttgggtcagccgccatgcctaaagtcagtgctatctctgtactttcaaattatgtgagctaataaattcttctttctgcttaaggtgagtaaaaaagttgttgttttttttttttttttttttttttgagatggagtctcgctctgtcacccaggctggagtgcagtggcatgatctcggctcactgcaacttctttctcctgggttcaagtgattttcctgcctcagcctcctga

SEQ ID NO: 110282 - DNA, 1025 bp, Homo sapiens
tttaaactttggtctgtgggacgcaccatgaacagtatcattgtgatatgttacatagctatcaaataatattttaaattattacttttatataattctttagggactttttgaaaattactttttagtttatttcatactgattgtgtatttcagaaattttcatagtttgcatttaccatttctttatatgttaaagaatattattcctataatattctttacagttttacattgctcagtgttgaaaatctcttatacagattatttgtcatcatccctggccattttcgcattcatagtagtgtctgttctcacagaaaatgatggtactgtacatgtgggttttgcataatgggctgattgggtaaggatgatgtcactgcgtgggaccgcctggaggagttattagaagaacacaagacttttgactgctagcatttcttaataaatgccatactgttgaaaacattaatttgtgtttggactggaatgaaccttggttttcctggcttagttactgagatttaaagaaataagtcctaatgtcataattacatagccaaatagaatgaaatatgaagcatttttctccctggcagagagaaatggggttaagaaggaaagaagttactaactgccagtctctgttacacagttgtgagactaatttttgagatttgaagttcaggaatactttgaaattttgtttctgtaatttgtgtattattcattttattgctgagacataagatatggttattagaaaagtccataattttagagatttttaaggtacatgtcactaagaagaggcagattacatttcttttctactttgagtactacatgtttgattttttaaattgttgtggtaaaatatgccattttatccatttttaagcatctgttcagtggtattaagtaccttcatactgttgtgcagctatcaccaactaaatccacttccagaacttttttcattatcccagactgcaacactgtatgcgttaaacactaactcc

SEQ ID NO: 110283 - DNA, 1043 bp, Homo sapiens
ctatgttaaaatcacatttaactagaagctttgtaaaaattctctagttgtaaaacatcattaattgttcatttccattttaccttcttgcagagctggcggagttgcctttgatacggttagacttctcatgcaataaaattaccacaatccctgtttgttatcggaacctcaggcacctacagacgatcaccctagataacaatccactacaatcacctcctgcacaggtaaaccatagtggaagcatcaggtaaaccatggtggaagcatcaggtaaaccacggtggaagcatctggtgaaccatagtggaagcatcaggtaaatcatagtggaagcatcaggtaaaccacagtggaagcatcaggtaaaccatagtggaagcatcaggtaaaccatagtggaagcatcaggtagaccatggtggaagcatcaggtaaaccatggtggaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggattcacatacatatgtatttttgagaagccttgaattaatggattagaagataatgtttccagaagtatttttcctttctctaaattggtatttctttttaaattgaagaattcttccctaaatttttttctaataaaattttagttaatttcttaattttttcttgtaaaattttagttaatttctttatttttttctagtaaaatttgagtgtagacaccataaatgctagagacaggccaggtgtggtggctcatgcctgtaattc

SEQ ID NO: 110284 - DNA, 1050 bp, Homo sapiens
tcttactatgttgcccagcctggtctcaaactcctgagctcaagcattcctcccacctcagcctcctgagtatggagcagtcttaagtagcaagaattaaattcttaggcctttaaacaagcaggatagatgtttcagtcaaagtgaagtaatgtttatggactttactcaaaagagaacctctcaggccttctcttgaacctctcaaattttgcttaaaagcacagtcctagtaaactcgcctcattggacgaacaagaattgcagaggtgtgattgttttgaagctggataataatgagtacatgaggtctcatgctattctgtttgctttgtttctatttggaatttttcatattaaaaaattaaagcccatttagttctaatagttaagtgactgccacatttcttgttttttagaaaattgatctgtttaatttcaaattttaattgttaaaataacaaactttgcagtaacagagtctcttttcggcagccatgaagaactgtactcaagtcgcccttatggagcccttgattcaggcttcaatagtgtggacagtggtgataagagatggtcagggaatgaagtaagtgttttttatgttccgtgtgttataacacctgattaagagaaaacagaatgatgaaaatgaaaagcgtcttaactggattcagtttctcactacataaaatacagaaaagtcaaggtggaggcaagattcccaccctctccagcagaattggcattctgcgtccttaccggctttctgtcacgtggatttccgcctgtttcctcattgcctcatggaaatagtttcatatcatagaaaggcaaacaggagctgagccagttgaaactgaagcctacaatctgaggtggggggtaatctcgagcagaggtgctagatggtgagaaaacaagtaggactttcggctgatgggtagagacaaggaccttagtaaagagtattcatgtgctcaagaggaataacttcctggctaattctgtcgtttttctcgtttttaaattattgatattatgttttct

SEQ ID NO: 110285 - DNA, 1855 bp, Homo sapiens
agattcttgctgtggtcattatttgatctcttttaggaatttagtccttttttttttttttttcagtgtttaccttttcttcacctggaattgtcagatgctcttcaaagtcatctgaatcacagttttccttattctgacattaaaaaatttgtagttcattagcaagcagcactctctctacttgcttatacttccgaagcagactcttgattttcgcattcaattctgtattgcttgaattggtttgaatttaatgtttaatgtttaatttcatatttaaattttgagggccagttataatggaaaataactttgattttccagaaacctattgcttatccgaggagagctttcatttctcagtgacgatttcaattaaatggtttgctgtccttttccttaccatcttagattctttactcctgtcgttaccatttcatttacatttcagtagttgtcttttaagtgtttctctcatatgaggtatctttctccatcagtttatttaagacttaaaataatgttgagatctgtgccggtatgatagccactagccacatgtgataattattgagtatttgaaatgtgtttttttaggctgggcgtggtggctcacgcctgtaatcccaacactttgggaggttgaggcgggtggatcacttgaggtcaagagtttgagaccagcctggccaacatggtgaaaccccatctctactaaaaaccgaaaaaaaaaaaaaaaaaaaaaaaaaagcagggcatagtggcatatgcctgtaatcccagctactcgggaggctgaggcaggagaatcacttgaactcgggaggtggaggttgcagtgagccaagatcacgccactgcactccagcctgggtgacagaatgagactgtatctcgaaaaaaaatcagaaatgtggtttttccaaattgatatgtattgtaagtataaaatacacatcagattttgaagacttcctttgaaaaaaagcgtgtaaaatagtaatattttgcattgattatatgttgaagtgatatttagacatattagacaatgtaaaatattaaagttaatgctgcctcttttactttaaaaaatatggctactagaaaatttcaaacgacatatgtggttcaccttcatggcttgtgttatttttctctttggccacactggtctagattggatgaagaagtaaagttactttcttcagaaatcgtcttaatataaaccattaatttagtcagaaaagttttagcacatttaaaaaatgcatttatgtacctggtttctaatgtggatgtaaacttagaaccttttcatcttttttagctattaataaaactctaataactcaaaattcaattttatattaattgtagtcacagaattatttgtcaataattgagtcagaagactaaattgagaaataggcttccccaagttcactgttccagcaactgcgatttttaggcagcctgtagaacgtcatgaagtaacaggttgtggtttaatgcatctctggaaaaactatcttagtaggaagtttttttttctagtgtgccattttaagtagttgtttcattacttttaaacttaaaaataatgggggattcccaaacttagcagatgaacaagatgtggctaaaaataatttatatacgtctcctcaccctaaagcattttgagaagaagaaactcctcaaatgaatcccttcccatccataaactattataaaatatctacattgctgacctctagcagatagttttccaaataggacaatctttgttctgatcttttttgtttctgcttaattgacaacaattacaggaagggagatagtagtcaga

SEQ ID NO: 110286 - DNA, 1084 bp, Homo sapiens
ttgtttttgagacggagtcttgctatgtcacccaagctggagtgcagtggtacggtcttggctcaccgtaacttctgtctcccgggttcaagcaattctcttgtctcagcctcccgagtagctgggactacaggcgtgtgccactaagcccagctaatttttgtatttttagtagagacgggatttcagcatattggtcaggcttgccttgaactcctgacttcaggtgatccactcaccacctccacctcccaaagtgctgggattacaggcgtgagccaccaaccttggacataaaatgggtaaaaaaaaaaaaaaaaaaaaagacttaagtaatttaaagtttttatcatccctcccactttcaaaatagaaaatcatggggaaaaggaaataagtaaatgtcttttattggctatctaatttgaatgtttttttctggtgtgtgtgtgtgtgtgggtgtgtgtgtggtgtatacagtggaacatgatctggatcagattgactacatagacagctgcaccgcagaggaagaggaggccgaggtgagacagcccaagggaccagacccagacagccttagttcacagtttatggcgtatattgaacagcggcgaatctctcatgaggtagtacacagattgaagcctaaatatgttgctatcccttcataaaaataattcataatagtataaagttttgttatatcagtgatttgttgactgaagcctaattgttttcattatgttcacttctgatttcagtcctgagtttttcagatttattcagaaaactcagacagcagcctcaagtaggctttaggtttatttttcaaacaagaagaaagatttcagaattttgcaggaggaataaaagaagtctaggtactgttaaggccttggaagaaagtacaaagaaaaatacagtgatgcttttcattgttgtttttattgcttttttattgttactaactgataaatcatagtttggtcagtagttaattaacagttaaaccaaaaagttgacttttgtggcaacatgcagacttaaccatagaatttttataatatgctgaattatattg

SEQ ID NO: 110287 - DNA, 1032 bp, Homo sapiens
aaagatgagttacagagacttgagcaatgaaatctgtttcaggaaaaggataaatagtaaactataagaattaacactgatagcagtgagaaggaagtactactttttttttgtttttttaagcattaaaaagggctttgtatttttcttaaaaataaaaaaaccagaatctttatttctgtgttaaaattgcttcatcgattgaaaataagagcaggtgtgctttataagtacagttacgaggttctgtagttgataaaaatgactgtatgtaaaaggatctcagtttacatgtatcgtgttttaatcatggtggtaacgaagataatagttatttgtgttataaagaaatgatgctgtttgcaaggtgatctcaattaactgtattgttggtattggctgacatagacagttgataccacatgaaacgtgagttggaggcatcagattttcctctggtttcacttaatgacttggacttaggtttacaaaatgcagctactccttcaatgctaactaggcagtttgctactgattaatagaaagctacatttacaataaaaatttcatttgttttttatgtatctgtttgtctttttatcaaagagtttttttctttcttttttcttttttgggtcagggttccagctgagccatcttccctcctgtcactatcagcaagtcacaatcaggtaatgtttagtagttgtgtttatttttgctttttaaactaagatgattttttttcttttataatacttaaattgccattaattgccaggtatatttaagcattactagctgtctcaatcgattaatataacatatgtacgtgatacttgctaacagtgtttttagacactagatagaaaatctttaccttcatgatggctttatagtattagtttggtgcaccaacctaatacatataagaaccgtgcaaagacgggaaaagattagccaataaacacatttcaagcaatgctaggtgacttcaaagcaaaagttgcatgggtcaacagtagttcccta

SEQ ID NO: 110288 - DNA, 1109 bp, Homo sapiens
ttactggctcactaaatgaccataggttctttatgttattgttacatctctctccagctttctgttccctccttgctttgtaaggttttaggcaataagatcgtatttgaagttgtttaaactctgggagaagatcagtactcagaaccaacttactgactattataatgcatgaattccagatgattgtgaatgtggtcctctatgtcaacgtcttcaaaagtatgtcttaatatgtctcttcccttgtgtgtgtattcgtgaaatacgtcacacgtgtgcgtagtttgtttctgacatggcttcatttttctccatctctccagtgccccttcccatccagaaggtctcagcacactgatgatagtgccttgtgcatggtaagagttttgcacaaaacggagtttcgcatttctgtgtttagagattgtactttttattcagaaactatctaaataccataaaacatgatgaacatcattactaaatgctttatgaagaactaaaccattttcccacatgaccatttgtgattgacccagtgtttcaaagttctgcagctcatatctttgtcagtgccaccgaaaggaaaacatttgccttgagaaccatattggctttgtgtgtgctgggaatggaggcataacataatattcatgttttaaatgtgtctaattccaggagcacttactttattaatcattaatttggctcatgggtcacctatatgttaaggtgactcatgacactgattgcacagctgtatatttggcatccaattttatgatgtattttcagctactgaaaatccttcactttggttttaaatacttacagctcaagattattccttcatgttcactttttaaacccaaggaaacattaactgctgatcgtgttgaacactggcttacttttattgcctgtttcatcagctcaaaatgagtataagatggaaggtttatttaacatcttattagccttgcgaaagaattctaaccatttctagaatttctttccccatcatgttttatgtgattgttttcatagtagtacgttcagaggtctagtgcctacagtgctagtaactgctgccagggtgcatcctg

SEQ ID NO: 110289 - DNA, 1011 bp, Homo sapiens
ttgcaggcgtgagcttccgcgcccggctgtaatttttaacagattagtgctgggatggcaggcgtgagcttccgcgcccggctgtaatttttaacagattaaatgagtgcccattgtgtgccatgttttgtgatgaatgtaaacattttgctattaaggaaattcttttcagctatttacttagaaaatgagatagatggcttattctataaagctcaattcctagctctactcatttaaattttttccttttttctacttcctgttataaagaaatattgtcagtaataatttatatgtgtgtgcacacatatataaatatcacacttacacatatatagtgagtgattgcctctttattttatgttggaattgaaggagaatctaggtttttttttttaatcagaaagttgtaaatgaatttttgttgtactttgtaccactatgccctggctgccgtccatatatattagatctccttaagttaaacttaggatagagggataaaatggatattgtggtacttatttcctttttatcttgatttttaattagatttcattataactcccttatgtcctatatgtcagtctttcttcaattaatctattacatgttttttgttctttcagcatattgagtaccggttgaaagtgtctctaccttgtgatctcggagcagctctaactgacggtgttgttctttgccatttggccaatcatgtgcgacctcgatctgtcccaagcattcatgttccctcaccagctgtagtaagttgataatcctaaaaagccttggctattcatcagacatttgttaagcacagtggacagacatttcttaagcattgtgctagatattaaggatacagatataaagagtccagtctctaccttcctggtctcacttctactcgagaagaaatagacatgtatacagctacttacagcagtgcgataaatgtaagaaaggcatgtacagtgtgtgttatagggatataaaaaggggcca

SEQ ID NO: 110290 - DNA, 1004 bp, Homo sapiens
gctgggcatttagctgatgcctctgatcccagcactttgggaggctgaggcaggcagattgcttgaactcaggaattcaagaccagcctgggcaacgtggcgaaccctgtctctacaaaaattgcccaggtgtgatggcatgcaactatagtcccagctacttgggaggctgaggtgggaggatcacctgagcctgggaggtcaatgatacagcgagccaggcttgcgccactgcactccagcctgggtggcagtgagaccctgtcccagaaacaaaacttctctagtaacacattttcttttcctcatttcagcctaaattaacaatggcgaaatgcaggcgaaatgtggaaaatttcctagaagcttgcagaaaaattggtgtacctcaggtaataaatttatcattttttatgttgcctaaatagacttggttgtcctaaaattttagaaatgtaaatctctaaaatcttacaggactagctctgagctaagtcgatcataattaacatgactttgtgttacaagagtcagtgtacttttgaacagttttccttgattatttccaaggaccacacaaagaaattataaatatatagattgaaataagtataagtaatttgaaataattattctattttcctaaactttcccacttgctatttgacaactaaatatatccttcaaaaactaagtatatctcagattgagaatgctgcagttggcttcagtgttctaacacttgctttgatactttttaaaatgttttagacttccagaaatgttgaaaaaatagcctagagttccttttgtatacttcagtcaatttcttctaatgttaactaacgtctaatacaaacataggacagtaattcaaactaagtaacatgagaacaatacgattaactgaattacaggctttatttggatttcatcagtttttccatgaagctctggttctttggagtctggcatgcaacaggccatttctaagctgttgtcct

SEQ ID NO: 110291 - DNA, 1656 bp, Homo sapiens
tctttacccagttcaccgcacctctttctaactagccaggagttgactaggccacagcatcacatgttacaaagtgaaagagagagcgcccagctccacagatcatctgtgtcagccagcaggattcccaggattgtttttctcttatgaaagtagatcatcattctattatttattttttacttttttcttttgctgttttttttttaactgaattatacaagaatggaaatttacataaagtggtagttagcaaacacctttttgattcctatggacaaattgaaagcaaaattttcgtttttatattatgttgttttataaagggtcatcttttagaacagacctttttaaatattttgagagcactgaatatggtttctgaagaaataacatacattcttttaaacaagtttattctaatagtgcacattagcctccagttcttcccttctgcttcctaaagaggttcttgctacacaaacatccagtgtctgctctagttccctgccacagtgtctttaaacaaagagagtatggcatgggttggtgcagagaatgggaaatgcaaaatagacaggagagtgctgaaaatggccccactcaagcaagtcatgttgacttaccagatgtcaaaacctgttgaaaggtctaagcctgtccgcggggctttcggaagcatcctctgagggtctctgagatttaaagtccgtaccttggaattatttcaggatgttcccaccatcagccaacaaagtacaaaacagtgtgccttaaaatacacatttaagttggtatttgcatgcagtggttgaccatgtttgttatgggccagcctgcccctgttcctaccagagctgtgctgttggaaggcaagtacgaagaaaaaaaaaatacagttttaaaagactgggtctttttccagagtggttaggctgaggttttgatgcatcctccctccttctccgtcaccagaaagaggaaatggacgttcccataggctgccccttccttctccccttccacctcccacccacgtccccaccacaaccactgccagttttacacggcttcctagcaagctgctacttctgctgaaaaattagtcatctgtctagaacaaagtgaaagaaaatgaataaacgcacaaactcgtaggttcaaactagccttctgaggtccctctgccagaggaagagaagaaacttctacctcctcgtcttcctttttctcctggtctccaggtcattctggcctttacttaaacatccccactttgctctgtgtgacttgaacattgggaatgtaataatgaccacttttgaaaatgtaaaacagaaaacaatattacaaatatttttgtcagattctatacccaggtaagatagataaagacaaataatttcccttctctgtgtaacttttaaagtgttgtacaagttaaagtatgagtgaaatactgaagaacaaggcagttattaaaaacctctgatgacattgggcatgtgggtatttgctttatttttatgcttctattcaatatgctacattcaaaaaaactgtaatgggtgattaaaaacttgtatctgagtccagtatcttttgtcccagagtcgttatgttatgtgttaaaggatgtctgtctccctgttgtca

SEQ ID NO: 110292 - DNA, 1482 bp, Homo sapiens
tgctttctgacctactttttttttttttttaaatagaggagaatgagtcaggaaagaggttgcttcacacacacctcactacattcaggcctcacacgaccctaaaccaacatccacttctgtgtattgtattttttttttttttttgagacggagtctcgctctgtcacccaggctggagtgcggtggcgcgatctcggctcactgcaagctccgcctcccgggttcccgccattctcctgcctcagcctcccgagtagctgggactacaggcgcccgccaccacgcccggctaattttttgtatttttagtaaagacggggtttcaccgtgttagccgggatggtctcgatctcctgacctcgtgatccacccgcctcggcctcccaaagtgctgggattacaggtgtgagccaccgcgcccggcctgtgtattgtattcttaatgttcagaccagtcaccaacaaacgaattttattctgctatttagtagtaagatcaggctcagcatggagaagattctttgtagtttgggttttcagcgttttatttttgttcctcaatgtaaaaatgttacaggatgtgtatatgtgaatatgactgagatgatcatatgaattctatactcaaatctgcatttctgatccactgactttgtttttctgttttcctttcctgcttacactttggacaggacaatctttgttccccttccgacatccttcagctaaacctcagcgttaaaagaactgttgaaacgctcctttctcttggggcacactcagaagaatccagttttgtctgtctctctctgcagcttctgggttttgtggcattttactgtactgtgatgttaactctctgtgtgctttattactggctcttccccgctcgctgaaagattgcactccggtgactttctgcctcattcctgtgcttggtaaaggaggtttgtttctcatccagaattatttacataagtgctttttctccctgctggccctcaaagagctaacccataaaggaggtaaatcctttctttatatttgcagatgagcaccccctcacattagtaaacatttacgattgctaacaaagagtaaaagaccagcattttttctcctggtcatccgtccattctcctggcctgtggccttgtttctcttaccataaatgctgaagcatttttactaatacaattctgaacttgtacttcgaatatgacatgtagagctttatttccaagtcacacaatacaactcccatctggccatttttccgtgcctcagcacaagtgttgaattgtggagtgactgaacctttgcagcagctgctcacgaggagaaccgtcgtgccttttctggttttggccgcacccggttacttagatttctgctttgaactgtgtcctgagatcctgaatccccgctttgtcggtaggcacaggtccatataagcatttgcggtctggacgtttcaaa

SEQ ID NO: 110293 - DNA, 1367 bp, Homo sapiens
aaagtaagcacaagtaccaataactgcctcaaaaatacttgttatatattttattgtaactggttttataaaatttcctagtaatatcgtctcaatgaaaagcaaaacaaaaaacaaaaaacaaaaaaacccaactagttgttttaacaaacatatataatctttttttagtggcaccagaattctatattctgttctttgtaagagcaatctcttttctttttggaatatttaatcttaacagaaagctagtgataaatgctgttcttaagatttgcctttttctctcacaagaaagggttaacctaacaaattaacgatgcacacattaaggaagcgtttaacttcctcaagcaaacagtgtcaacacttctcacatgttggtaatcaacatgttcctgcctaagcttacatagtagttccctggaataattcaggctgttaaataccaggatattaaatcctttacattttcaaatactgcttttaattctgtaattcagatttttaattcagacaggcccttccatgaattattcaaattagggggaagtttctcaagagctcaggatacactgagtttcttgccctatctggtctggaaaccctggttttcacagtcaggattataatgcagatagcgtagaactcatgcaggctgagttatgttttcaaactatctttcattcttgtggtagggaacttaccctcaagtgtagtatcttttactcttgagccatctggtagcgtggaattgtttttctatttttcacctgcctattttatagacctgtattgaccttttattcatcagggataaaggatgttgctttcaccctgcggtattgttttccctctgttgtatgtatagatatatgctacttgtcaattttccaattttgaaaatgatctgtatgtacttttagttgtattaataaagtgacagtgagtgtcagacaccatctctctaactcatatttacactgaggtcagtttcccaggtactaattttcatatctaagttgatgattgtgaaggggagaagtgcttattttttcctttcagttctatgatattcatccgattttcttttttgtttgttttcatgttacgttgtccctttcaggagcaattatgtttgcctctccacattttagaagagaaaggtttgagccaggttgcagtgacggtccaggctctcctggaacttgccccacccaagcaacagcagcaccagttatctgctgtttgaggatccccaggacggtgggcactggcctggccaaaacaaggaacaggacaccgtgattgctgctgccagctgtctgcttaaacaaagctcttgtgtgttctcagaagggaccgtt

SEQ ID NO: 110294 - DNA, 1230 bp, Homo sapiens
ctagcagagcccttcccatcactgacagtgtctggggctgagagccccccctagcagagcccttcccatcactgacagtgttgggggctgagagccccccagcagagcccttcccatcactgacagtgtctggggctgagagccccccagcagagcccttcccatcactgacagtgtctggggctgagagccccccctagcagagcccttcccatcactgacagtgtcgggttgagagccacccccagcagagcccttgccacgtacagagattttctgtcagcagtttcccagtatttcagactcataatctgtgtttagcactccagtgttctcttgtaatagccaggtctggaaacgacccatggaaagaggggcctttgtattctgctagaacacagagcatagtagtagatcacttttctgaagagctttttaaaatacagctaatcaaggagtttgcgatttctcttactttctacagctcagcagtgactaatgatgtgtgactatgcgaatgagtttgatgaattcgtaaaaactaagcgcttaaatggttatagaaatgaaaacatggatatttagaagcctttctatatacacagtgcagttgagatggtttacagcaaatttcgttttatttctgaaaatgttgtaaacatgtaattagtgaaagattttgtaaaacattgtcctgtatttttgtctgtaaatatattgcataagttctaagtataaatatgtcagtatcatgtatgttattttaaattgcctgtacgccactttacacattgacattcaaataaaagccaacacttcagtggcgtgtaataaaagctgattggagcgtgttcatacctgaggtgtggttcccttggcaaaggtgaatcaaggaaagagcatctcatttccagagggaatgtcagtggaaatgggggcttcgggacaaacttttgagatcaaattcattttttaaggaagtacagatatcaagactgagctttatttggagttagatagaaggcttaattcatgaaatgtatgtgacacattaggacaactttgctcttggaaacctttagcatcccaaggcattgttttgactcatcaaggcaagcatgatctggtgggtgcattttttttctaggagaagagggagagtgacagctttcctatttgccaggcacaagttagatattttcacacacctgatttcttttcatcttaaca

SEQ ID NO: 110295 - DNA, 1053 bp, Homo sapiens
ataagaggagaggcaagaagaagtgaccaagttctcttttgtgttttctgctggtattctggaggtgggaaggacttggagagagttaagaaacacctggtacctcaaagatgactcatctacaggttgtttcctattgagactttcccagggaagcctgatttcactttgcctgttaatttcactctgcctgttaggtgggttttcaaaccctgatttaggattacaccattgacttagggcttcctcataccttgctgggaagaagtttctagtagtcctgtgaagattcattcttcttgctctttctcagcagaacaaaggagttcactggcttagctacagtgacgcattgaaacttgagtaattcctgtaatgtcagattttgattttacccaatttgtctgtagtgaaaaaactcttatgagcaaaagtattcagtaggaattacaatatgatgttattagctgtccagcataatatatacacagcaaagttttaataaatgttggttcctgcctgccttttagatttatcgtcactttggtgtttttattcaggtgaaaatggcatggaatacatatccagttgtaagctgcttcagcaacttttctaggaaacagggatacaaattataaatacaagctagaaataggatgttaggatatacaactttacaaactataaagatggggacacaggttctctggaaggctagtttggagatatttttgacaagtgaaacactagagccaccaatccccactttatggagtgttaagatgaaaagaaatcaggtgtgtgaaaatatctaacttgtgcctggcaaataggaaagctgtcactctccctcttctcctagaaaaaaaatgcacccaccagatcatgcttgccttgatgagtcaaaacaatgccttgggatgctaaaggtttccaagagcaaagttgtcctaatgtgtcacatacatttcatgaattaagccttctatctaactccaaataaagctcagtcttgatatctgtacttccttaaaaaatgaatttgatctcaaa

SEQ ID NO: 110296 - DNA, 1052 bp, Homo sapiens
ttcattatggaataaatgcagaacttcctaaatttctttcaaaagtcagctactgctgggcatggtggctaacgcctataatcccagcactttgggaggccgaggcgagcagatcagtagagatcaggagtttgagaccagcctgggtaacatggcaaaaccctatctctactaaaaatacaaaaattagccatgcatggtggcacgtggctgtaattccagctattcaggaggctgaggcacaagaatcacttgaacccagaaggcggaggttgcagtgagccaacactgcgccactgcactccagcctgggtgacagacagagtgagactctgtctcaaaacaaacaaacaaacaaaaaagacagctgactacttgtgtatgtacattctcccaaagtttaaaaaacaatccatattattttgagatcattgatcacacattaattcatatttcattttttataaaagatagaatttaaatttgaattattaaaactgaaaaagttttgggaacaattataaagttaatatgtgaatatttaccatctaggaatctattacatttttttctttggtttatctttagattgagcatgttttattttgaaattttatattaaaagtgcagggctggctgggctacagcttagccaagagagtactataataaatgatgaatgtctatctttgcagataagagagtatgaacaggtcatcattgaagatcgtatagaaaaggagaggagcaagaagaaggtaaaacaggatctcttggaattaaagagcgttataaaggtaaagaaccataatcagtatctcgccacagctggcttaacactgaggaacacaaaagcatttccaattcattatcaaacacatctcagtatatcaaggaactgcagatctgagaagaagcatggacttttgttattattagaatttgccaacagtccatggtgcagggagacagttaacatagaaaaggacgtgcccccagctcttcatctggggaaaaagaggtggttagcagcggaagcaaaacctaggcca

SEQ ID NO: 110297 - DNA, 1051 bp, Homo sapiens
cccacagtttctgtgggtcccaaggttaggagcaggttagctggatggtgctggcttgaggtctctcctgaacttgaagttggccaggggtggcaatgatctgaacacttgatgggggctgcagtatccacttccaaggtggttcattgacagagctggcaagttggtgcaggctgccggcaagaggccttagttccttaccttcatggatgtgtccacagtgctgctgaagtgtcctcataccaaggcagctgtcttccctcacagtgagagatttgagagagtgaggcagaagctgcaatgtcttttatcacctagccttgcaagtcacactccgtcatccccaccgtaaccttctggttacataggctagtcctgctcggtgtggtgtagactacacagaggcgttaacactagaaagtgagaatcatttgggccaccttggaggctggataccacattctgtttttcactcatcatgagacacttttggttagcatccaaagatactcctagggaaaaaaaagttaattttggctcaaattcaaattgatcagaatagccaaattgcatgaactacatacctttattaaacagtaggccaggcgcggtggctcacgcctgtaatcccagcactttgggaggctgagttgggcagatcacctgaggtcaggagttcaaggccagtctgaccaacatggagaaacccaatctctactaaaaacacaaactggccgggcgcggtggctcacacctgtaatcccagcactttgggaggccgaggtgggcggatcacgaggtcaggagatcgagaccatcctggctaacacggtgaaaccacgtctctactaaaaatacaaaaaattagccaggtgtgttggtggacgcctgtagtcccagctacttgggaggctgaggcaggagaatggtgtgaacccaggaggcagagcttgcagtgagccaagatcgcgctactgcactccagcctgggcaacatagtgagactctgtctcaaaaaaaataaaataaaataaaataaaataaaaacaca

SEQ ID NO: 110298 - DNA, 1083 bp, Homo sapiens
gcctttccacctacggcgtccggggacgcaggaagtaaactaagttgtttctatggcaacgcacagctttggcggatttagctggctaccattttgccttcccttgttcccaagtagtacattttgcagcctaccaagatgaaaggacttaggaaaataattgtaagagtgctattgaatgtggcttatttcagtgcgaagccgatttccgaggattgtttttctggcgtttggagaagatgcctaaattgagggcggagtcgaaagatgtttaatcccacaaggccacgcggcggggcctcgtccttctcttaccgccatcttggctcctgtggaggtgagtgaagggtctgctgctgaaatttgggggcaaataaccggagtaggtttgttcctgtgccttggcgagtcgccggtgcgtatcggagtctctgccagccattgatttctacgggtttcaagaagagggagaacaggatggaggagatgttgggctgatggtgtttggtcccctgacacccggagaacggctgcccgggttatcccagttaaattcctgggcctgaacggagtgaaacgatgtttttgttcgtgtgcagttgtccatgaggcagtgcttccttcatccgtttcctcccagtccataccttccttggcttgtctgaccagtctctttcctcagcttttctcccccagccattgcataaaagtcttacgtgtgtgtttctctttaaggcttcatttcttttcctgagtgttgcctactgataacggcatgcattttctcaggcttttctgagagtcatttttgtgactcctgtcccttagttttgtcttcattctgaagtttgcttagataccagctgttctctgaggtttgaatgtcttgccggaccctgcgtttcatatggatgttctggcattgttgtccccgaactcctacatgaaactcccatccaaaaggaatttgctttaggggcttaaacgagaggggacgaggtgggaaacttgtgtggcttggttttaaactaatctttttgtttgttttaaggcctgctgggaacgggacttctaaaaggaact

SEQ ID NO: 110299 - DNA, 1026 bp, Homo sapiens
attagtagagacagggtattgccatgttggccaggctggtcccaaactcctgaccttaggtgatccgcccacctcggcctcccaaagtgctgagattacaggcttgagccaccgcgcctggcctcattatcctattgaaataataaacaaaagatttagctgaagtacttggtattgtttttttgtttttgtgacaagagtctctgttgcccaggttggagggcagtagcgcgatcttggctcgctgcagcctctgcctcctggctcaagcgattctcctgcctcagcctcctgagtagctgggcttacaggggtgtgccaccacgcccggctaatttttgtatttttactagagaatgggtttccccatgttggccaggctggattggtattgctgtggcttctattttgcgtcattaaggaacttaatggggagttttagaaggacgttacttctgagggtggtgttggatttaggtaccttttgcacttgtaagcaataaaggaggtaattccttatattgtgatccttttaaggtttctaattttttttctcggctccttttgccagaatttaaggatttttagaacacttgtgcttaatgcattttgttaatgccttaaaattatgggttttttttttttttttttttttttttggagacggagtctcactgtcacctaggctggagtgcagtagcacaatatcggctcaccgcaacctccgcctcccgggttcaagggattctcctgccttagcctcctgagtagctgggattacaggcggccgccaccatgcctgtctaatttttgtatatttagtagagatggggtttcaccattttggccaggctggtcttaaactcctgaacttgtgatccacccacctcagcctcccaaagtgctgggattacaggcaggagccacggtgccccgccccttgttttttcttttctttcttttctttttttctttcttttttgagacagagttttgctcttgttatccaggctaaagtgcaatggc

SEQ ID NO: 110300 - DNA, 1085 bp, Homo sapiens
gaggctgcagtgagctatgattgggccactgtactgcagcctgggtgacaagacaaccccgtggtctttaaaggaaatatatataaagtcatatcctttgtacattgctcgaaccacagtagtttctctcattcagtaaaagcccgtcattaagagctccataattctctttatctcagctgggattaaccccttggtgtcttcagtctttcttccggccaggacacacactccttggccccagtgcctgcgctagtcatcccgtgatcacttcatggcatttcccctccctttccagtctttgttccatggtcacctcagtgagaccttccttggctatttaaaatggcaggtaattcctcctttctgtacacacaaatatcctcacacttgtccttttttgctattttttcaatattgcctctgttatcatctgacctatgtattttccttaaacttacttggttatcatgtgaaagatttttgttttatagctgctgtattttacagaagggcctggcatacaatagttactcgataagtatctgttgaatgaatggtgttctaggcatttaaagtttctcaggtgatgaagtgggtaaccagggttgagagccactcgtgtagaggtcaccttgaatttgtatccaactatatcagcttgtattcctcttctttccctttttaaaatcagcaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtggtgagtatggtttttagcaaaatggacgtctgatgaatcagactaggttcaaggtgttgtgctttgacttctgaggacttctgtggttgtgaaattgacaccagtaaattatgctgcaaaatttgtgtattgcagaacactggagagatagtaattgaaagaattaggtgtttggttgtttgttttttgttttttttttggggggagacagggtctcactttgtcacccaggctggggtgcagtgg

SEQ ID NO: 110301 - DNA, 1046 bp, Homo sapiens
caggcgtaggagatagtgactgggagaaggtgtcctggatgagaaagcgaaattggggcagagcctgactcttacaggcctgggacccgctctcagctccctacaccctgcaagttggctgttaggcgctcagaacagtatcacttctgtgcggagggttgtgcttagcagtagccctcgaggagtggttttcaaacttgagcgtgcatcacagtcacccgacgcacatggtacaacacggattgccgccctcagtcccccacttagtgactcagtaggtctgggatgagtccccagagttgacagtttacgttcccagctggttggtgagatatgcttgtccggggaccactttaggaaccgctgacctgaagtttcgggaagacattgaacggagagccagatagaggcgttggtgggacgttgggggctcactggagacaaaattcaggtttcttttcacgttatgtcgtcactttgtttgctttacccggttcctctgctctggaagtgcctgcccgcctcccatcccatttttctctctgcttaaattctttgtctcatttcaaattccctaacctcaaggcagcctgctgaaaccaccacagcgcaatattcttttcattaaaaagtacatcgtgtctgtactccctcctggcatttaaccaagtactgctatgggataatggcttattttttaggcgtatcttgcctttgcagttagattataaggttccgtgggataaggtttgtgtttcatactttgattccttcacagtatttaggtcagaggtgggtccacgataatccatattctttgagaaagggagagtacctggggcagggctgcatgctgatacacctacacatgttcaattcagcccagaaatctaaagacactcatttttatggtaatttcccaaaatgttacatgcatactcttcataaccaagtgagccaaaatattaacttcggagtttatagcttttttgcagcttttatcatgctgcattttcgctgaattctttaaaaaaaatttcccacaa

SEQ ID NO: 110302 - DNA, 1040 bp, Homo sapiens
catttacattctaaatttttgtattcttaccttttactcttaaacttggcagatgtaactggattcctgcagtcatttttccccatcattcatctattcaataaatgtcctggccaggcgcagtggctcacgcctgtaatcgcagcactttgggaggccaaggcaggtgaattgcttgagctcagaagtttgaggccagctgagcaacatggtgaaaccctgtctgtatcaaaaatccaaaaaattagccaggtgtgatggtgcacacctgtggtcccagctatggaggaggacgaagccagaggattgcttgagcagcccaggaggcggagtttgcagtgagtcgagatcatgcccctgcactccagcctgggcaacacagtgagaccccatgtcacataaaaataataaataaataaatatcctaacaacttataaccactcagcagttccatattaaagcaaaagaaatgcacagatctgtcagttatggatttgccagagatgtactatcacatgttattgttttagagctggagctggcaaacgttttttgttaacggggaaaattataaatatctggggctttgtgggtcataaggtctctagctttctgattcagctcagccgttaccgtctgaaagcagttacagacagtatgtacgtgaatgaatgtgccaggatttggcctgagggttgcagtttgctgaattctgttttattattattattattattatttttagagacaaggtctcactctgtcacccaagttggagtgcagtggcaccatcatagctcactgtaacctgtaactcctgggctcaagtgattctcctgcctcagactccccagagccaggactacaggcatgcacctccacacctgactaatttttaaaaatttttgtagagatgaggcttgctatgttacccagactggcctcaaactcctggcctcaagcggtccttcctccttggcctcccaaagtgttgaaattataggcttgagccaccacatccagccctgaaccccatttt

SEQ ID NO: 110303 - DNA, 1052 bp, Homo sapiens
tacttcctcagagtttcattttctttctttgcagaatgtctcttgggtgcttctgctttgcattaattaatttcagtgcctttctacaagaaaaaaattgggatttgctggtgtaaaaagaaaatctttaggatgtttcatcattgcataaaccatctcttttcttgagctaatttgtgtccttcactctaggatagtagtaattctagaaattcagtgatgtaaaatattgttttccacatctaaaatctaatttgcaccacttatttttgattcagtagtactgggtagtggaacttagaacccacagatttaaaatatttcagtattctaaagattctgtcaggaaacaatttttggattaattttctggagtcttccataatttctttattctacttagcatagtaatagattggtcattggagtatccccagcaatagtcatgttaatttttttttaataaaacaggttttgtgatctctaacccagacctggtcacctgtctggagcaaataaaagagccctgcaatttgaagatacatgagacagcagccaaacccccaggtaggtgagactgaatgaaggagaggacacaggctaggaggccagaggtcaggaaggaagccaggccttcaaatgtagtctgggaaactgcgccaataaaaataatttccgaaaaggctgcattttttctcttattcacaaatagggtcatcttctgtcccatgctcttaaatcttctaagaatttcctttttttcttcagtgatctccaagtttacaaggagagccaatgtccactttatcgcttataatgggctgcataatctgactgctgttccattgcttttagagacataggagtatttgtattattgaggacctctatgttaaagtattttttcaaatattattttcgcatcatgcctaaaatacgtaaggtgagtagtggacataatgggatttggtttagaaatcttaggaacaccgaggacagatgttgcatcttttctgcttagtgatttttttttttaattatactttaagttt

SEQ ID NO: 110304 - DNA, 1031 bp, Homo sapiens
tcacagttttgtggctgaagcaaagccacctacagttactatgcctcgaatcaaggtaagtttgccttaatgttttatgaatcatggtttggctgttttgaagatttagagggggtctctgtagtctttcgcttggagttgcaattttaagaaagtggaaattttgtgctgtcagttggctggggcaatagaatgttgaaggagcctcacacgggatggaactgagacccatcatttgtgccccatgtcaagtagccaaagctcatgcttcatggcaaatataaaagatttagagcaagatcatccaggctaacctaccccaagatatgccattcttggtgacctgctttcttctttaatcgtcactgggtcatttacaatcttagaaggagcctttagagttaatctagttcagtctctagactttatagataggaaagcaaactcagataagttaaatgtgacttctccaaaattatccaccagtatacataatgatcaaatcagtatgttccggcctcaacaattaccactgtttccaccatatccttcaggtgtccagcctactgacagcagctttgaagtacatagtgcatttcccaagaaccgtgggtaaagaaaaaagtaagcctttattgattggctcaaaacttttgagcaacgactatgtggtgatacttcaatgggtatgcaattggggaaaaaatagtatctctgccttcatgtagcttttagtctttagatatacagccactcaacaaaggagcatatgaaaacatgcagttgtaaagtgtggttaatgcatgatgagaaagaacaggatgtgatgattagtgggtgagaaagcctggctgaggaaattgcatttaaactgagactggaaggatgaataaaggtggggacagaaaggagcagaggggttgaagtgtgtgagtgtatcgcatgtgagcgtggcataaagtctctgacggagccttagctgtgttgttgatcatgtgaaacattatttggtgagaaggagctacttattg

SEQ ID NO: 110305 - DNA, 1029 bp, Homo sapiens
agtgcccttttcatgctccggttttggattcagtggcctaattcttgcattttctgactgcaggcattgatgacggggagccttcctggctttgtcgacgtcatcaggaacctcaattctcctgcactgctggaagacagtgtgataagacaagcaaaagcagctggaaaaagaatagtcttttatggagatgaaacctgggttaaattattcccaaagcattttgtggaatatgatggaacaacctcatttttcgtgtcagattacacagaggtcagtttttaaaataagaaaatatatcatactagaatatcatactagatagagcctggcatcccattacttagtgagagatgataccattttatatttggttttattaatttatagggagtactatggacaggtgtaaaaattattcactcacataatcagttaacaacccagaaatacaaacctgaagcaggtgtgagcagagttttatggaacccaaagcttagaacagctgagtgccattgaggggcagagaggatcaggaagggtgacacagccaagggactgtctgagccgagatatgatgggtgagtggggactccccaggtgggcagaacaggctggtagcttctgcacatggcagagctgtaggactccacagcctgttggttctgctgcaagcggagcctcatcgtgccctgagggcaggtggccgactgggtggggcctggtcctgagggggttttcctggagcttttccaacaaaaattagacctgcatgttagaaagcagacctggggctgaggtaggagcacaccagcacacctgcctggcctggggtttagccagcttcacctcctagatggctgggccttatggagcatctgtagtcctatcctgttccaaagtggggcgcttttcaacagttacttttcagtaatgactgagttttcctgactatatatggcatcactgagaaacacttctcttcataggagatttttttagtgggagggagatgagctagctgagggg

SEQ ID NO: 110306 - DNA, 1093 bp, Homo sapiens
ttacctcatgacaacttgggatctatttaacttgcccatttgctcaccttcagttatgcccattaagcccagcagtgatcccacagaaaaatatttttgtcagaagaacccttgctcatttaaattatctgtagaatatattcgatccatagcccagaaacataaaaacaatattagcaaaagtttaatccaatgctaatgttcatttatttattatagacgtggggtcttgctatgttgcccaggtgggtcctgaactcttggcctcaagcagtcttcccgcttcagcctcctcaagtgttgagatgaaaggcatgagctgctgtgtccagcctatttatttatttttaatgacatagattttgttgtgtttcaactcccccaaatcctgtaacctgaataaacccctagattttaagatgactgttgcgttttccccggggagtgaagatccagggaaattaggtgagttgtttatacgtgtgtttccccttcaaaggtggataataatgtcacgaggcatttggataaagtattaaaaagaggagattgggacatattaatcctccactacctggggctggaccacattggccacatttcagggcccaacagccccctgattgggcagaagctgagcgagatggacagcgtgctgatgaagatccacacctcactgcagtcgaaggtgaggctcgccgtcgctcactgtctgctgatgtggtttcacgtggatgttccctagaataaatgcaaccgcctgagttattcagggtgcctgtgtgaatgtccaccatcagtctgctagccaggggccgcatgccacacgggcagcactgtctcagtgtccactgcactgactccgtcttccagcagccctgcagaacagcagctctcactcctacccgtgtatgcattcattcaactaatacctcctgaagaccttttgtgccactctctctgttctgtatcactctctctgttctgtgccactctgttctgtgtcactttctgttctgtgtcactctctgttctgtgtcactctctcttctgtgtcactctctgttctgtgtcactctctctgctctgtgcc

SEQ ID NO: 110307 - DNA, 1340 bp, Homo sapiens
agcttgctggaaaatcagaccgtccttgtaatttataacgagcccccgtaaggggccaggagctcctgttgattggcgggagggctcagtcaggaggaccattttattttctttgtgtcaaagcaactgtgtttctgattttaattgtgttgtggtggtgaacacaggagtgggatgagcagaggccgttctggagggcagcttgtaacatgtgggtgaccctctatttaaatttaaatagctgtttccatttatctcaagaatataagcagaggcaggagcctgggatgggacagaggcatgtccactgaagtgtccttcacaaagtgtccttgcaaaaaggaacaaccagggtaattatccagcagcaatacagtgatcctcccagtgaggtcggtgctctgacagtgaccgtcccagtgaggtcggtgctctgatagtgaccctctcagtgaggtcggtgctctgcagaggggtcttctggctgttaggcagcctattttcacagaacagagaagcatgttgtggaacaggtatgaccccagcttactaattgtgtacctgttttttttttcatacttatatgaaagactacatacttaaaatactggtgattatatttaggacctgaaatcataagattgtggtcttgctttttacttatttttgtatcttagcgatgtctagagttaataagtgttgcttttctaatcacagcaagtcaaggtgactgctgagggctgtggccagcctgaggggtggccgtggggctccgggggcacccctggaagtacttcctggctgagtggggagtaaggggtgggagttagggtgacctgaggcctggctgaggcagtgagagtgtagcaggccgtcatacggggccggggcctggggcagagaggatgctgacgtgcaggtaccagcggtgttctgtggagatgtctcaaaggctgttgactttggaatctgagacttagggctcatccaaatggatgttacatttgcgggtgtgtgtttaaggtgcagcgtatgaataaattcatttcctcacagatctatacactgaatttcagcatcactcatctcaagaccttggccctcttccctttcctggcctgcttcctgcagcatgtaatttgctagtgtccagaactagccagtgtgccttttctttccacacgcactgcctggttcaccttcttcctgtaaagtgcctccgtcctttgtccccatctgtcccgatcgtaaataggtcctggctacagaggcatcctggctctagatcattgtaacagctgccgctctcctgtcagtcccccgggccctgccatccactg

SEQ ID NO: 110308 - DNA, 1044 bp, Homo sapiens
agttagctttagaaagaggctggattcagtcaactagctagcagaatacaactgttcaaactcaacatttgtccgaccaaatgaaaccatttccccccacactgacttgtgcgtagacatcctctaattccaatttgatgaatattctccaataacatagcaattaatttaataaaggaactcaccaattttaaattgcaataaatttaccaaacattttcactatttatggagagctttacagtaagaaagtatcaacaaaagcaggcacatccgtgtacaaagtgttgctgttgggtgttctcacttcttctttctgaattaccagctgctctgcgtctctgtctgctcttcctccgtgggaagtcgccgtcctggggcgctcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaacgcaagcgcggtccgcgggatgggggtccggcccgcgggatcagcaggcccgatgggtctcccagggccgcggcgtctcgcagggcggccggcagcagtaggggtaggaggcgttgaggtcggggtccgagggcgcgtaccccggcagctccaccgacgggtgccccccgcagcgcacctccgcgcccgcctcgtccagcgcgtggaggacgcctacgttgatgtaggagaccgcgtggtgcgccgcgaagcccgcgcagtccccgggggcggccaggtccgactcctccggggacaggatggaggcctcgctcggccgct

SEQ ID NO: 110309 - DNA, 1078 bp, Homo sapiens
gcctcaagtgcttctcgttgggctcggagctgcgcggggagccgttccgcctgggggccgccgccggcgccttctactccgggctgctgctggccgccggcctctcactgctcggcgccgccctgctctgctgcggaccccgggacgcgcccctcgcggggtcggaaccgggcccgggtttgggggtccccgcggcgccggcaggcgctcccgaggccacgccgggcgagtcgggggccgcggccggggccccggggccggtgagcagccagaacctgcttctgctcggcgtcctggtcttcatgctcggggtcctcagcgcattcgcgggcgccgtgatcgacggcgacaccgtgtccctggtggagcgcaagtactcgcactactgcctgcccccgcgggcgccaggttcgagccccggctcggccccgggctcaacccccggctcggccccgggctcggcccccggctcggcgccgggctcggcccccggcgccccgcgcgctcgcagcaccctggacagcgccacgtccgccaagtgccgccagctgaaggactaccagcgcggcctggtgctctccaccgtcttcaactcgcttgagtgcctgctgggcctgctcagcctcctgctcgtcaagaactacaagtcgtcgcaggcccggcgcggtcggcgcggcaggcggaggggaggccgggccctggcgcggccccgcggcggctccgggctccgcgcgcagccgcccgcctctcgggcgcgccggggccggcggggccggcgggggcggcggctgcagcagcggccgagcgaggcctccatcctgtccccggaggagtcggacctggccgcccccggggactgcgcgggcttcgcggcgcaccacgcggtctcctacatcaacgtaggcgtcctccacgcgctggacgaggcgggcgcggaggtgcgctgcggggggcacccgtcggtggagctgccggggtacgcgccctcggaccccgacctcaacgcctcctacccctactgctgccggccgccctgcgagacgccgcggccctgggagacccatcgggcctgctgatc

SEQ ID NO: 110310 - DNA, 1912 bp, Homo sapiens
ggtgggcgcggtccgcggggctggacccgcccgagccgccctgacctcaggcctccgacgctccgcgcaagaagacagagtgcgccccggcccgcagtctggggtgtggacacacggccaggacgcggacggcggggcctcggcagcagcgcggggaaacagcggacccccagccctgcggggaaaggaaaccccccgcccactcggcgcagatcccgcctcacgcagcaactgcgcaggcgcagccgatgatcctccgcgcactccccagcctttgtgcgcgtgcgcctcacgtgacgtcaccgccgcgcgggggcgcgcagtcacccttcggtcgccagggggcgcggccccccgctctctcgccgctgacggcgcatgcgtgcgcccagctccgcctttgcctccaaggctttgctggcttgtgcggcatcctgctccgtctgcaggttgtgcttccggtgcggaggtcagggacaagatggtgccaccggtgcaggtctctccgctcatcaaggtgatccaggctttgcagccgccgcccagtgctctgggcccccccgtgtcccgccccgcagctccgaccccgcgggctgcgacccccggcccccgcccccatgatcctcgccccgtgaccctcgcccggcgaccggacccccacccctcctgcgacctctgcccagcgaccccgccccccctcctcccgcgacccccgtcccgcgagccccgtttcgcgccgcctctgaccaacctctttcgcagctcggccgctactccgccctgttcctcggtgtggcctacggagccacgcgctacagtgagtgaccgcgggcggggccggggcggggtctgctcggctttcctgtggagctcctgtgctatttggagaactccagctctggaagggggcttgggacgcatgcgaggctgcaggaccgtgtcctccaccgagcgtgaccccgatagtggaatcagctcacccaaagctcaggcttctgaggcccgggcgggggactcgaaaacggctgcttcttggtgaaaacgggtgctaaatggctgttcgagtgctgaggtcttgatgggaggcagtccctgttcgcagaggacgagtgagccagtgcgtgagcgggtgggcagcaggggccctgtagcctctgggttggactcgtcagggtgaaggtcaggcgttgactcgcattaacataaagagcgggaacagcaggtgcgtctggtttacagcgtcgctgaagataccttgacctgtggactcagttccttttgtacagcatttccagtgaattttattctcctgcattccgccaaacagattacctaaaacctcgggcagaagaggagaggaggatagcagcagaagagaagaagaagcaggatgaactgaaacggattgccagagaattggcagaaggtacgagtgacactggctcttatagattgtccctcccaggtttgtgcagggataaggaaaatggaggaggacatttaagcagagctaagtagatgcggattgtttaaaaatggggaagctggccaggcgtggtggctcatgcctgtatcccagcactttgggaggccaaggcgggcagatcacctgaggttaggagttcaagaccagcctgaccaacatggtgcaaccctgtctctacaaaaattagccgggcatggcccggtgcggtggctcatgcctgtaatcctagcactttgggaggctgagacaggcagattgcctgagctctggagttcgagaccagcctgggcaagatggtgaaaccccatttctactaaaatacaaaaaatcagccgggcatggtggcaggcacctgtaatcccagctactcagaaagctgaggcatgagaattgcttgaacccgggaggcggaggttgcagtgagct

SEQ ID NO: 110311 - DNA, 1052 bp, Homo sapiens
cccggccagtgtgtgatgtttctatgcctgcctgtgtgtattgagtgtgtgtggtgtgtgcggtgcgtgtctctgttcctgtgcccatgtgtattgtgtgatgtgtgcatatgtgtctgtgtgtctgtgcacatgtgtggtgtgtacctgtgtgtgctcgtgcatgtgtatcaggtgcgggtggtgtgtttgtgcttgggggtatgtactgagcgtgagtctgtatgcacgtgtgcctctgcacccacctgtgtctgtgtgttgagccctatcatgggctgtgcagctggcagtgagatgtaagtctggagcctgggggtgctgggctaacatcagccaggagggtgtcactggtgagggatgcgttgacagccaggggtccccatgagcccctggagcaggcccctcccagcctgggcctcgcaaagggcagctgcagaccagaggttgggaggcagccggtggtggggcaggaggagctgggaggtggcgcctgggacaggcagggctgcggcgtgtgtgggtgccagtctgcgtggtctccttgtgcacacacacccctccccagctcggtgtctataccatccctgctggcgtcgtctgcctgctgtccaccatctgcctgtgggagagtgtgccccccaccccgccctctgccggggctgccagctccacctcagagaagttcctggatgggctcaagctggtcagtgccgtgggatccccggggtagggtggatttgggggtgggggcaagaggctgaggaggcgatgggtttgggaagggcccccgggctccggggctgagacgctctttcccagcagctcatgtggaacaaggcctatgtcatcctggctgtgtgcttggggggaatgatcgggatctctgccagcttctcagccctcctggagcagatcctctgtgcaagcggccactccagtgtgagcctggccccacccctggggaccctgcctctgtcatccgccccatatggccatggagtcaccgccgcctccagggtgcccagtgtccgaccctggcgggggccaca

SEQ ID NO: 110312 - DNA, 1066 bp, Homo sapiens
caagagtgaatgatgtatgaacaaatgaatgaaaggcaagagtgagtgatgcatgaacaaatgaatgaaaggcagggccgctcttcagagacatcccctcggattaggcgtgcgggcttgcctggaagttgggcagtacaatgaggtgtaaccctaaaactctgagctatctagactcccaagagagacactgaattggatggttcgggatttcatctttgccacagcttcacttcttggttacttaggagaaaaccgtgttaggttttcagcttaacatttcagggtactcagtgtcagccacgtcgtgtccctgcgtggtcagcctggacctagaagctcttactcgcccagtgtaaccgccagggacctttttactcaacacttccttctgatttgctcttttgacatatcctttactgttttttaaacttcatttgctttgtgaaattgtggaagaggcttgtgaagctgagtgttcaggtttgtttggctctgtactgtctggttcccaggcttttagaggtgtgttttagaggtgtttttaggccgtgctgagtggttgtattatttatatattgctgtgtggcagattaccccagaacccctgccttaaaccaacagtccgatgataacttactgtttctgtgggttgggagaccaggtgggctctggctcagggacctcccatctggggttgtgtctcctctgaaggctggactggggagggtccgcagccaggctgtgtcacgtgactgtgggctggagacctcagttcctttctctatagggcagctccgagggagcccatgcctagccagagagggacaggaaggacgtcccagtgtttgtggagtgacattctaccacttttgccaagagtcattcggcccctacacacttgaggggaggggactccaaaacggtgagcatacgatgggcaggtggggtcactggaacacttaaagcctgcccagcacagcggtgctgtgagcctggcacctctcagggcactggagagacatcccgtaagtaaatcagcgattgcgtgtggagtgacgtgtta

SEQ ID NO: 110313 - DNA, 1031 bp, Homo sapiens
ccctcattttcttcctgccagtgattttgctccagaaattatcaaccgacttctgttaagttttcctaaaccattttaaatatatgggggaaatgtttttaccagttacagtagaccttgcgcttgcagttatttgtgacttcataaaaatgccgtaggagacgtgagaccttgaccacactggacatttgaccggtgtgaggacttagctccagggtccaggcactactgtgagccagagcctctgctcctagcccacaccctccactgcacagggagccggaccccatgcctccttccggttctgggctggagctagggccgggaagggggcctgttctggactctggagacctcagccgcccctcccaccatgccgcactctctagactacagcggctctgtggcaaaatcgaggagctgcagggtgcggcaggggccctttgccgtgggctagaattctttacttgggtttttttatttggattataaagtgagtcttgttttggtgtatgctgttactctttattaaatggcaggatttattttgtttgcagccttatttttggttaatggttagaattgaagttgaaaatgtaatttttcttttttttttcttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcacccggccgaaaatgtaatttttctacagaattaggcaggcgtgtgtaatttttcaacaaaaattagccaggcatggtggtgggcacctgtaatcccagctacttgggaggctgaggcag

SEQ ID NO: 110314 - DNA, 1047 bp, Homo sapiens
ccgatgccttgggcctgggctcagagacgcccgacaggcaccgagaccagcccgtgtctcccgggtagagcctgttcttcacggtccctgtgaagaacttttggttattttaagcaaggaacagagcagtgtaaccgagccaggcttggcaccgcgggtggggtgggggtcgtccgcctccggcccacgggtaaccctgttgtgctttttctccgcaggcgtcacaatgtagcagggaccccaggcgtcgtgctcaggtaagtgcgcgtaggccgactgccctcttctttccgcacctgtgaactgccggactccgccgggaccacgctttgtgcatgtggtcggcgttccttgcagtgcctctgaaacgcaggctctgaggacaggctggagccatgcgtgggtccttagcttttctcccggtcagtacttctgattgaccccattccgccctttgctcggtagggcttggttgcaagttccagtaggaatggcggagttgtggcagtcacacatccatgacgcgaagtgaactaacaggtgccgtttctgtgctagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggaggtgaggcccacgccccccgaccccgggggtcctgctgactccttgccctgccctgttgctggttgtggcgagggccggcgatcattaggagccagctggtcaggacacgatgcagtgttcacggttcactgccgagttttcctggcccctcctgtgagagtccaaggtccagccagctgtgggggtcccaggcctcgatggcagtgcggggtgcagagggctggtctccttccgtcactggttcacttgggttcccggcgtgtcgctgaggagcagtgctgcttgggggccgagcctggggcctcagcccagtgagttgtgaggcggtcggctagcatcctgcaggga

SEQ ID NO: 110315 - DNA, 1124 bp, Homo sapiens
ccgcagagggtccaggtgcccagagcctgcccatcctcatcccacccggcagctctgccttcgcgggctcctcctgctccttccgctttcacagaagacagacagctcggggatcctgcctctctgcagctttatggaccctcctcagtcctcactgcaggaggagaggagggggtgttgggcacagagagaagccagtgcgggggagccgggggcttttgaaaaggtgggcttgtcccagtgcacgcagacactggattgctgaccgtgccctgcacatgggagcctgggaccccgtgagcccaagaggctcctgccacccaggcctcagggcctgcactgtcctccctgggggcggctgtcagagctcagccaaggatgaaaggcatggaagagtttcaggtgttaattaatcgcgttttctcttgtagaagccaaagatgttgaccaggaagatcaagctgtgggacatcaacgcccacatcacctgccgcctgtgcagcgggtacctcatcgacgccaccacggtgaccgagtgtctgcacacctgtacgtgccctgcccgcgccacccagggagggcgcgcccttcccagctctgtgctcttcagaaccttggcttttgtgttaccacacgcttttagctcaagcccgacaaaagcaggaaccaggaccaggggcagagacgatcttgaagataagtcagaaaagtcatttcacgctaaaggtcctgtgggtggtgtcagagcagatgaggcctcgcttaggagagcgaaacacaggagagaccccacattcctcccacggagcagcaaggccagtagccgctgtgacagtgctcactgctggcagtttccaaatctccagaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatg

SEQ ID NO: 110316 - DNA, 1605 bp, Homo sapiens
cccctctgaagcaggaaaccaatggtggaactctcccacctcagctggtgttgctgcctggggagagggggaggagccaaggctggcctggggctgggccagagggtttgagggagaagggggcaggggagtggcagccagggccacatcaggtacaggtggccaccacggtgtgcacagtggtcactgggtcacctggggccaggggagagggcacatgtcttcctagcccgtcttcccccagcaacttctgggggacccttctgttgctcagaacagaagggtctctgtgcagccctgcatgtggactgtgcctcacgggacgtgattcctcagcacccttcccgatgaagtaggtccttctcgcctccacccctgctaagcaggcactgtgcgttcttgtgtcttccagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgt

SEQ ID NO: 110317 - DNA, 1099 bp, Homo sapiens
ttttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaat

SEQ ID NO: 110318 - DNA, 1297 bp, Homo sapiens
gtggaacacacactgtctgcagagctccgggaggcacagtgcacgatgtgccagggcctgggtgcccgtcccctcgagtgcacagtgcgaggtgcgccagggcctgggtgcccgtcccctcgagtgcacagtgcgaggtgcgccagggcctgggtgcccttctccccgtgtgcacagtgcgaggtgcgccagggcctgggtgcccgtcccctcaagtgcgcttcaggacgtctttgcccaggggcaactgccatctccggtttgtctcctggttggatgatcactgtgaaggtgtctcgccagtttgatttctttcttatgaatgaggttgactcttagtttgagtggttttggttacgtgtatttcttttgagaatcatttcatgttctttgcttattttttggcctcaggaattcatctttttcctcaaatagatccacgagggctctttatacatgaagagcctggttttaatgactgcatggcactctatcaagtagctctaccacggttttttttttttttgagacagagtgtcattctgtcactggggctgagtgcagtggcatcattttggctcactgcagccgtcaacccctgggctggagcgatcctcccaccgcagcccccctgggtagctggggccgtcaacccctgggctggagcgatcctcccaccgcagcccccctgggtagctgggaccacatgcatgaaccaccgtgcctggatgatttttttattttttgtagagacagggtatttctatgttgcccagcctgtattttatgattttatacttaggatattctcaaatttatgctattataaagagtatcctgaagagcattcacattttagatagattccagaaagtggtactgcagaatcataatcataatgatatgagcatggtttggttctgggtgtgagctgtgaagctgttttccctgaggagcagcatggggcatggaggcagcgtccgccacacacacctctgtcctggctggtctcgtgcacgcaagccatgcaggtgccagctctcaggcaggagtgaggctgtcatgtcgtaaggaggcgccatcggaggtcccaggaggatgtgtttcgcttcagatggtgcttgttctaatgccctgtgccccttctccaggccccctcttctctcctggaggtcagccggccccttgtggctctcaggccagctggaccaagtctcagaacccggacccatttgctgaccttggcgacctcagctccggcctccaaggtaacgtggagggcactttgggggtgtgg

SEQ ID NO: 110319 - DNA, 1475 bp, Homo sapiens
ggagggccccctgccgctggtacgtgtttctgttctgaaggcgagtggcttcacagtagatgagtgatgaggctgagtcattctcactgcatgggcgtgtttcgaaggtgcttgcaggaagggaacgtgcccttcccccacctcccccaggagcagcctcggggtcatgtcagggttctgtgctgcccacctgagctcacgggccgggagctactggcttctccatctcagcagtgttgctgtgtccctgggaaagtcatcctgaggcgtggggcacggggagcccctgggctgactgcctcagtgcccctgcgagggcagccgtggggtctgggctgcccagctggagtggcctcttgggcaggcctgactccagagctgggctcctttgtcttcaggcagccgggctgagtcctccccatgcccgcctgtccccacagctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggtaagtgcctctcgcctggcagccagctctccatggccgcctccctcaggaccgcagcctctggtgggaaacagagctgtgggtctcaggcagtggtggggctggactgtgtggcctccgggtgcgctccttgcggcccaagcatcctgcaggacgtcccagaggtcaggacagactgctccctgctctgtctccccaaaccatccccaaacctggaacaggttgtggggccctgcagtgcctcagtcgtctgtgactggcaacaggtgtttctccaggcctcctcaggcccaggccttgcagctgttagcagagaaggccacctgcacccagagcttgtgtagggaccagaggtcagagggaggcagctgggggacccagggtccgggaagctgacctggtctgggtgtagcaggggccgtggggcaccgtatccatggggaggaggtcaggcgccggggcacagcatggcttgtttagacagacgccggtggggccaggccctgggagagggctgcgcgcccctccagtgtggtcctaggggaaggagcctgggttctctctcctgaggaggcagcagcgtggtccacggcgtactctggggtgatgatggtgaccattgcaggatggcttgtgggcgggtgtgtggagtgcagccttgcagcgttggggcgggtgccgccagaggtgtgctgcgtggccagagccagggcagacaggacctgctgggccctctgtctgccgaaggcagctcagccaggtggagccacctcgggctctggtgggttttaggagaggcgggaacgcaggctgtggggatggcggcagaaagtggggtcctgacaaacccttttggatgggaat

SEQ ID NO: 110320 - DNA, 1049 bp, Homo sapiens
acaggcatggggagcctgctgcccgctggagagcccaggcttatcagtgcagtttatgacagtgggatcagagatgatcataggaaatgtgtgaaatagcctggaattccttagagagctgtggggctgggaaatggtcagtgtcaggtcacacctgcctccccgtgcggccaacaccccaaggcgggccctgctgacccctgcccctgctccccacccacatggccgacaccccaaggtgggccctgctgacccctgccctgctccccacccgcacggccgacaccccaaggcaggccctgctgacctctgccctgctccccacagctcagcctgggctgcctccccagccccacagtgaacacagctttgtttcccccggaatcatgttcccaattccctggcagccggattctagaggtcttggttttatgggcatctgttgacagttgtggatttttgtcagggcggacgtcgtcatttttatggaaaacacatttagtatcccagagtgcgtgctctgagctgccgggtggctgcagtctgtgtgtgctgggtagtgagggccagcgcctgccttggaaccctggggtcccacctcagagctgcctgcctgggtgccggagtctccagctgtgggatgttgtcccgtctgctctgagcacgtggcctcccctggagttgcaggaaacatggcggccccgcccggtgcccctctgccttgaacacagtcgcgggcatccccactgtgacgtccgaggagcgagtgaaatgatgctcttctggggccgtgaccgggggtgctggtgccctgtgggttcctgggacagctgctgggtcagctcacagggctccagcttccgcaggcgggggtggccggctgccctggttgttctcgccccgctgcctgcagctgccacctgtttccatgcacgtttctttagtgaatgtccaaggacttacagactacttgggtggccttcctaagtggtgtctacttgtaaccgcaggtatgacctggacgcgtgtgacattcaagaaaaataccc

SEQ ID NO: 110321 - DNA, 1037 bp, Homo sapiens
gctgagggctttggccagggtggggctgtgatgggggcggccggaggtctcctgaggggctgcagagcgtgggacaggagggggcgaggtggggtctctgttgctctgaggatgccgcttgccgggaactctggaggccccagctcctcactgcttcccaccagccagagggtgctcgaggccgaggcattccttccagacacgacacttgtcagtatgcaaagggacccaaagcccaggaacagctgactgagctctgtctgcaaggccagtggcagccctggtgctcaggtctcgcgcaggtggacgcctgttcatgacaccagctggcggaggcccccgcactgcaggcaggctgtccctcctagctgaccaaggctggggcggggctcctctgccgtccgtgccaccgtgccctgtccccacaggtctccgagtgtggctgggcagcacggcgggccccacacctgcacaccctgtacaacatctgcaggaacatgcacgcctggctgcggcaggaccacaagaacgtctgcgtcgtgcactgcatggtgagctcgagggccgtgggctggcgccgtcttctgtcaaagttcattatttcatgcatagttcaacaggatctgagcgccagtcatgagctggggcctgttcttcaccctgggacacggaagaaagtccctgtgcttggtgtctttgggtctggaggggacagatgacagatggccccgcccttccctccccatgtggcccttcctggccttgacctgcatgcccgtgtggaggccactccgctgtgtggggagcccacctcccctcctgctcggtggccacctaagagtcacttccagtttcccgatctgcagctcgaggcttagtggtgcttgagcctcccagggtgtggcagctgccactgtgggtgatggagttgaggtttccatgaggggtcttttgcggggtacggggcaccagcagagcctgttggagtggccctagccctgttcttcgttagggaaccttcagtctctgttgggctc

SEQ ID NO: 110322 - DNA, 1004 bp, Homo sapiens
gattccgtggacccagtgttgggggcagttggtctgtagagagttggctgtggccacagcaggggcttctaggcactcagggcagggggccctctctgcctccagcggcgtctgctggagtcgcactgctacaaccaccaggcctgggcagcgcgtggagcctggcatgacccgtgaccatcgtccaagccacccttgctctccagccctccccttccaccggtgttgccatccctctcccagcccactcctgggccgtgcctccctggagagcgcaggggaaggggcagtcagacagcggatgtctctcctgtctcacccatgcctccaccagctgcaggctgtcatttccatccgtttctgatgtaggggtcagctccacagcacgcacacagccgggaagctgcccacacgcctgtgcacacacacgttcctcctgggatgcggcctctacagtgagagccccacggcttctccaggcctcgggctctggcttaagccctgtgacctaactgcggagtgtttcttgtcataaccaagttctcttctttttaattccagttatgcaaagggtgacctggacatatcttacatcacatccagaattgcaggtatgcgtgccacatgaggctgtgggacgcgccccggcccttccctgtgtgcccagtgagtccctgttgtgtgtcagggcacaggtgcctctgctccagccttctctgtggccacagactcacaggggtgacctggggccccttggcaggcaggcggcctgtgctcagcacctccaggcgcagcagtggacagggtcagcgccagcctggcctcccatggctccctgaggtcatgccaggaacaacacaaggccgtgtccgtggaaaaccagggcctctgtgcaccaggcatcccagtcactcatcccgacacctggagacagggcaggtgtcagaaagctgtctcaggaagtcccagccaccggctgatgggcgtgtggctgggtccatgct

SEQ ID NO: 110323 - DNA, 1051 bp, Homo sapiens
ttaacaccacttgtgccaccaaagccgcctgtgaagacctcactcgcaggacccaccaggccaggggccaccactctgccttcacgtccagggtcatggtggcctgaagctgtggccgtgaggccggactatccccacagacagagtcccagccccagctgtgctgaggcggccacatagcccttccgcacccagattgaccatttcctgggtctctggaaaggctgaggacagggtagacctgccagtgctgaggcctggcttcccgctgggtacgtgtgggtcaggggcctggccataccacccactccctgctcctgctgcctgggcccagccagcaacctgcacctggggaggtgggaccgagcgcctggggaggtgggaccgagcgcctggggcctgggcccagccagcaacccgcacctggggaggtgggaccgagcacctggggcctgctgagactgtgtctccctgcaggcctggcgctggcggagtacgaccagccgtatggcggcttcctggacattctgcggggtgggacagagcggctcttcaccaacctcaaggacacctcctccaaggtcatccagtccgtcgctaagtgagtgtgaggctccagagccctggacctgccgcacgctcgttccaggctgcagccccggcccttgcttcctggctgcggtggaacagctggtcatcaggccccacaggggcccctgaggcagtgggacagcatcacccgcttctcccagggagtcggaatgagcccagcatcccacagagccaggcagatccctttcctttcatcgcctggggggcaaggccctgctgaggagatgcctgggccctcccctcccttgctgcaatgtcgcccctcactctggggcgttcctggcttgttcccgggactctgtaaattgggtgaaacctcggtggtggcgcctcactgagccagtccttgagttaaagccctagttactcagacttagaccaggtgagtcccagcctgtggtgggagaaagtctccctctgggtgggctgtccaagggcg

SEQ ID NO: 110324 - DNA, 1040 bp, Homo sapiens
cggcccgggtgtcacccctgttgttcccgcaggccccggtgtcacccctgcatttcccatgttcccgatatcacccctgtgttccctgcagtccccagtgtcacccctgcgctccccacggctccgatgtcacccctgcattccccgtgggcctgggcatcacccctgctctccccgcaggcccaggcgtcacccctgcgctccccgtgggcctaggcatcacccctgctctccccgcaggccctgggctgcatcttgtacctgctgtgcttccggcagcacccttttgaggatggagcgaaacttcgaatagtcaatgggaagtactcgatccccccgcacgacacgcagtacacggtcttccacagcctcatccgtaagtcccggtggaatgcgtgcgtggggcaggaccctggagcacagaccccgcgtggctctggagaccccgctccccttggggcactgctcacctggccccactcccgcccgtcaccatagttttgacaacatccctggggggggggtttccagagagctcccctgccgcccaccccgctggtgaatttgcggtgctctgagtggtgatttttgatcattttgttcggtttttgttcttccctttgccgctcccttcttgcttctgacgtcactgatgtgtgtagagggagtggcctctggtggtctgtgacctctgccagtgcagggggtgctgacccgcctggggaaccgtggggccgagcgcgctgtgcttctgctgcaggcgccatgctgcaggtgaacccggaggagcggctgtccatcgccgaggtggtgcaccagctgcaggagatcgcggccgcccgcaacgtgaaccccaagtctcccatcacagaggtgagggaggcacacgtgagccccaaatcccccgcagtggtgaaggaggcacacatgagccccagatcccccgcagaggggagggaggcacatgtgagccccagatcccctgcagaagggagggaggcacacgtgaaccctaagtctcctatcacagaggggaggga

SEQ ID NO: 110325 - DNA, 1068 bp, Homo sapiens
cccagcctctgcctctcgcaagtgcctccgtgtgtttgtgaggctctccattgttaaccttgaaccagtcgggtgagcttgggtggacggcttcctcctcccagataccctcacgtaccctggggttctgggtgtcacagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgaggaatacaacaccaatgtatagaacaccagaaatcatagacttgtattccaacttcccgatcggcgagaagcaggatatctgggtgaggtctggcgcctctcagtggcagtgcctggctccgtgcgccctacttaacctgaggcggcgtgggccgggcacctgccactcggaactggcctgcctcctccaccccctcttcccctcccgtccccttttctttttcctttccttaagaatcactgtggctgccactgtttttttgggtttttttggagacagggtcttcctctgtcacccaggctggagtgcagtggtgtgacctcggctcaggctcaccgcagcctcccgcccctgggctcaagggatcctcccacctcagcctcccgagtagctgggaccacaggtgctcaccaccatgcccggctattattttgtatttttggtagaaggggtggtctcaccatgtcgcccaggccggtctcgaactcctgagctcaagcggtccacctgcctcagcctcccaaagtgctgcgattacaggcttgag

SEQ ID NO: 110326 - DNA, 1022 bp, Homo sapiens
agaccagaaagcctcataactctatacagcctgagagaaattccatgatggccactggtgtttgtgcccctgagaagatcctcgcgatttggtgaggctgtgctgtgtggtccgtgctgggcccttcccgtccctgtctctcccatccctgacacgccgctcccggcccctcccgtgcgtccatgcagtccgtgctgggctgtctcccccatccctgacacgtcgcacccggcccttcccgtgcgcataccggggcctcgtcaaggctcctgtgtgtgttcggttgaggtgtctgtcagtcaatctcttgttgttcatggcactgttttctctggatgtccctggactctgacacccgctcctgcgctgcgcttctagggcctcctccagagctgggaggtgctgaaaccagtgggattaagatttgtcgggagcacgcatcacgccgtggggcctcccgctcgtggtgttacttgtcagttttcattataaaagaatacatgctgattgacaaaatacaaataacacagagttaggccaggcacggtggctcacgcctgtaatcctagcactttgggaggccgaggcgggtgcatcgcttgaggtgaggagttcgagactagcctggccaacatggctaaaccccgtctcttttgtattgtaaaaatacaaaaattagccaggcatggtagtgggggcctgtaatcccagctactcgggaggctgaggcaggagagttgcttgaacctgggaggtggaggttgcagtgagccgagactcttgtctcaaaaaaaaccaacaacaacccagagttttatgagtgcttataaaaatgggattttactttatataattttcctttttaaaaaaattgaccgtatcaggcgtattttttttggagacagggtcttgctttgttgcccaagctggagtgcagtgattcatagctcactgtagcttcaaactcctgggctcaagcagtcctcccgccttagcctctggagtagctgggacttcaggtg

SEQ ID NO: 110327 - DNA, 2075 bp, Homo sapiens
ggccaagaggctgctccgtgacgttgtctttcatgtgttaaaatcggctttttgcttttaccaaacctagttgtaggcgacttctaggaagaagcagttttttctgttttttttttactgccagggtaatagtagaagattcagaagtgttgggaatgaagttgttcctacccaagaggtctccctgcccagtggatgggctggttaccacagggggcccttgcccggcccggccccctcagctcctccggagacctggctgagagccgtgcagatggcctggctcccacaggccccgatgtggcttctcagccgcccctctcgtcccttctcaggctgtcccagcatgactgggcggggcatctcccggcgctgacagaggatctgggggctgcactccctgtccactgccacatgtccctcctgagcctggagtcttcggccctggctgccctcagactctgcctctctttcctctcctagctctgttcactcggagagcccgccggctgcctgagtgtgggttcgggtggacacagccacgccgcagcctccctgcgcacagccccctgagggccctgcctcctcctgccacgcgcgggatggactttggtgtcgctgtggtcaggtgtgtgtggccggtgtgcctgcctttgtccccgccctctcctgcagctcctcctgcctctgtctgcctttctctcggtcgtccactgctctctccctcatcttccgctctgacgtctaaaattgtaagggttcgattcaagtattctgacttcagtgtgttaatattgtctacatttattttgaagtgcacagaactgtggacatggttatgtacgttctcctttaacaagacaactgcagaaaaagctttccggccacccgaacattgtccagttttgttctgcagcgtctataggaaaagaggagtcagacacggggcaggctgagttcctcttgctcacagagctctgtaaaggtaacgtcctgtgaaggccggcttggtgccatctaacccagcagaggccggcttgatgcctcctaacccagctgcatggctgtgaaacatgcccggcatcttctctcaagctgtgttggtcttagcgggaagcgcgggcagctctctgacagtagttctgtgagaggcccacgctgacgcccagtgagcttcccactgtcccggtgggccacctgcatcgtctcctcgtggagctgcgggcagccagagagccgggctcccatcctgcctgtctccagtggcagcacggggtagagcgtggtggccttccgtgagtggtgtttagcaggggtggaggagcgtctgtccttctcagggctctggggtccctgtggggtggagcgtggtggccttccatgagcggtgttgagcagggtggaggagtgctgctgtccgtccttgtcaggggctctggggtcctggcaaggagaagagaggccgcagaggtggacaactccaggtccctctgtgggtgcccagcctcatcagggttgagcccaggaagatggcacaacgactccatggtccgtttgtcaggacaggaagagaggccggtgggttggggtggtgctttcggagagttctaggggcagagtggtctgtgtgagtgactgcgggggatgtcgtgttggtgtcaccggagcccacgctgactggccggagacctggcctgaccctgctgagcctcaggctgtgtctgcaaaggggaaacaagacctgtgcctcagagggcggctccacccccagccctgcctcgtgccgatgccctccagaactcctgtgccaggtgacgaggggaagtcgagcactcggggaggcctcagagctgtggcctggccggtgagggggtggtgacactagtgacccctgcgtctgtcccccaggcagggagagaggggagaggagaggccgggagcagcaggggagactgaggcagggagtcccacagaaggaagcctgtggggagggcacctgtagccgcgtgagatctgtcgtccacaagccagcccctgctcagcagccaggaggagctgttcccgcaggccggcta

SEQ ID NO: 110328 - DNA, 1036 bp, Homo sapiens
acagatgccgtctatcaggctggggaggtttctttctgtcctcgtttgctgagagttttaaatttcatgatgtagtttttccactgcagaaacctaaaagaaaactaagcaaattagaccccaaaacaatagaattaaattgattttcaaatgttaaaccaactctgctcctgatgtcttggtgggcttggtttgctgttttatgaagaattcttgggtccacattcgtgagtgatgttggtgtgtattctcttttatgtcttttcctcttttgggcgtcggggaaggaggtcccctctcttgttctgggtattggtgatctgtcctctctctctggatcagtctgtctagaatttatcagtctcgttggtctttggagaactgcttgtggttttgtttttccttctattgacctctgttcttaggttattcctgtctgtctctggagtagaggaagtgaaaggcagtggtgtatgcactggggccgcgcacgctggggctgagtgcggggggccatgtacgctggggctgagtgcacggggccgtgtatgctggggctgtgtgtgtggggccgtgtatactggggctgtgtgtgtggggccgtgcacgctggggctgagtgcggggggccgtgtacgctggggctgtgtgtgtggggccgtgcacgctgggactgtgtgtgttggccgtgtgcgctggggctgtgtgtgttgggggccgtgtgcgctggggctgtgtgtgttgggggccgtgtacgctggacctgtgtgtgtgtggggccgtgtacgctggggctgtgtgtgttgggggccgtatatgctggggctgtgtgtgtgtggggccgtgcacgctggggctgtgtgtgtgtgtggggccgtgcatgctggagctatctgtgttgggggccgtgtacgttggggctgtgtgtgtatggggccgtgcacactggggctgtgtgtgttgggggccgtgtatgctggggctgtgtgtggggccttgcacgctggggctgagtgcggggggccgtgtatgctgg

SEQ ID NO: 110329 - DNA, 1043 bp, Homo sapiens
ctgggatcagctggacatttctaaaccttgtaatcactttggaaaccagagtcagactacttatcttacgaatatttctggagcacctttatttattggcattgaagtagatgctatagtaacaccatcttaacccaaatatctatctccatatctcatctgaactctcagatgtttgttcttagatactgctacatgtataaacatgtatatatccaaaactgaagttatagtcttaatccctataactgatttcctaaatttcatagcaaagagtattgcaagagattaagaggatcattttgtaatgaagaaggggtgaattcatcgaaaagacttgataatcctaaacatttatgcacctaataacaaagctctaaaatacacaaagcataaactaatagctgcaaggagagagaaaaatcacaattgtagttggagaatattctttctcaataaacgataggatagatacccagaaaatcactgaggatataggcgacttgaacatgactgtcagccaacttgacctaatgaatgtttatggaacactccccacaataacagcagaatacacaatttttcaagtgcattaaaacattaagcctgatcatattctgttctattaaacaagtatgttatctgaccagaatgatattgaatattaaagtagaaatcagtaacagattggaaaatcctttcaatatttggaaactgaataactcacttttgttttttgtatattttttcaactcacttttaaataactcatgggtcaaagaagaaatcaaaaaggaaattagaaagtattttgaacagaatgaaaatgaaaatgcagcatttaaaactggtgggatgcagctaaaacagtattaaatgttaagtctcaaatcagtgacctcagcaatcaccttatgaaactagaaaagttggctgggcacggtagctcactttggcaggctgaggtgggcagatcacttgaggtcggaagtttaagaccaccctggccaacatggtgaaaccccatctctactaaaaataca

SEQ ID NO: 110330 - DNA, 1166 bp, Homo sapiens
ccgcagggtgctgtgttcctcttccacgtttaggtcggccttggggtctgtgatctctgtgcctttccttgtctctcccgtttcctgaggagaaactgaggcccagtccacccagatcagtgttcaccagtaacagggccgggagtggcatctgttgttggcctctcagcctggaggccagaaatttgaggggcacctgggagaggacagagcagcgtggacccttcccctgctcagtggcggccaagcccccccccataccagtccctgtccctgcaccagggctgaggctgcatggccgacctccaggagcgccccacaggcacactcagacctgcctttcctcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatggtctgtacggggcccctgcttaggcctgccccaccccgagcctctcgaggcactgcccagcccacctcagacctgtctaggtcttgccagcatccttgggtcccccagctcctcaggcagcttaggggggcccagcactgccctcgagtccccagtactgccacacccaatccaacaagcgtctcttgctctcctgcttccttctgtctctttgccccctcagatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggc

SEQ ID NO: 110331 - DNA, 1014 bp, Homo sapiens
tggcagagcctcatgaatgacattcgtgacctggtgcttttgccctcctgtcccctcccacatgcggatacacagagggtaccatccctgaggcggagtccacagcagacaccgagcccattaagagctgaccccccagcaggaacacagcccatagaacactctggagtacacctgtgggtgtgggcatggatcagcgccctggagaaggggtgggggctggaggggtgggggctgcaggtgccaggggagacagaccagctggagacggaggctggacccagaccagggcactcagggtctgctggggaggccaggaccctcccaggtgcctcacaggacccacccgagggtttcgccctgccctgggccgaggccagccccccctcacggtgctgtctcgactgccattcagggacactcatgtcacctgggctctgacagcagtgctcttgtattccagcagttcgacagaagtgtacagaggcttctggcaacacggattgccgtctacctgatgacctttctcatcgtgacagtggcctgggcagcacacacaaggtgggggcccgggcgcttccagcggtccatagctgctctcaaggttcccgtaccccgcaccacatcacgcacgggtccatggggtcggggaggacagcaggctactcctcccaccctcatccgcgtggggatggcaggacttaccccaaacccagggcctgggacagtgtggatggtgcagtaggcggaggtgtggacggtgcagtaggtggaggtgtggatggtgcaataggtggaggtgtggacggtgtggatggtgcagtaggcggaggtgtggatggtgtggatggtgcaataggtggaggtgtggatggtgtggatggtgcagtaggcggaggtgtggacggtgcagtaggtggaggtgtggatggtgcaataggtggaggtgtggatggtgtggatggtgtggatggtgcaataggtggaggtgtggatggtgtggatggtgcagta

SEQ ID NO: 110332 - DNA, 1061 bp, Homo sapiens
aacattacgatggccgggcacggtggcttacacctgtaatcccagcactttgggaggccgaggtgggcagatcacctgaggtcaggagttcaagaccagcctggccaacttggtgaaacctcatctctattaaaaatgcaaaaagttagctgggcatggtggtgggtgcttgtaatcccaactacttgggaggctgaggcaggagaattgcttgaacctgggaggcggaggttgcagtgagctgagcttgagccactatactccagcctgggcgacacagcaggactgtctcaaaaaaaaaaaaaaaaaaaccccacaaaaaccaaaaacgtgacgactgagacgagacgcgcgctctaacagacgaagaggcagatgaggccgcggaggagcagacgctggaaggaagcaacagccagccaaagggagcaggaggggctgcgaagcgatggggggcactgggagggagccggagggaatgggagggactagggactaggaggggctggtgttggggcaggggtgaggcctggggcagggggatacccatggctgctgagcccctctgagaggagtgaggagagcagttggctgctggtgctgacctcaccctggcaccccatcctcggctgtgcttggggtgggagccgctgggaagggaggggccgctgggaagggaggggccgccgggaaggttgtcctccctgaagtgggggctgccctgacctcacacaaaactctaggcatccagaggagggtggagccaagacccctgtgcctttctggggtttccaggatgagacgccagggactcaagacacattggccacctgatagctggggcaggtgacgcggggtcctcaccagatgtccaggatgagaagcgtggccacgatggcgtagactccgtcgctgaaggcttccacgcgctccttgctgagtggctcgtggaggtcaaacgagaagacttccactgggtgagccgagggctccctgtggcctggggacacgccaggagggtggagctggccaaaccccccatgtggaggtagagcccgcgt

SEQ ID NO: 110333 - DNA, 1065 bp, Homo sapiens
gggctcccattagcacagagcagaagggtgccagtttctatggaatttcagatgaacagcacgtaacagtcagtgtgccaaatacacataaatacggcgttctgaaatttagcacactgggaagtccacatggttcatctgaaaacgtgccagatccaggcagccctgacaggcgctcagccaccctgctggggcctgtgtggccacggcaaggccggcacaaatgcatctattcactgttctcagcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctctta

SEQ ID NO: 110334 - DNA, 1882 bp, Homo sapiens
ggtgagtccagcaggacccctggtccagggcagcagcaggggcgggaagggccccaggaggctgccacagctgtctcggccggcaggagctccacggggatcccgtgctgggaccttgaagtcctccacacggccaggacgggcacttggaagaggcagcctgggtgggggatgggctgcgcccgcagctggtagaggacacttcctgtctcccgctaggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacaggtgggctcagccgtgcagccgaggagggggcctcagggtctaccccttcctgtgcagcttttgccgaggcctgggctggctgtcctcgtggtggggtctgcacccagctgatgggcgggtgggtgtggacagatgctctgtgtctgcttgtgtcccagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaaggtacagggcagcccggcgtggggtgccttccaggctcctgcatatgaccccgctacacgcgtcacaacgggcgtcctcttcccagccacactcgggtgtacgcgcccgcatcatcccctctgcaaagcgggcagttgagggagacacagaaagtagccactgctggggattgtgctgagccagctggcgacagagcctggccaggacctgcccatgctgccctctcctgggtgctcggcttggtgccagggtggtccttgctcttgtctctgcctgccggcagagctgttggggagctcagggggcctggtgagggcggccgggtcctgggagatgaacgccctgtccccagatcgtgcagatgagtaactactgtggcattggcatcgacgcggagctgagcctggacttccaccaggcacgggaagaggagcctggcaagttcacaagcaggtaccggagccgcaggggctaccacctgtcaacggcatacctccctcaggtcccccagcaggaacaggcagaggggccggaacccggaggctgcctaaggcggggtagggcttcccctggtgatgggtgacctgccccgtcctgcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccaggtgctcgcgggcggggctccccagaggctctgcccggcggggccatgggcaggctcagccctcgtcctgcctgcacctacacctctgtgcccgctctcttatgcggcagctggggctcgggggccgacctgtggggctccgacagcgacaccaggtttgagaagccacgcatggacgacgggctgctggaggttgtgggcgtgacgggcgtcgtgcacatggtgagccgccggccgagtgggcgggcgagcccagggtgggcgtccccggtccccgctgagcccagctggcctctcccgccccagggccaggtccagggtgggcgtccccggtccccgctgagcccggctggcctctcccgccccagggccaggtccagggtgggcgtccctggtccctgctcggctggcctctcccgccccagggccag

SEQ ID NO: 110335 - DNA, 1024 bp, Homo sapiens
aagagcgaggaggggtggcgggcagcctgttgcccttaccaagggtgctgaggtgaggctgccccaccaggttcctgtagcccactgcttcggcccccgggggctccacaagcgcaagttctgtgctgtctgccgcaaggtcctggaggcaccggcgctccactgcgaaggtacctggagcctgcctggctccccacccagtgtcctggtctctgctgcccagggtggcccagcccacccctgctgtgcagcttgtcaggggtgatgggggaggccaagggctggccgcctggcaggccacaggacacttaaaggatgcagggtgctaggtggtggggatggggcagacccaagcaccggcagaggcaggggtcctccgggggcggcagacacctctaaccctgcctgccccccagtgtgtgagctgcacctccacccagactgtgtgcccttcgcctgcagtgactgccgccagtgccaccaggatgggcaccaggatcacgtgagtgtaccggccccagggagccctggggggtggggcgggcccagctgctgactgcccccgctctgcaggacacccatcaccaccactggcgggaggggaacctgccctcgggagcgcgctgcgaggtctgcaggaagacgtgcggctcctctgacgtgctggccggcgtgcgctgcgagtggtgcggggtccaggtgggcgctgggaagtcgagggggtgggggtggggcaggagaggtgcggggttgggtgggtgctgggaggtggaggagttggcggggcggggcaggagaggcgcgggttccaggtgggtgctcgggggcgggcggcaggaaggacacggggtccaggtgggtctgcgtcgtgtggggtctttccctggacctggcgcacctggtgcccccgcaccctggctccaaccccccagctcaggcccttctccccccaggcgcactccctctgctccgcggcgctggctcccgagtgtggcttcgggcgtctgcgctccctggtcctgcc

SEQ ID NO: 110336 - DNA, 2360 bp, Homo sapiens
agggcctcctttcccagttggggttccccggtttccccagggcagctgtggcacaagagtgcagctcttgggtggctcctccctgggaagggtctcagcagtggcttgcagacgtctgctgtgggtccccaggagggagcagaggctgctgggcaggcctggccctgctacagatgggcatcggtggcctccagctccctgtggcgggctcgtgctgtctgcacggcatcgtgcacactgaggaacagctgctcctcctcagccgtgtccccggggccctccccgaggaagcctcctctgctcagaatgtctctcacaggcgggctgcagcaggctagcagcaggctgatgcccagggccccgtagtctcggcgcaggtcctgcagcgtgctcacaccggctgcgtctaggaacagcagcggggcgcagtcgatgaccactgtgtggaagccggccgctgcgggcaccagcgcagccctggtgctaaccgggcccaggtcctcgccctgggcagggcctccctcaccgacccccgtctctgagcccccctccttcctcctggcagccatgcaccctgcgtccagccccgtgaggctgtagagtgactgcaggaagaagtccttgttggcatagtacagcggccccccaaagcggaacacccgcacgccgggctcagggacgaggccctcgaactctgtggcatcctcgtagaaggccgtgtccccgatgcgggccagcagggcggtgcgtgggcgttgggtgcggccggccaggctgagcagcgagaggatgacgccagccagcagcccggcctctgtgctgaccagcatacaggtggccgcggtgcctgcccagaccagcgcgtcagccgggctcatccgccacagccgcgggaggtcccacaccttgcgcagggccccccgcaggctgaccacgatgacgcaggccagcacgcttcgctgtaggtcgtggaacagcggtgccagcgccagcagcaccagcagcaccacggtggcgctgaccacgctggacagctgtgtccggcagccagtggctgtcttcaccaggctcttggccagggcggcgctggtggcgaagcagtggaggaaggcgggtagcacgttgcagcagcccacagccagcagctcctggttggcacgcacagagtagccgtgactgcgggcgaacatctccgccagcgagatggagaaggcggcagccacgagggccagggccacggcatccaaagccacacgctgcatcagcctgggctctgggacctgagggggcatgaaacccgtggggatgtcgccagccacgctcgagccaaagcgcttgtggagctgcccgaagtgcgacacgagtgtggccaccacgatgaccagcagctccgtgggcagcggcaccctcaggcggtgtcggtagcggtctgagagctccttcgcggctagcagcaccgccaggcacaccgtgctggtgaccacgtcgcacacgttggcctgcccggcgccgcgcagcaggctcagccatgtgaggaccaccatgccgggcccctggtgccgcgggatccgcacgcccagcaggtgtttgagctgcgaggtcaggatggtcacggaggcccccatggcaaagccatcgagcagtggctgtgagaggtaggcggacacgaagcccagccggaggacgcccatgaggacctgtggacggagtgcggtcaggccagcaggcgcctggcgggagccacctgcccctcaccagcacctggcatggcccgaggggtggtggtcacggcacaggacctgacaattctgtgttgcggccccgtgtgttccaaaccagactcctcacacgggcctgagttctggttccacgcgtgctcatgcccgcagacaactgtgacatccacgtgagcatcacacgtgcacacagctggccatagacacgtctaacccttgtcacgtgcagcagcccgttttatttcagaattaagacctctggtatcagaaggcaaccccttcctgctgcttcctacacatggtgcccactgccccccatgcagatgtggagccaacgggggccaaggtggacaggccaaggcaggagaccttcgggggtggggaggccatcccccactccacctaggacagaaggcctgggaggccacatggcctcagtccagcaccactgagccacagccacacctggcctgctggtccccaccaaggccatggcccaccggactggctccccgtgcccctcccctcctgcatccacagcctctccgcgtcggtgcctcgccctgggatgccccggcacgccccagctctgcccaagccttgctgtcttgggccagcacctcc

SEQ ID NO: 110337 - DNA, 1126 bp, Homo sapiens
catggggtgtgctgaggccagcagtgctgaggggcggcgtggcggcaccctgtccaggctcagctccggcctattggctctgcggttcctggctgaaaaccaccctgtagcctcctgaagctcacctccccaacggggcaggaacaggctgggctgccaccacgcacatgtgcctaccgtcagaatgtcacagtcactggacacaggtgcaggcaagcctgagtccagctgctccgtgtccacctccctggctccccaggttggcaaacggtcctgctgtccaccccatgcccacaccagagccctccctcccccatccaaaccatcgcctgctctcctggagacacctccacccacccctctgtcacctgccctgtgggtcctggggctggcggaagtctcaggaagaggcctcctatgtccctgccaagctttgtgggtactgggaccccaagtctgctgggggagcagcactcagacactagcctagcccatccgcctggacttgggacagaattctgagaatatgcctggacgggggccccatcagggccagctgggaggggaggagggtgactggcgtctgtctcccctgcccagacagttctgggacgtgaggcgccctttttcccaggctgcaccagctcactgtggaacggccatgacacactgtcccgaggcagcaccgagagggcccagcccgctgcacacagtcaccctgggccggcagagccggaagggcacctgacctttcccttgatctcggaaaacaccgtggcgttagggaggcggtgcttagaggcctgactggtcccacgtgaggcctcgggtctgtcctgtttgcagactccaatgtactttcactttaaacattcttctcagcgacgttaggcaaagactttgctcccaggacaccaggtgcccaggacaccctggagcctgggctgagcctgctgtttgcacgctggcccagggtgtgcgagctccagtctcctggcgggtgtgttggggcagtgagcccagcctggtaggttgacacatgcaggctgggcacagcacccctggggcacagagcgggggtcctggccctcaggcaacattgcaagagttgtgtccccttccctgg

SEQ ID NO: 110338 - DNA, 1141 bp, Homo sapiens
gggtgggcgaaggccctgggcccctggggtggggggtactcctgggcaggctgcacccctatcacccaggccgcacccctatcacccaggccgccgcccaggtcttggacccccttgagccagcgcttcctgatgtggggcgggaggctggcctgcatggagatggggttcatcttgagtcagacgcccttcatcaccttgcaccctccctccgtgggagtcactgaggcgagattcacctgtgctggggggacagcaaggctcctctgcaggtaggtacggactggcgcatgtttccaagtggaacttcgagacgtggaatgagccagaccaccacgactttgacaacgtctccatgaccatgcaaggtgtgcaccgcttcctggggtcctgcccggctgaaagggggcagaggaaggcaggagcagaggctaagccgctcatccccagggcaggtgtagacgcagtgctcccccggcccaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaaggtgcgccctgcccctccgtccgccccggtgttctgcgccctcagccgctgtgccccgggccgcgctgaccctggtggtgctgaggcggccccgcccgcagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgag

SEQ ID NO: 110339 - DNA, 1083 bp, Homo sapiens
ttgaccccagccttgttcttggcctgacctccccaggtgcctgtggacatacgagatccagttctctcaggacggtaaggcgtacaccccggtcagcaggaagccatcgaccttcaacctctttgtgttcagcccaggtgcgcccaccacccgctgccctggactcggccaccccattcttgggcctcagggcagtactgggtgggggcctcgagaagcctggggtcagggggctttcgggtgggggcaggttccggttggcacacatgtccccttgtctccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgcacaggtcagtctcgggttgaggctctgtggcttggccctgggcacattccagggcagcctccaagggtaaaccccggtggctgatgaggacccagctggagcgaggcctctttccccctcgctcccactcagaccacccccaagcctggactggaagtgtgttgagcccctgggtcaggctggcgagccagctcggccctgcccacccaggggtttccgagatcacccctggtgaggcggcgtgccagtcccttgctttcttacttgttctgcagagcggggagctgaggctgcatgagggaagactcccgtaccccagcacggtggagggtgggatggggtcacgcctgtgcgacccaggaggtggccagcagaaggaaacagtagtgtccaccatggtctgcgtctccccaccacggattgtcttggctccggatttgagacatggcagggccagatgaggacaacttgatgacagtttacagagatggaggcagggtgc

SEQ ID NO: 110340 - DNA, 1036 bp, Homo sapiens
agaccgggcccgggggcgcggggcggcgggatgcggcgcccggggcggcgatgaccgcggagcgcacgccgcgggcccggccctgaccccgccgcccgcccgctgagccccccgccgaggtgagccccccgcgcgcgcggccgcgaccccaggtgggcacacgggggagggcgggggtccggggcgggggcggggaggggcgggttcggggccccagctgggcacgggtcatgcgcgccgccgccgctcctgcgggcccccggcctgccccgcccccgcccccgcgccccacgtgggccccccccagcgcaaatttgtccgctaatggcgcaggcgattatctgcggggcgctgagtgttgtgtgtcctgcgggcagggccggagttacaagcgccaggaatccagacggtgtttggagagggggggcggcgggggagcccggtaattagtgtaaaccctttgtctgcctttgatacccacagcttctccccgctgcggcttcctccgcctggagcgcgggcggggagggcctgtggggagggcggccagacccctgatccccgcggcccgggaccggggagggcggtatctcccagttccacgtgttagtgacggcgcccccaatgtccccaggtccggacaggccgagatgacgccgagccccctgttgctgctcctgctgccgccgctgctgctgggggccttcccgccggccgccgccgcccgaggtgagttctggcgcccagcccggccagcctggcctccgccagcgccgcccccttcccgcccggccctgaaccctgccacagtgcccgcctggcacgcgccatgccccgcccctgccgccccgctcgccaggcccccttccttccagggccccctcacccatgggctgtccacagcacccaccggggctcccctagctggctggaggggttcccctcatgcgtgcttgctggccaggtgggctttagtcctggctccccaggacatgctcctggtcttgcaaacactttcatactcgtacctgcagtc

SEQ ID NO: 110341 - DNA, 1079 bp, Homo sapiens
gtctttcacaaataactctgaaggaagtcgtttcagggctttctgagaagtgccacctttgaacttttgcaagcatggccttgggggccagctctgagtggcctgcctaggaggccactcccctgtcctctgcacccggccagctgcggtgggcaagctgagccctgacccaggtgggcagggtgcctgtccaggggtgccccatgcctggggggtagcggggtcagtgtcggctccctgtgggggcaagagtctgaagggttgtgattcggggaagcaatagccgtgggtgtacggtgctgacctcggcccccagccaggcctcagggccttcctccctcgccccaggcccttccgggcagtggctggcccgtgtgcagcgggctgaggtggacgtgtgggagctgggcccagcccctgcaaggtggggaatcgggccagccgccccgtttccatctcggggccccactcctggaagggaaaataaatcactgtccccttggggggagggagggagccgtgaacaaagtcgcctttggctgggcctggaaacgccgaccgcagactcctttatccattgtgcgggaatcaatgggcctccgggctccctttcagccgcaggccccgcgctgcggccctgtcaggggaaatgttggtttttccccagtcgtggcctccagcccctggcttgcccagccctggcttgcccagccctggctcaggaactgcggccgtgctgggagaggcgggctgtgcccgcagactggaccccggctgctgcatgctggccctctgtgcggcccgggcttgctgctcggcccagggtggactcctttgccccatcagggcctccgccagtgactccaggcctggtgtgtccaggtgacagcctcagcgggtcagcacaggagggagagggatacccacacccctctccccagaggccccctccagggctgcactccctgcctgcctgccactctccctggcggccatccctggagctgctggtcaagccccagggtgcctggctgccctctgcaggcggctccaaggtgggccgcagccccagagccatg

SEQ ID NO: 110342 - DNA, 1079 bp, Homo sapiens
ggggggcggcgggaggatttggaggcatccgccttcttggcgcactgcctccgagtctagtcctccatacctgacagcagtgaggccctgtctcagactcagtttactctcatgtctcgctcccatgtggcccttggtgtcctgcctgtgctgggggcctctcggctgtggctaagtgtgtgtgcagggcaggggctgtgctggaggaggaggctggggggtgtcttggcagggtgcacggccccggaggtggcacagtgctgctgtcatgccccggcgggggttccctgtgtttcttcctggctgcagtgcgaggcagccggtcttcccaccaggtgcctgtgccctcaggtcctgactcagtttccccataggctgcgtgggttggacgcccgtccaggtggcgtggtgccctggccgctgtcctggtgtgatcattccccaggaatctggggggatgggcttcctcctgggcaggccctcctgcggggggtcttgggccggcaacagcagggggtccggggagcccaggtgggggtgggataggcctggcgagggggagggaggctgtttgctttaggataagcctggctcctctggcccagctgcctctgcccgtgcctacagcgcttgcaggccggccctgggggccacgcttccggccatccagcggtcatttgtctctgccccctttctcagtggtgaccacaggcgggggtcccgcctccctgtctgtgcctgtcatcctgcacctcccgcatgcctttggggacccttacctcaccaagccttgcttgtatctgcctggggcagggtgggggctgggaaaccttcccgaagtgtagctggggctttcagcctctgaggtgggctccctccccagatgtggggggctgggtcagtgtgctcccacccaggacagggccaggcactcgctctcttgcttcttctggacagttgtgtgggtgaacacttgtgtgcacccatgaacatgcacgtgtgaggcctgtgcccaggtagccagccaggaggcccaggcacccctgcaggctgtgggccacaggggctgggctggccag

SEQ ID NO: 110343 - DNA, 1049 bp, Homo sapiens
ctaaggtgcctggcagggtacggcccttgggggtgggcagacagacctgggcatctgtggtccctgaactcaggtctgatattgacacagacgtgggtgctgcacagactctcatccacacattgcacaggctcaggcagcccgccgtgctcggttgcttgtggatagctgtggggtcgctggcccatgcccaggcccggctgggccctgggctgatggttgggtgggaattaggtgaggggcctggggcctctttgggacccaccaggccccccatccccctactgcccttgtccttggggggccactgtcccctctgacctcgggtgtacggctgcttcctgtatgaccagaaggagactctgcccttttggttggtggttttcgagagttaccaagcgcagctgttttgcatcctctggggaccctgctcccttctcgtgtctcaaagagccagcctctggggccacggggctgccccggccatgagaggctgctgacgtggtgtttgctgggccagtgctcagggctttggtgcatgtgggcagctgaggcctgggtcaggggcactgcacctcggcccctctgctcatcttgggcaggtgacccaggtggagctcaggcccgaggtctgtgctgggccgtgggtccccttttgaccgcccccccggctccggaccccaagcccctcctcgctgactgttcctcggtcccacccgcaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggt

SEQ ID NO: 110344 - DNA, 1069 bp, Homo sapiens
atcagggtcacctgcgcccagtgtgggccagcggcccttgcccagctgtccctgggattctgggctgtgggtgtgtggcgcagccccctgcctgggtgtccagggctgtcccggctggggctgggggagctagaggccacgggggagttgggggagctcctcagggcccccctcacctgccctccctgtgcacctccgtctctctgcagatgacattagcccagggaaggagagcctggggcccgacagctcctctgggggtcaagaggaccccgccagccagcagtggggtgagcagggggtgacgggggtggggggcgtccgtctgtcccggccccttggctgcatccccgtcctctgacctccacgccaccccaccccgcagcacgaccgcgcttcacacagccctccaagatgaggcgccgggtgatcgcacggcccgtgggtagctccgtgcggctcaagtgcgtggccagcgggcaccctcggcccgacatcacgtggatgaaggacgaccaggccttgacgcgcccagaggccgctgagcccaggaagaagaagtggacactgagcctgaagaacctgcggccggaggacagcggcaaatacacctgccgcgtgtcgaaccgcgcgggcgccatcaacgccacctacaaggtggatgtgatccgtgagtgtggccccgggcgctggcgggcggggggtgctggtgggcgggggcgctggcgggcgggggtgctggtgggcgggggcgctggtgggcgggggcactggcagggcttgggggtggtgggctgggggtgctggtgggcccagggtgctggcggggtagagtccggcgcggcccaggagccatgcccgcgtgccacgttcccacagagcggacccgttccaagcccgtgctcacaggcacgcaccccgtgaacacgacggtggacttcggggggaccacgtccttccagtgcaaggtgcgcagcgacgtgaagccggtgatccagtggctgaagcgcgtggagtacggcgccgagggccgccacaactccaccatcgatgtgggcggccagaagtt

SEQ ID NO: 110345 - DNA, 1060 bp, Homo sapiens
tctattaacaggaattgagttggtgtgaccagtatgagcattggcagatgctctttgtggagtgactgcgacccctagacccacgggcctaacgactggcactcacagtgcagtagccgtggtggcatctctacacaccccatcttcctcttcaagttatatccttctggtcttttgtccctttcactgattttccataattgtattgttttattattggtagacaatactgagcagaatttttctcagggaaaccacctagctttgttgaacttttcttctctttctaaacttttcaagtggtcaaactctggctcatcgttctgaaaggtcctgtaaacatggtattcccttctgcttaagatgggattttgttcatctgctcctgttgaaggattatgactctgccacctgtatctccagttcctactaattctccagaatgaataagttctactggggaagaaaaaagctaatgaaatagttatggtcaatagttatagaaaaattaaaattccacaccactcgtgacatcatctgctacatcgtcatctattgctcctttcacctgagaaacctctactgagtgtcatccctcctccagctcctgccatagggaaacaaaaatacacatatggccccattatgtttcaccttgtgaagggctcttccttctcagcgcaaaaatatctgtacatacacctaagaaagcttgcagcagggggtaaactactttccttgacctaaatgttggttacacattatgattctgaaaaattgactgaggtatacactcataatgtgtgtacttggccatgtgttagctcacagaaactgtaactaaaaacttgcaaatacttaaaaatgaatatacttctaggtaacacatgggtcacaggagaaactgagtaaaaatatcaaaattcaaagataaaaatatagtatcatcaaatacatatactgcaggcaaaaatgaacacagaagggaagttatgaccctatagtgtaatattacagaggaaaggttgaaaattaatcctaagcacccatcttaaagaac

SEQ ID NO: 110346 - DNA, 1017 bp, Homo sapiens
gtgcttaggattaattttcaacctttcctctgtaatattacactatagggtcataacttcccttctgtgttcatttttgcctgcagtatatgtatttgatgatactatatttttatctttgaattttgatatttttactcagtttctcctgtgacccatgtgttacctagaagtatattcatttttaagtatttgcaagtttttagttacagtttctgtgagctaacacatggccaagtacacacattatgagtgtatacctcagtcaatttttcagaatcataatgtgtaaccaacatttaggtcaaggaaagtagtttaccccctgctgcaagctttcttaggtgtatgtacagatatttttgcgctgagaaggaagagcccttcacaaggtgaaacataatggggccatatgtgtatttttgtttccctatggcaggagctggaggagggatgacactcagtagaggtttctcaggtgaaaggagcaatagatgacgatgtagcagatgatgtcacgagtggtgtggaattttaatttttctataactattgaccataactatttcattagcttttttcttccccagtagaacttattcattctggagaattagtaggaactggagatacaggtggcagagtcataatccttcaacaggagcagatgaacaaaatcccatcttaagcagaagggaataccatgtttacaggacctttcagaacgatgagccagagtttgaccacttgaaaagtttagaaagagaagaaaagttcaacaaagctaggtggtttccctgagaaaaattctgctcagtattgtctaccaataataaaacaatacaattatggaaaatcagtgaaagggacaaaagaccagaaggatataacttgaagaggaagatggggtgtgtagagatgccaccacggctactgcactgtgagtgccagtcgttaggcccgtgggtctaggggtcgcagtcactccacaaagagcatctgccaatgctcatactg

SEQ ID NO: 110347 - DNA, 1018 bp, Homo sapiens
tggagctggggagggtcgggcagccccagcacctcaggctactgcgccttggtggggaactctcctgcggctgctgatgaacacccgggctctggtctcctgtagacttccgccccgggcacgggagcaaggggaggctgcaggcagctccgggggccttggcaggaagttgggagggtcgggacagtccctctggggtggcccaagcagggcacagggcagggagccaggctcttcggggccccaccccaggctggccctgcaccccatcctgccttctctccccactgtgggcccagaacttgccccgtgggggccgggaagcacccaccatccccacccctagctgctctcagccagagcccagctggacttgcaggattgattttccagcaaaaaacaacagcagagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctggtgagtctacctccgcttccccaagcccttgaccactgccctggacagcctcagccgccccctgacccgaccttcaaacgggccaagggcttcccatgtagggtccgaaaacatccctgataggcaggacatgagacttgaacaatataaggttaggtgcatctgtaagcgcggcgcatggttaggcagccggaccctctggagcatgtgtaagcgcggcgcatggttaggcagccggaccctctggagcatgtgtaagcgcggcgcatggttaggcagccggaccctctggagcatgtgtaagcgcggcgcatggttaggcagccggaccctctggagcatgtg

SEQ ID NO: 110348 - DNA, 1018 bp, Homo sapiens; identical to SEQ ID NO: 110347

SEQ ID NO: 110349 - DNA, 1024 bp, Homo sapiens
catgtccctgtcccacggcctgccccctgtggcccacccgccccacgccccttctcctggccaaaccgtcaagcccgaggcggatagagaccacgccagtgaccagttgtagcccgggaggagctctccagcctcggcgcctgggcagagggcccggaaaccctcggaccagagtgtgtggaggaggcatctgtgtggtggccctggcactgcagagactggtccgggctgtcaggaggcgggagggggcagcgctgggcctcgtgtcgcttgtcgtcgtccgtcctgtgggcgctctgccctgtgtccttcgcgttcctcgttaagcagaagaagtcagtagttattctcccatgaacgttcttgtctgtgtacagtttttagaacattacaaaggatctgtttgcttagctgtcaacaaaaagaaaacctgaaggagcatttggaagtcaatttgaggtttttttttttgttttttttttttttgtatgttggaacgtgccccagaatgaggcagttggcaaacttctcaggacaatgaatccttcccgtttttctttttatgccacacagtgcattgttttttctacctgcttgtcttatttttagaataatttagaaaaacaaaacaaaggctgtttttcctaattttggcatgaacccccccttgttccaaatgaagacggcatcacgaagcagctccaaaaggaaaagcttgggcggtgcccagcgtgcccgctgcccatcgacgtctgtcctggggacgtggagggtggcagcgtccccgcctgcaccagtgccgtcctgctgatgtggtaggctagcaatattttggttaaaatcatgtttgtgactgtaaccatttgtatgaattattttaaagaaataaaaatcctggaaagagccagcgtgcccagcatctattctggtgactttctctcatgaggacacgggtgagcctcagtcctggctctggtgacctccacggctcagctcagcctctctgaagtgggcggcctaagag

SEQ ID NO: 110350 - DNA, 1044 bp, Homo sapiens
aggtgggcgtgggggccgctcggtcaggcctgggggtcccttcctgccagccccagatgctcatgggctcgcatccgcctggcagccaggcccatgttctgccagctcagggcccgtggtgctctcactgcacccccagcagggacctctaaggccaaagtcaagttgagccctggcgtcgtgtcttacacacaggacctgctgggaagttgctgggctgagcagacaggtccctcagcaagctgggcacgtgctctgggctgggggtccccacgctgcaagggtgccagtgcccagagagacaggaccctgccgtgccttgggagccccggggctgagagggaggagcacactgccaagaatcctgctgcccgtgtcttcaacccagtgggccacgctcctggggccccctcagagccacagctgttccttcctcctgcatctcccaggccggatcccagacagcctgaagaactgtgtcaacaaggaccatctgacagccgccacccactgggccagcatggaccccgccgtcgtgcaccctgagctcaatggggctgcctataggtgagcaggcccgctggcccagaacagcctccaggagggccccaggcttcccctggatcccagcacagcccctggtgggaggggcggcgtctccactgactgacctggaggatctgggtagaattggtaaggccaacctcacctgaaaggcccatgagaaccagggcctcttggaaggagcctgggctggggtggccttcagggctcagtggacacaggagtgccatgggcacggggcctgtgggaggagggggctttgggtgaggcgaagacctcatgttcaagtcacctggagacaccagggctcccctccccagccctgagaagtagctgccataggcaggaacatccgtgtaaaggccgggatccttaccctgactgctggtcctcctggagaggccccctcggtgctgccgatgctaggagggcaggtggggcctggccaggccgcctacaggtgggcctcacggatggacc

SEQ ID NO: 110351 - DNA, 1089 bp, Homo sapiens
ttggtcttctcagggaggcctgccctggctgccgcctttgaaactgcgcccacttcccacccgccccggcgctcaacctgcttccttcctgtgtagcggttccctctgaggcaatgcaggagacaccacgttcgcgggcttggggtcctgtgtcctttgcagccatgctgttggctcacagtgggcacgagcactctgcagacccttccccgaggaggagccggccccagccagacacggtggctcaagctccacggctcctgtgctgggacccgtgccagccttggactgctggggtgggggcaggcacgtctgcctgggatggctttctctgccgctccactcgaaggggtcaggacctgagcccagcggggcctccctggtctggaagtttccctcctgccccctttgccgtctccacgtagtggtggctggaattgagatgccggaaacattgatgggtggatcgaaaggccagcggaggggcctgggcacggaggacatgtgttgggtgggtggagacccactgaccagtccgtttgacactgagtggttcatgtcacgtcctgtggacaggctgcaggggagtggtgtggctggcagctggtgtgggccgaggggctagtgtaccctttccacccctgtgcatctcctccgccttggcagtgggcgcgttggagcggacgtggagcgctcgtgtggagcgtgcgtgggcaccttggcttgaccacagctggtgtcatccttggcagatggtcaaactgaggcacagaggccactccgaccctggctttcggggccggcctcccggccacgggtgagcaagggtctcacactgtgtcttgacgccaccaggtcgcgtggggcaggcagtggcgctgcgggccaaggccttcggcttcaacgtgctcttctacgacccttacttgtcggatggcgtggagcgggcgctggggctgcagcgtgtcagcaccctgcaggacctgctcttccacagcgactgcgtgaccctgcactgcggcctcaacgagcacaaccaccacctcatcaacgacttcaccgtcaagcaggtgcgtggagccggggaca

SEQ ID NO: 110352 - DNA, 1038 bp, Homo sapiens
gaggcctgaggacatgtgcggatgtccacgtaggggtgtgcaggcggggccggcacccagattctgacctggccacagcctcccagcagggtacccccgagaggaatcggggtggcgaggtgacgcggggagacacgtgcttgtctcttcctgggctgccagcgctgagtcgggaggggtcagggcagcgtctcacaccccagccctaccacacaccgagcagttgccgtgtgtgtgctgccacgtgaacctaaagtggaggtggggctcctggagttgctctgttgcgcccgacctgtgagcaacgtgttcatctcgtggcctcccggggtggccttggggacacggcctttggcttcttccttgggaagcttcaaacccgctccagtcacggcggccccggtgtcctcccggaggctgggcccggcccgggggtgaccgccgtgtccttgtccccacaggcattgccgtctgcaacgtgcccgcggcgtctgtggaggagacggccgactcgacgctgtgccacatcctgaacctgtaccggcgggccacctggctgcaccaggcgctgcgggagggcacacgagtccagagcgtcgagcagatccgcgaggtggcgtccggcgctgccaggatccgcggggagaccttgggcatcatcggacttggtgcgtcggccgcagctccacgcctgtgtccctccctgtgtctggcgctgccgctcttcagctgtgcccaggaggagaggcccggggcggggtggggctgctgcaggtgtcggtcccaacccaggacaggactgagtgcgcacaggcaccagggcccgggagtcccaggcgtgtgccctacgtgcacggacgtcacagcacacgtgggtctcacacaggcacacacagataacgtacacggatgccacagcacacacagcctcacacagacatcacagcacgtgggtctcatgggcacatgcagataacacacacggacgtcacagcactcacatgggcttcatgggcacatagataacacacggatgtc

SEQ ID NO: 110353 - DNA, 1063 bp, Homo sapiens
ggcccgggaatcagtgacatgagatagaagcttccagaacaggaggcagagcctttccgcagtttccctgcccacagcacacaccctgtgccctccgtcccctggttcttggacactggggacatctggatgcggctagagcctgtgggggtggccgcagccctgggggactgttcccaggagtaggcctcggggccacaggggcgcggcctcgggcctggcactgcaacctcagggtgagcgcccttcgtgtgtgcggcaggagccggggcccctggctgtcagcaggcccccgagtccaggtaggtcccagacagcagtcccgggtgtggcagatgcagtgaggtccacttctgaggcgttccctggagtctgtgagttctggtcggaccttcgatggcattttaatgtgtctcttgtgtttgatttttagtaagactttgaccccgacgcaggcttcagtgattgccgcggatcagaagcctgagcactttggctcgagacaattaaggacgtgggatgaggctccgagacaggacgcggttctgcctggggatcctgaagataaaaagctttgaaaagtcgaattcatggtcgtggaagctgagcccatattaagagatgtcaggttggtaggggttcctggcgtcggcggcagagtgaagccggccggtctctttgcgaccgtgtggaggaggcactgcctcggatcaagtcgagggacctgggctgcatgggcgtcgggccggactgctgccacctgacccccggtgtgctctgggcgaggtcaggtgcccctcgagggagggcttcctgcacacctggtggcagagcacagctgtggtcaggcctgtccgtggcatctgctgtctgtttctgtcggaaagtgtctgagaggcacggagggcctccatgtggaggccgccagcacgagggtggagccccacacggaaccctggaaatctcaggtgtccacccggctggcccaggagcagggccgtggcccctgtggagctgttccttgtggttggtctgcgctctctggcccggaagtgcgtgcagt

SEQ ID NO: 110354 - DNA, 3085 bp, Homo sapiens
gctgcgtgagccgagccagcgacgactctggcagcgctaagggtggcgaatttggggctggggtggaagccggagtttgcggggcgtggggtctctggcgcccaggcagacggagtgcgcggcgtgcccagccagtgcccggccgccctcccgggagcccagggctgggaggtgccggctgcgccggtcgctagttaggaactgtagggagaaacctcacggcctgatggcacccagcgacctttttgatgggcgtcaccaaacctgaaatacagctcttgccgtccggctgccggttgcgtgaccttgggtggtcacctagccacgtcgcacttcttagaatgaaatttgtgctcctagtagaaggagccgatacttgttctttacctagttagtagaggatttgatatgaagcacctgggaaggaattccttaaaagatcaaggtcatagctttcctagagctgcggctgagcttcgtggttctgtgttgccttcctggagagctgcgtagtttctctctcctcccagagcgccctggtgttcacgtccgtctgaggacggacggtgtggcgacaggtgtggaggatgcagtatggccaggttgctgtgcgttcccccagccccagggcagttcagcgaagggctgaagagcacaggctgtgagccatcctgctggggtgtgaatcaggcttctctgtattcgtccttactgggagacatcagggcccggttggtgactgtttattcttgtcaggtttaagcagtggtagcgcctgtgtcacctcagggtgaaatgagtgaccacgtattgtttcaaacagtgcctagcattcattaaaaggtccctgctacagttagcgctgctgaagtcaggctgtaccctgctgtagctggtcttcataggaaagcagaagcaagcttctcctcctctttattaactagcggtttatttcatatttttaaaaagaaacggggtttcactgttgcctagggtggttttggattccaggacttaagcgatcctcctgccttttgacctcccaaagcgctgggctgacaggtgtgagccacgcgcccgccacactaatggtttcgcagtggggtttcatggtgcttgtgtgtccagcacttcttttgatcaaggaagggagggcaatgttgctgacgttaccaaaggtctagcctcttgctagatccctccaagatgtaggtggttggtttttaatactcagtgacattggtggatctctgttggtttagagatggagaccctgcagctgagagaagtctatacaaggacattgtggtgatattagtagggagtcctaaccactgaccactttgtctcacgcagtgcacctccaggcctgtcatttcagctaacacacaagaaggtttgaagatcagaaccgtggtggtttgtcacttctggtactggctggtgaatgtgggaaacactagataggaaaagtttccagaaatcctttcattgtgtattgaaggaactaggaagggagatggaaggtctccggaaaggattcttcttcaggtcttctgctgttttgtaatcgtgaatgtaatttgtattccagagtgattgcatagcttctgattaaaatagtcatgcagatagtcatacaggtaaagaaatattatagtgtcataatttctctgttgacacttgtgtcactactgagttaaaactttttttcatagaagttttcaggagtgattcctagtggataatggaggtgttttgctgggaaactagggatccttgatttagaagcatttattggtatagaactaaacagaacatgctgagctcacagctcaagagctgcactcttcagtttccaggaggggccagtgcagatgtcagagaagggaccgagggctgcaggaccggggttgtggaaggtggggggtggatgttctgcttctctagtctgagagcaagtcctcctgcagggtggtagcagctggcatgctctggactggatcttcacctggtaatagttaaactgctttcctgccatgtgagtcctccacagactcacaggggattcctttctcttcagagggcttggtagccctaggtgggtttcagcagtaacacttgggatgtctgcttcctcacagcgtcagggcggctggtggggctcctgggtgcctggcaggtacttatttttctattttcctggtgaagtgggaagagaatggaacagacgtgaattgctgcagccaacacgcactgaccttgggcacctctgtcgtcatgagcttctatttccaccaaaggggtggaccggcctgcgaacgtttgggctggaggagcctttgtcggtggtgggggctgtgcagtctaggatgtctagcagcatccctggtgtctgcctgccagatgccaagagcatgcccccaaaatgtcttcagacattgctagatgtgccctgggggcatgcacacacccctgagaattgctgggctggatcctgctttaagggacttgtttcttcctcttaccaaacggaggtgtggctcatgaggactcagccttgcgtcctggctgtggctgtgtctttttgctgtcaaatgctgtgaacgccgtccggtgtagggtggtgggtaatgccttgtgggggaggggaaagatgaataactcaccatcttttttttttttttttttcttttttgagacggagtctcactctgttgcccaggctggagcgcggtggcacaatctcagctcactgcaacctctgcctcccagattcaagcaattctcctacctcagcctcccgagtagctgagattacaggcacccgccaccatgcccagctaattttttgtattttttagtagagacgtggtttctccatgttgtccagctggtcttgaactcctgacctcaggaattcaccatctttcaattcaacatgcatagttcaccatcttgaattggaagcccttgctttcattattttgtaaaaggtttttttttttctgattataaaagtaatttgatgagttgggtgcggtggtgtgcgcctgtagtcccagctaattgggaggctgaggcg

SEQ ID NO: 110355 - DNA, 1092 bp, Homo sapiens
cgttcctcacccgtgcctgtgcccccctcacccgtgcctgtgcctccctcacttgcgctgtgcccccctcacctgtgctgtgccctttgccttgtggctgctcctgcacttggttctctctctgttggtcggttttcccattggctgtgcagctccctggtgtgcacgtggctctgagtcttcctctcgtgaaaaccccttccttgcccccgtcctcctccagctactactccctgtctctgccccttcatgtctctcttcctgttttacctaaatcagatttttgccccccaacactccacccagatgttcctcttgaggacaggatgatgctcctgaaagcggtcagtccacagcggaccccactgcctcgagacgctcccatcactcggctcccgtgacaccatcctctgggctctccccacccctcgctgcatgtcctcacttgcctatgctgtcttctctagtcttggaggccttttgttttatgtcaccagccagccctccagaggttgtgtggcttcacagacggtctccaagctcctgtccccacactgctgccctccccaggcctctctccctgaggccatcccgtgtagtcacctcccggagctctcttcgcatgtctggaaggcagttcaaagatacgataccaggcgcaaaaccaaatgccgcatctcggccttggggccccagacgagccccagacctgccttactaagccacccttcccaagtcagttgacagcgatgtcccccggcacttgttcagtgacagccgagaactcggaggttttctcgatttctgtttctcacgtttatccttgagtccacgatggctgctggggctgcggccttcgcggccaggaggagggtaagggggaatcagtgccgccctgcgtggccagctccctgcgtgggggccttagtggacatcctcccaagcgtttacacttcagctcattccccagagcacggggctggccatttctagctttggaggagcctgaaaaagtacgtgcgtatgtgtgtgtgtatacatacatatagagagagagcacgcgcttgagtgtgggctcattgctgccctaaa

SEQ ID NO: 110356 - DNA, 1057 bp, Homo sapiens
gaaaaccgtaatgatatcatattgttctttttgtgtttgataaatatttcttatttataatgaaagggacaccaagaagggctgggccttgccagacaccacagccaggtatgtaactgccaaagttgtgaccttgtggcagaacagctggctccctttgaaatactttatggaaaggtgagagaggaagctctgctgatgttgtgattatgaactgacactcctgcccgcttgcagtctctgttgtttggtcagggagtgacctggggatgagggcactggaccgcgtggggcacggccccggctcttccgtgctgccggcttccgaggctggggctgcgtggcgtgcgtgtgtgccgctgccgcaggtcgcataccctttccaagacggaccagtggctttaaaaggttcctgcaaggaagtggctggctaaggctgggcctaactgggcgtgcacacaacagggagcgcagagctcagggccgacagcactcttgccactgcgagctttgtagggcgcaacatcaatctggttacatcccctcagaagttgactggaagtgtcattttttcaagaagcctcttaggggattcgaagcgtttttccttggtgagcctccctcagggtatgtgctgtgcttggggagattagctcaggatggcaggaagccaccgtgattacatgccccgcaccagaacatgagactggcccctccaggacggagagggatgtaaactgccacccagggcttaatccagcacttctggccctgtgatgagcttcgtgatcaatatttagaaacctcttctggttaattgcaaaagacaaagagcctcatgcattggggaaattcttccttcccgtgctggtgaaaacatgatgatgacacactgaaatgcgttgcgttttgtcagcaaattctgtcagaagcacggcaaacgctggagaaggtttgaggaagcgcatcctgaagctgatggcaccgtgtgggggcagcgggcgggcaggtgcagacgtttcacgcatgtctccactcacactgcttgccacattct

SEQ ID NO: 110357 - DNA, 1050 bp, Homo sapiens
cagcctgagcagcagagtgacgccctatatgaatgaatgaataagtaagtgaataagtaaaaataaataagcactggacaagggacacagacaaaatgtgtagaaggaaaaaagtgttaggttgaatcatatacagttgttatttttgtaagttaaaagtgatgaccgaatagacctataacaggtgaagttactacaaaaaacctcacaaagaaaagcctgagaccagatggtttcactgatgaattctgttaaacatttaaagaaggatttataccaactcttctaaaaacagttaaggagggattacatcccacctccttctatgaggccagtataactttgatataaccttgaaccagacaaagacatcacaagaaaaccatagaccattgttccagatgagagaaaatagatgccaaaatattcaacaaaatcttagaaaactaagaaaatctaagaaaacaaaatatagaaaggattatgtgtcaggactaagtaggatttcccccagaaatgcaaagttggttcaacgtgtgaaaatcaatgtcgtgtatcatattaatagaatgaaggacaacaaccacataatcatctcaatagatgcaacaaaagtactttacactgtgagaaatcagtgtttgctgtttaagttgcccagtctgtgatatttttgttacagcagcctgagctgactaagacagctgctcagaacagggagaaaatgtttgccagtcatatatctgttaagggtttagtattcagaataggttaggaactcttctagttcattaatacaaaggcaaaagaaaacttgtttttttgagttggattctcactctgtcaccaggctggagtgcagtacagtggcgccatctcggctcactgcaagctccgcttcccgggttcacgccattcttttgcttcagcctcccaagtagctgggactacaggcacctgccaccatgcccggctaatttttttgtatttttagtagagacggggtttcactgtgttagccaggttggtctcgatctcctgacctcgtga

SEQ ID NO: 110358 - DNA, 1090 bp, Homo sapiens
ccagcccgtgtggagcccacgccccatgcacccttgtccctgcccggcctggcctcgtgtggtggcgcctgcagccgcagcagcctggctgatcaccggccaggcctgtgttttaccgtctgatagcctcacaccccggtcactcctctcctgtttggaaatttctttaactgttcgttattctggatgaactttgggattattttgtcaacatacacgtacaatgtttttggcaaaaattggggttgcttctcatccagggatgtggagtggctctccgttcagcagggcttttgtgggtcttggttgaggtttagagtagatacttttgagaccatgaaccttctgagacttctgcctctacaagtgccatgaggagacctggtgtgtcctgggtgtggggctggtggggctcacaccaggggagcagatccctcaccatcctccttcctctccaggtgccctacgagacgctgaacaaacgctttcgcgccgctcagaagaacattgaccgggagaccagccacgtcaccatggtggtggccgagctggagaagacgttgagcggctgccccgccgtggactccgtggtcagcctgctggacggcgtggtggagaagctcagcgtcctcaagaggaaggttggtcccgcctggcggtccctcttcagtctggggcatggacaccccttttgtctcgaaaatgagtcctaagacaggcaagctgcaatgatgggaacgcgggaggtgcggttgggggcccccttccctgctgtctgccttctggggccactgtcggctgagcaggccagcttcctgttcctgtagggaccgtgttgtcttgctccaggagtgtccagagtccaggccacagggagaccaggatgtatagcaggttgattgattttttttttttttttttttttttgagacagagtcccactgtgtcattcaggctggagttcagtggtgcgatctcagctcactgcagcctccacctccggggttcaggcgattctcctgcctcagcctcacgagtagctgggactacaggcgcccaccaccacgcccgtctaatttttgtattgtta

SEQ ID NO: 110359 - DNA, 2038 bp, Homo sapiens
aaaagtgattgggcaggcacagtggctcacgcctgcaatcccagcactttgggaggccaaggcaggcggatcacctgaggtcaggaattcaagaccagcctggccaacatggcgaaaccccgtctctattaaaaatacaaaaaaattagccgggcatggtgtacgcctgtggtcccagctactcgggaggctgaggcaggagaatcacttgaacccaggagctggaggttgcagtgagctgagatcgcaccactgcacttcagcctgcacagagactctgtctccaaaaaaaaaaaaaaattcagaatttaaaagggactaaaatttcaagaaatgggaaatataataaccaaaaatgaaaaactcaacatttgcctataacagtttaacagttaacagacaaagctaaagacagaattagtgaactggagggtgatcgagaatggagcacagagactgaaaaatcaaagtggctgcgagagtaaagcatggaatagagcagaaacctgtggcatgtttcaccagagcccaccagtgggtggggacagagatggtgcggggagagtgaccaaggtttcagaactgatgagtaccaccaggtcagaatccgacacagagtaagtgaaaataaaccgacatgggattttcccgtggtggaactgaagaaaacagagacaaagaaatatttgaaaagctcctgagggcaaaagatgacttccaaaggggcaacagacagccggacagctgatttctgcacagcagttggaagccaaaattggtagaatgtgctgaaagaagccagcccggatcctggatctgtccagtagtcagtcgccgtgtgtgctgtcaaatttttagcgaagaattcagttcctcagttgcaccactgcccttaagtgtgtggcagccacgtgggctggtggcagctgtgttgggcagcacaggcctggaacgtttctatctagcccgattcatttttaacaaaattgactttaagaaaaaaagtattgcaaaagatttttttaaagtcaccttataatgataaacagtttaaccagaaaggcatagcaaatttgaaattgtatgcatctggcaacatggcttcagggtatattaatataaagccagaaatagcagagagaagctgcagatccagggtggtggattttcactgcctccgtctgcagctcttgggccaggcacacctgcctagcggactcggtagagcacggttttttttctgtcccgtaatccctgcttttctccttgtgagtgttgtggattggggcagcctggcctcccttggtgcagggctgcggggcatccctgtcctgaacgtgcctctgttgtgtgtggctcaggcggtggaatccatccaggccgaggacgagagcgccaagctgtgcaagcgccggatcgagcacctcaaagagcatagcagcgaccagcccgcggcggccagcgtgtggaagaggaagcgcatggatcgcatgatggtggagcacctgctgcgttgcggctactacaacacggctgtcaagctggcgcgccagagcggcatcgaggtgggtgcccgccagacgcaggcacagcgccccagctggccccaggcctatggccagccgccctgtggcatgtcccccggcatgcctgtgtccctacatgcttgtgttcccctccccccacccccgtatgcttgtgttcccctccccccacccccgtgtgcgtgtgtcccccctccagtgtgtgtgtgtgtccccctccccgtgtgcgtgtccccctccccccatgtgcatgtccccacccctgtgtgcgtgtgtccccttcccgtgtgtgtgcccccccccccccaatgtgcgtgtttctcccccaccccgtgtgtgtgtctgcgctgtggtgagggcctcctccccagctgagaggccctgaccctttgtggaaacgcacctgggacttagccttctgaaggcaggaagtcagtgtctaagcggctctccaggttcttctcatttccctgtggtgtctgcacacatcctgc

SEQ ID NO: 110360 - DNA, 1082 bp, Homo sapiens
tcccttgcccggctatggctgctgtctacgtgagcgtccgaccttttggtccttgggggctgttctgttcctaggatctcagagcggccctgagtagtccacgagtgcagacccacagtgtggactggagatgcatctcgagtggtggccggtgctgggcctgcctcatggaggctggggtgtgggagggtggcatgggggccttgagccagcacattctgatcaggtgctgcttccttcctctaaggacctagtgaatattgagatgttcctgacggccaaagaggtggaggagtccctggagaggcgtgagacggccacctgcctggcctggtgccatgacaacaagtcccggctccggaagatgaaggtgcacggactcccaggttggggtgggagtgggtcggggccgaggctgcgccacctgccctggagccagcacccccttgcctggtggttcacagtagtttggttttggtttgtaaggtgggggttgggtttgggagtttttttggtggctgtgttacacttttaggctaaaatctggaaaagtgcacctcatttggcattacagtttgtgtacagctggcatgaggctcagaaggagtgggttacaggaggctgaccatgtgcacacagagtgttggggctgctgggcttagagcctggagacaggtcagtcctgctccatgggggtactccatgggctccctgtgctcagtcatagacacagaaaagctggttgggaagtcattctccatctgcgaggctgcagagctctgggctgtgatattgttaatgaatacccacttttttttttttttttttttttttttttttgagacggagtctcgctttgtcgccagggtggagtgcagtggcacgatcttggctcacttgcctccggtgttcaagcgattctcttgccttggcctcctgagtagctgggattataggcatgcgccaccatgcccggctaatttttgtatttttagtagacatgggatttcaccacgttggccaggatggtcttgatctcctgaccttgtgatccacctgcctcaacctcccaaagtgctggg

SEQ ID NO: 110361 - DNA, 1049 bp, Homo sapiens
tggaactctgggcgagagggctggcgtgcttgcccactgcctgttcctaggtgccagcagaacgtccctgctgggtggctcttgtcctgcctggagaggttgcgtggccggggagagggcggcgggcgacggagccactctgtgcctgtggtcctggtgctggaggccggggtgagaaggcgcaggcttcttgtctccaccgaggcctcagtggggctgtttagctgtcgagtgcagcacttcctgtgcctcgaaagacagccccgtgtagtcagcatggcgcccacatagccagaagggcacgcagcccagggcagagtggccacagggggctgggctcaccccggctgccctgagtggcccccaacccttccttgacccgatgctcagacagtgctacaaggaggacggcagctccaagagccctgactgccctgtgtgcagccgctccctgaacaagctggcgcagcccctgcccatggcccactgtgccaactcccgcctggtctgcaagatttctggcgacgtgatgaacgagaacaatccgcccatgatgctgcccaacggctacgtctacggctacaatgtgaggggggcagggcaggggggccaggctggcacgcatcgccatcgggacagggctgtgtgggacgggcagggcaggggggccaggctggcacgcatcgccatcgggacagggctgtgtgggacgggcagggcggggggccaggctggcacgcgtcgccatcgggacagggctgtgtggggcgggcagggcagcggggccaggctggcacacgtcgccattgggacagggctgtcctctcgccccaccctgccttagcttcgttcgaaatggatgaaggggtgggaaggacaggcgaggtggccccgggatttctttggcaggtgtgccttcgggaaggaactttgcctgagaggatgagtcattccctggtggttcattgtggggattttccatggaaatccgtgtgtacgttgtagtcgcttgccttaatgcattcccggttttatttttcagtctctgc

SEQ ID NO: 110362 - DNA, 1081 bp, Homo sapiens
cgatgagacttggagaacgggctggtccttcaccacttcctgttggccctggcctggccggggaaggtggcagcggcaccggactgacctgcagtgacccgcgatgccgcgccacgagggacacttatggcttcattcgagagctgctgccaaaacgcctggcgccgccaccgtcgggggctggcttcgaggacgcccgcctgcctcgcgggtcgtgtccgcgggactgtgttcgtacgtgcatagtttcgatatcacatcgcggggctgtgttcgtagctgcgtcgtttcgatatcacaccctctgtgtgccgccttacttcctgcttcgagaatgtataacgtggaaatccacgggaccaaatttctgcagaggccttgccggatggttccataactgtagagtctaattgctatccattacagaaattaatcgttcagttgaaagaagtactgatgacttttcaaaacaaatgaaccaccgtagctgacagagaaccgtatcgtagaggtttgtagttagtgcttatttttgcatgttgatgttgactagctaataaactgtaaatgtaaaccatgcgaataaaatggttttctatttctcatttccgtgtgagccgaggctgccgtgcgtttctaacaccgaggttgtgttctgctcctccccggggcccgggcagcatggcgggcatatgcgtagcttctggcaccacggccaccgggagttgagaagccggctggaggccactcctgcccggaccgcagtcctcctctcgggcgctgccctgaggcgtgatggccccagcgtcttgaggccccggcttgcagctgggtgaatcagacactggttcctgggacccacgggccattgtctgttgggggtgggggctcaggctgcagccaccagcaagcctgggcctgcggcttgggctgagtctagggttgggctaaggaggcctgcgggctgtggccactggcccttccccccaccgcccacccctgttctctccagtgccccgtcgcagctcctgtggccagcctggtgccccttagcccatctcttaccccatggtggctgccc

SEQ ID NO: 110363 - DNA, 1030 bp, Homo sapiens
gtcccagctaatcaggaggctgaggcggctgcactacctgagcctggaaggtcgaggctggggtgagctgtgattgcaccactgcattccacctggtgctgaaaagtgacaccctgcggggagtgggcctctgagtgtggttttgagtgggctggtgcttttgctccacatagcgcagcaaacaggtgtcttgatcttccggcagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcaggtaactgccttcgcggggtctctgtggcgccaccctgccccggctcccgggtaggctcctccctcactggcacccggcccaggagcctggggatgcaggggcctcccctggggagctaggtcaggggtcaccaccaggtttttcctttctgtgtggcctctgcactgggctccccccacccatgccaggcctctgtggccacagggacacttctaagagctcatggcagcccccacctcagtgaggctgtgggcagagtaaggacccacaggattggggtgaggtggggtcgtgaggctgttgcggtcctcaaaggatgagggagcacaggcctgacctccaagtgactggatccctgggcaggctgtgtgggcatcccgtcagctcacaggcctgtcagggtcccgtgtcgccatgaggggtcaggtagcaccggccctt

SEQ ID NO: 110364 - DNA, 1027 bp, Homo sapiens
ctggcagagcgtggcctgagctgctgctccgggcctcaccctcgcccgtgaggagcagatagcaggcacccacctcgggactgttggaagatggaacacgctaacgcataggcgcgtcctaactgcccggtcttgcctgatgtgcctggcgggttgtgggagtggtggcagggagtggacacgtgtctgtttcagggctggaggcagcaccagagaaagacacagttgtgcggtgcttgcggacgaggacgaggatggacgaggaggtgtcggaccccacctctgcggctgctcagctgcggcagctccgggaccacttgcctccaccctcatctgccaggtgactcccagtgtcctgtgtgctgagccccctgcccggcgctgccacagcctctgcccagagcactggccggcctcgagaggctgcttagtgccttttctggatatcttggtggaagccttgggtgtgtacccccggccgggtgagcagtgttggtgccatgtttgggcttgtcagtgccagcatcagctggagcccgggtgggactgggccaacaaatacccttccagacactgcccgtgcctctgagaggagcccccagggctggggtttgagaggcagatgtcaggtcacctctgggccagggtgaaggactgcagaccagaggccagctgttggcgagggcccagagcttctcacaggacctcagcggtggccctgaggcccaggcgtcgtgtggcagaagccattgctcacctgatccgacccgaggccccagccttgctgtgggggtggggagggagaggagggtggctgtgggtggcaccagcagcaccgtcaggctgtcccactctgctcctgtagcccctccagagcgttgccagagccacaggaggcccagaagctggcagcagagcgggcccgggcgcctgtggtgccctacggcgtggacctgcactactggggccaggagctccccacagccgggaagattgtcaagtgagtccccatgtgtctgaagtcggc

SEQ ID NO: 110365 - DNA, 1488 bp, Homo sapiens
cttcatctctgtggcccaaattccccaactggaaaatgggtacaatcaaatctgccctgtcagaggcaccgtgggagcctgccctcccaccctcaggcgtcaggtgctgatgtagcccacctccaacctcggtggcccactgagctccaggatgggtgcctgactgagctgagaccaccacgttcctgctcctggggtgcagccgcacacagctgagaggcaggcagggtgggagccaggaaggccagtttgggagctggtatgcctcaggaggagggtgtgccaccagctcacaaagggagagcatgtggctccagagggagacagaggcactgccaggcccctgtgctgctggtaacaggagcccgcactcacaaagcatcacgggcaactgcctgctcacacagccaagtgggctgtgacctgcctgcttcaggcatggttggatccagcatctcaaagcagagaccaggctgcttctgcctgtcggggtggctcagaggcctttctggggggcagaggcagtgagacccagtcccagcttgcaccccaggctgctggatactcaggtgggccctggaggggagcaggggagcgggaggagagggctccatctaggttgtgctggaccctgggaacagatggcagctgagatgggcactgtcccccaggaggacagccggtcaagggggtgcagaggcccgagggagacaccgttgtgccccaggaggacggcggtcagggggacgcagaggcccgagggagacaccctgatggtggcacagctgagtctcccatgctcagcatgtatgccgtgaagccccactccttccccaggtggaagaggaggggctgccccagctgtgaccacagcttgcaggaggcctcaggtgagggggtgaggatggcccctctctgcaggcaggggtcagtgtgggggtggacacccctgagtcggcttgacactggtgccctggggctgcttagcctctgtgagcctcagtttttccatctgtgtgggaatgcgcccgtccagtgtgataaggcgtcacatgtgagctcccggggggctattcgggctctgaaggagcatcggaggtgaggaggtgaggtccagcactgcagctgcactcgggggtcctcggctgggcacgcactggccctgggggggaagattctgccagggccctcagcacgccgggaagggcccagtctgtcacccaggcttgtccttggctctcaccacacagcctggggcggggcctccctgcagccacacggccacccgggcctcgggccgccaggcactgccctgtcctgtaatgggaggggccctcagctccctggtggtccgtttgtaggggagccccctgcccactcctctacgccagccatcggccctctgagggggtgccgcactgccagaccctggctcaggagcccgcgagctgggaggaagcaagtttattaccttccacaacgtgataa

SEQ ID NO: 110366 - DNA, 1051 bp, Homo sapiens
cctgcagcacctccccaagcaagggcacactcatgtcaggggctggagagggacagggctgggtctgggcctactggggcaccacgaaggtcactgacacctggccctctgggcctcgagtccaaagcccgtgtgtgatcaggagactggcctggaggcccagctcggccccagagctctccctggcctgggaaggggtgtgtgctgggggccctggaaggctacagggaagccaccatttcaatcccgaccactcacgacccttgtgggactccaggtgtggatgcccacctggaacagccacactgagtcagtgggggaccacagtcccaggccccaagggtccccatcctgccacattcttagaggggagccactcttgagggacccccagggtctcccaggccagaaccttgaggctgcacgaggacccttcagcccactcaggcccggaccactccaaggctggccaaggaacaggggaatagggtgctgcccgaggccaactgagggacttccaggggccctccaggagaagctggctggtgggctacgtgcccagcctctggagggcgaggggatggagagctcgtggcctccgaccccctgtcctcaccccaggaccaggccacaggatgcagtgagtcagaggatcccggaggcagtgcctggctccccacctccctggccgacccccaccctgttcccccacctgctgccccagcccaataagaagttggccacaggcacccccagcccagtgcctgtgaacagctccatggcagacatggtggctccagaggtgtccctgctccctgggagccagctgcaggagctgggggcacggcaggcgcgccggggggctctgtggcacgcagcgaaggctatttaaatgctccgttggagagggattaaagtttacgcaaggtcactgaggatgtgataattataatcacaggtttttggctccacaatgacagccatttgttatttccgctcgggcggctcccgcggcccagagctggtgacaagcgtggactgatttagtggc

SEQ ID NO: 110367 - DNA, 1849 bp, Homo sapiens
ttcactgcatgggagaagggcgcggaccctcccgtggtccagctccaggggcaggatcgtcgctgttacccaaggccagcggtggcctcagacacagctaggtgcagagatgctatactatactccccgctgcctccctcccctgaggaggggtggcagagggcccaggaagatgcctggggctgagagggagaaggccagcgggacaccaggagcaggggacctgaaccccacatgctgaacccctcaagcctcaggtgagtcctggcccagccagcctggcttacagatacaccccgagggcaccccttccctcactgttgacccactccaggagaggacgcatcagataaccccgtaaatcacacgtcaaaacactttttaaaggaaaccgctgaagagacagcgtttcctcagcctggtgaagacgcatatagcaaaatctatgtaagaaagccggctacttaatcacggagacgaagagcctctgcgagagattgttctgcttaaaaaatgtggtggcgacttgcaaatatgtttttagaagcaattttattacaaactgtcccatcggatagcgcctggaaagttatggggagctgtgttcattcttcagacgctgggacagcagcgggaggttgttacaggaggatttattccagcagagctggggaggggcccaggccaggtgtcgaggggacaggctccatctgggtctgtgtccttcccaaggggccaggtagagggtccctgccagcccctcccctactcagtgcctggcccctctgcctccctccttgctggtgccccagtagaggggccctgggagtgaggagctgccgtctggagggaatgcacagatcgcaaaaggccggagggaggcccaggctcagggacacggcacccacagtctggctgacggagagacgtgaacacagccacaactcacagaacacttcagagggactcaggccccagcaggaagaagcaaatcacaagaagcccctggtgtggcccaagaatttctcttttttctaagtcaggtgtgagacctggagtccacagggactgtgtggggtctctgacctcttcctcctggctggagggggctgaagccagaagacactctctgctccttctgcattctcctcatcacagtgtctgcctggcagctctgagatggccccagggatgcacacccctacggagtcccctcccctggagcggggctgcgcctagcaatgcttctgggtgatgtggcaggtggggaggcagctcctctgagaggaggctgtagaaaagagcatgcctctgtcttgggtgctggctggatttctccctcgccttcctcccctccctgaccctatctctctctcatcacttccccttgggggaagccagtggctggagtgagtccactcagacagcctatggagaagcccatagaggcaggaaaccgacatccctggggtataggcagtgaacgtcggtggcttgccaacagcctcgggatgttcttgggaatgaatctaccaccagtcaggctttgagatgcctacaaccatggctgacaacttgactgcagtttcaccagagaccttgagccagaactacacagttaggctgctctcaagtttccgagggtccctcagtaaccgcgcaggataataaatatttgtgatttttagttactatgttttcaggcaatttgttatacagcaatagataagtaatacaactaaccaccataatcatcatgaccatcatcaccatcaccatcatcaccaccatcacaaccatcaccatcacaatcatcaccatcactatcacagtcatcaccatcatcacc

SEQ ID NO: 110368 - DNA, 1113 bp, Homo sapiens
aggctttggacgctggttcgatccccgcccctggaaaccatccccgtggcttgtgggtgccggggccgtggcgcagccccacgctgactgcagaggagcccttgagccctcgccgagcccacgcactcctaccctgtgctggcaacctggccacctgtcccctggtccacccgcgccatcagggcgggcccggcggcggggcctccagcgacaggatccagtagcggagaggaaggaggctgagggaccccactccgcgcccgcccctcgcccccccctccgctaggcagaagcccccgccgccagaccccaaggaagcgtctaaaattaattcttgttcccgcagcagcgggtgaccccgatgtgtcggcctccacggctctagccggcagccggctctgcgtcttatctccagagcagcctcatttgttaacttctcgctgaatacaccctctcccattatttctgtaattcttggcaataacagcccttcccctaatgaaacctgcattattggaaggttgcagtcctgacccggtgaagattagctgtgtcctctgttattgctacatatgtaattgtataattgattttaaaatttacttttgtgtccccacatcataaagtaagcagcccattaaggggcagaaatataattaatatatctgtaaccacttcaacctcgggaaaacaagggctggggggctctgccggcctgtgggcaggggcgccgcagggtccacccctaggcctcctacagtcatgggcctcgggaggggctgtccaagggggtccgaagtggggtggggtggtgcctcctccagcgggaaggctgcctgcctgtggccatgccccctccagccgcccccaggcccagtggccctgcccttgctggagtgtggttgtggtgaggctggactgatcccacgggggccctctgaggctgaagcccctgcccagctgcctgcatcgtgggcacccagggagcagaggggagtgaggggcccgtaggaggctgcagggagctgggcccaggccagcccctgtagcagggtacattccaccgtggttctctttgcctttgccaccccttcccaggcacaaagacaccct

SEQ ID NO: 110369 - DNA, 1028 bp, Homo sapiens
tgccgtgtatcgggacaggacagacagcttcctcctcacctcagggacaaaggggactgtctgtgcctcgtctgtgaagccaaggtgtccgcccaaagcgctgtggggctgaggtgcttccttcttcctgtgtccgtctgctgcccctgggggtcttggggacagctgggggaggcgttgctgtaggcgctgggtccaacctctttccaggtggggacccgagtggcagctgtgagcccaggagggcgctcttcctcgcgggccaggggggctgcagaagaccaccaggggggcttctgagttgctggtgggcactcacctgggggccggtcctgggggccaacaggcgcccagcaggggcttggcgtggcctccgcccttggagggatgagctggggctgttgcttgacccgcgttaacttttaatttaaagtctctcaccaaaacacaatggacttttgacatacaaatattaaaaattaaatttcccgagttcattatctgataattagaactaaataacatcttaactgagaggccagccccacgcagatcaagtcagttccatttaagattccattagaccagtgtcggagcgataagtaatggaccataaaatttaatttggaaatgatctcgcgccgagatggagcgacagcgcttcacaaagagcggccgggccacggggccccggcgggggcgggattcaaaggcaccgcggcggccgccgggaacatgtgttcgcgctttcttccctttctcggccctgcggtatttaaaagtcagaattgaccagtgtagctccgtgtaattacaaagatccccttatcagagtctatttgccggcgcgaggaaagagaggccggagccgtcggctcatttgcatgcggggccccggcggccgcaggaatcaccaggatcagcgcgggcctcgctgcaccgggaggggccgggcatgggcgaggctggagggagaggcgtccccggggcggcctcggaggggctggaggggggagaggcgtccccgg

SEQ ID NO: 110370 - DNA, 2176 bp, Homo sapiens
acacacatgcacacagtcacacgcatgacccacttgcatgttcacatggtgtgtgcgcacacacgcacacacacacgcacacacacacgccggcacatgcacgcacacacacgcacacacacacgtgcacgcacacacactgcctgagctccacctgtccagtactgtggggatgggcccaagggggagcttcccttccccgtctggtgtggcagacggctgtgtcccttgtctccagctcacgcctcttgtgtcacactggttgagtgtgtctcttgcatttccagaaaaggtgagtgtgttccggcctgggaaggtgggtgaaacccgggtctcctcctttcagtccagcgaggcaggtgctggtgctccctggaggaggttctaggggccctcccagtaccctggggttctcgactcagtggtgtcatgggtgctgaacagtgcaaggagaatagtctgtctttggctgtggttccgaggacccccaaccaggggaaacagtgtggctgtcctgggccttttctcaattgttggggggtgaggggagtggctttgcagagctatgtgctgggactggggacctggatgatgtgagaggctctcccagcttccagaagctcttggtatgggcggggggagggcgtaggcccagcagccacaggcagcggtgacacccaggaagggctggggaaaggcaggtcaggggaggcttcttggaggagagagcccagagctggctctaggacgagctccagtggctttggctcctgtttgcccttgttgtgcaccagccacccacagcctcccctcctgcagaagcacagacacactccgcagacacactcccacccaggactgccatggccacaggggtgcactctggtcggtgtgggctgaggggtgcgtcctggtgggtctcagccgcacactgctcggcttgctgtcttgggctatgtcctcgtggggcatgaagctggacagaggacttttcctgggtccccaacgtcccggggcaacagggtggaaggagctggtggggccctccagtgcctctgtggcaaggagtgccccaacccaggagctgcctgggcccagccaggagcacggcccaagcctggcctgtgcctcaccggacgtagagatgtatcgaattcagcttagcaacccaggcatgaatgcccggcctttaaagagaaacttatctgtaattaaaatcatgcacaagttttagaaagagtgtttacaactgggaagaaagctgattgtgaaaaagaataggcttccgttggggctgggagtgtttaattcagaaataaatccccccacgggaggtgcttctccggggctcttttccctggtgcttttgggggctggcggctggcgtggcgccgtgtggatgctgttgacggtgaccttatcgagctcccatcgcagacgcgagggccgggctgcgggctcccgggtggctggagaaatttgctgcgaactcaggtcctccgcttgtgagcaataaattagtccagttaaaatcagcaggacctgcttattcaaagtttatgtttccctgtaagcagatggtggcctcagcacgtgtggagcaggtggcatcaatcatggctttgggatttaggagacagtaacactgctctcagcgggagagcctctgccctgacgcgcggcagtcagaacgtgatttacgctggtccgggctggctgcggccgccggtgtaatttaggaggtgagggtggcgattcggcgttaattgtgggaaggctgatggatctctgtccccacagccccctgccggccccttcaccgcatcggcgtgaccctctgcagtccttcttgccatcagagatgaccagcgtggccagtcgggggctaattgcttttctgagcattgattgcaattaagagcacacatttgagtgggaagatgaggggcttcgggctggaacgcggcctgaggcgtgggcagctgactggcctctgagtacccagagcccccgggcagagcagctgtcccgaggcctctgagccaccagcccctgtgatgtgagatgcgcccgagaccctccctgcctgccccacccaggcccagaaaacccccaggatgaggaggccgcgcactgtgttcgcgtccaggtggatttagcttgccacgctcagccg

SEQ ID NO: 110371 - DNA, 1003 bp, Homo sapiens
cgccatgggcctgtgtgtgtgtatgtgcggcgtgtgcgtgagcgtgggtgcgaggcatcgctgtgagcctgtgtgtgtccgcgcatgtgccttgtgcctttcgttgccgccctcccaagcaagatgtaacaggaaggctgcagggatgggtctggggtcctgggctgtttggggagtgtgaggatccctgccggtcttgatgtggcctctttctgctttcggccgcattggacattagcaccctgctgggcaaaaaatggtttcatgctcctggaaattggcggggccaacatgctgattgattttccaggcaggcccctgggtccccgcggttcctctggctgggtggggtgggctgcccggctgtggcagccacctgtgggatgtaggggtcgggaggcaccggggtgtctgccccagaggccttgactgcaggtatctctgcccactgatgaggtccagcttcagaaacgggagaaaatgccattgtcatcctgtttcagcgaaagctaatctgtgtctttgcttctccatttggctctgctgtgcgcccctagggggttctgggacacgaccccatggaaagggccttagtgagagcgagggatgccgtcaccaccgccccccccgcccgctgccaccccatagcacctgcctgtgtgctggccgcgtctcccatctgcaaaggcaagacctgggtccctgcagcccagcacccatgtggggctgcctcaccccgggagtgtgcaggaggctgggggtcctgtcaagtaagaggacggagtgccggggccaccctggagccgaggtctgcgctggtccccattcgagcaacttggagctgcaccgggctctcgggcgcctgcttgctgtaacactctgggggagccatgggggcgcggggtggaggctgccgggctctcctgcccctcactacctccctcatggcttcccctcttttgcccctttcccggattctgctgcgccctggggagcccccgct

SEQ ID NO: 110372 - DNA, 1143 bp, Homo sapiens
gccgggacccccggcccacccgagcctaagcctgagccaaggacgtgtcctggcagggagagggagtccctggggtcttgtgggacgtgtccacagggcacgccggggcctggcttccccaggcctgtggacacggaaggcaggaacaggaaggggctgcagccgggccaccacggggggcaaatgcttgtccatcgcagatgggcgtctgaggctctcgggctgcctctgccatgccccgggccccacctggctctctggggggcggcctgttaggataatggcctggcactgaagccttcctgggcactgttgcggccggtccctccccagttctccgccggccgcgtgatggagctctgacggggacagactcccggccggagctaatcgaagctgaaaaggtggaatcagcgtgtgtcgtatccttttgccaccttcatcaatccagctaactgggtttgagctgcgctcggcaaatgttctgcagcgggaaattaatatgtaagacatctgaggcctgacggcggccgcagggccaagcgggtgctcgggcagggtggcctcctagggccaccacggctgccgcccgctgaggacctgcagtctggggagggtccccaccctggcccccaccctctgcatcatcaattcagttacctccggggttgatacatattcaggcccgaggacgccagggtggaaggagacaaaggaatctgtatttacccaataataagttccatttggaggaggtttgaaaacaattccccgtcacatttgtccctgtcagatcacattattcacaaatgaagttcacaaagtatcaattcaatttcaatgaggcgctggctggcggggctggggctgaatttagctgggtgctgggggggcgtggacagcgtggccgtcagaggtaatcaaaggcaggcgcagcgggcaggctttccatttcacccactctgtgcacatctgttcctggataatcccattttctacacttccaaatcactgaagacggcagctgggggggctccaggcccctgggagccaaggtggggcctggggctgtgctcccacccagtgccggggcctcctgggactggcacctctccaggtcaggctgcagctgtcctggtcccc

SEQ ID NO: 110373 - DNA, 2882 bp, Homo sapiens
tcactcttctccccgacagtttgtgctgtcccagaagagcacagctgctgaaatgtgctccccatctcccctgacaagctccaccatcttgccccatcctcccctgccagcccctcgggggcgtgtgggacaggacacccaagtcccgctccttcttgccctcagcatcccctctcagcttgtgcacactagaggctggatctggaggatggggcagagaggcctccgggtcctgttgtggggacggctggcaccggccttcggccttcagtgggtggtcccactgaagcacggccttctctggccccatgcctgactgtgaatgggtgaggctctgaggaccacagagacctgtccctcaggccctgcccatccctcctgcctggggctctggggctgggtcagtgagagcagatcaggcagtatctggggagtcccagctctgccctcaacttgccctgaggtgacaaagcctcgactgaaggcgagtgggacccactgggtctgcagtagggaaggtccaggcccgaccacacctgggggctgtcccggctctggccttggcccaggccccccccaccaccccgaccaagctggccttcctgcctgcacccatctgggtcttctgtgcccctgagctggggcagtgcccccgccagcatcccaagaacaggaacgggccgcagaggaccagatgtgactgcacaggggcctggacgccagcttcttccctcccgcctgctttctcacctggaaccgtggccatctcagaggaaacccgcctgtctcgggattttctcacccgcagagcggggagggccctctgggctgcctgcagtgcaccgtgtgtccagcagggggcaagcgcccggccccggagccgcagcagggtccgcttggggccgcacagggtcctcgcccgacctgtgtctgaacacgcaggagcggccgggccaggcagtcccagcgcattttaatagtggaatgtaattcctgggcggcagaaaaatgaaagtgagaagtctatgaattattgcaaatgctctcgatctgctgggccgtgcagcggggccctgggctgcaaagcctttttttctcatgtttaagttggcgtggaagatgaaatagtcacagagacgcagtggcccctcaaagctgttattgccagctgtgtgtctcctgtaaacacttttctgatttataacctcactctgctttataaatggaaaaaccagaaacgccttcaggagcagcctttcaccgcccaagaggcctctgcgtccacacgtggccgcgggggcagggtgccgaggcttctggtcagccttccttcccagggccaaggcctccacctaggcctggcgcgaatgtgggtcccggaagggtgacccacggtgcctgtttgcctgggacggacggggtttccggaactcggggaattcgatgcaaacctggcaggttcccggcaagctgcttccctggactctggcggttcttcttttggtcgacagatgctgtggacgggttttctgtttgttttggaaggagagggggtactcagacatccggcgattgtctttgctggcctgtgtccgagaggggaagctgatgcctgtggctggaggacctcgtgtcgtacctagagtcccctcaggacggccgactgccagccatgggccacccgggagctcaccccacagccccacctcggtgcccacacctgggccaggtggccatggggtccccaagcctcgtgcagatgagggaagggactcgctgcagcctccatgctggcgtctggcctcagaaagagggctcaggaaacgttggccactgactcctgatatcacagtaacccagggcggctgggatgctgtcctgctcaatggggaactgagtcacttgtcccaagtcctgcagtgacccagaaccgtgcaggtccaacccggagcagcagagcccttggagcaggcggtgtggatggcagccccatcacagccaggatgcggggtcagctggggtgtgggttgtcagtctcctggagttgtctggggtgtgggttgtcagcatactggggttgcctagggttatttggggagtgggttgtcagtgtcccggggttgtctgggattgtctggggtgtgggttgtcagtgtcccagggttatttcgggtgtgggtgtgggttttcagtgcctcggggttgtctagggtgtggactgtcgatgtcccggggtcgtctggggtgtgggatgtgggttgtggcctggggttacctggggcgatgcctcccctctccggggcaggtcttcgtaacatcaggaatttgcaggcacatgtgtctgggtgttgggaagcaaacagtctgtgctggatttgctgtgtggattcttgaattatctggagaatacaagcttcttgatgaaaagtgtgattttgtgttatgaaccggagagtcatgggctatcaggccgggggctgggtaatgtcctgaatggcaggcgctgtcgtttccaggaaagacgatggtgtgaacgtgccattcaccctttagagcccgaggctcagggcccacactgaggccctgcactgcttctaagtctgcccaggatcaagagcccttgggcagggggtgtgggtccctggagacaagtttatcagtaaagcaggagaccttgaccgccagctgagagcctggggcgggtctggctgtccagctgagagcctggggcaggggtccggctgtcctgctgagagcctggggcagggggtccggctgtcctgctgagagcctggggcaaggggtccggctgtcctgctgagtacctggggcaggggtccggctgtcctgctgagagcctggggcaaggggtccggctgtcc

SEQ ID NO: 110374 - DNA, 1033 bp, Homo sapiens
ggaccctctgtctgggggtgtcttaggtgagtctgggaccctctgtctgggggttcttaggtgagtctgggaccttctgtctgggggtatctgttgggttggctgggcctcctctgtcctcaggaggcaaccttgtcttgctcgctgagcctggctgcctcttgagtcctggaacccgcttggctgctccaggcacgtgctggcctcatgggcaccaacccacatgcagggacacaggctcctgtgtgctctgctcagatgcagctccacctcctgccaggtgccacatgtgccccccatggagtcatgccctgctgcccaggccccacctgaccacatccagcctccgtcaaggcctggtccccatccctggaaaggccagacactgggccgtgacacccccttcccacctcccacctgcccaccggactctttactgagtctgccctggcctggggcctgagcacctgtgggctgggcatggccaggtggagtggaccctggggaccctaagaagctcctcccagccttgagcgtccaccccagccatgcccctggggctcctaaatccccatggcccttagacacactgagggggaatggtgggtccaaggacagctccttccccctggagacggggtggggtctaggcctgcttcacctctggtcccctaccccagcctcagtttccctctagcgccaggggctggggctacacctcactcctgtggccgctggattggtggtctgaatgccaagctggggcagacgggagcttggcctgactccaggccctgcactggccatggcgccgtgagtgggtggccccctcaactgttgggggggtggccctgcctctggggacaccagccccctctccccagcctgtactatcatctgttcttcacggttcctctgtcttcccaccacctttggccgggttcggagccctcctggtgtgctgggccccggggctgtcctgcccaggcagtgagtgtcatttaggggggcaggctggggtgggcagtggtgc

SEQ ID NO: 110375 - DNA, 1518 bp, Homo sapiens
gcgctggtgacgggggcctcgaggctcagtaccgcctggcagccctggagcctcggaccgggtgccccgtattctcctcggctagattaggccccagtgccatcctccaagcaccgagggcttcccgggccccttcccagaccccgccccccaacctgcttccttttgctaaaaagctagatttttctactatttgtgctgcttttaatccataggaagtcaattttccactcatatattagtttattttatattttcaaattgattcgactatgcattgatttcctgttgtgggcattgtgtcctgagccgggattacgcgtttcggagaagtggatactcgtggcacataaaggtgcttctacgccacagagctcttatcttgaagagggagagtccaattttattgaaacagctaaaatcccacttaattgaatttttttgctctaagatgtacaagcttagagacgtttgctttccaattcaactcaggctccgtggtgtttaaatttccaaacccataaagacctttatgaaaaagaccctacaaatattgtatttctgagcgggcgcgtcggtgagcacccgggtgggagtggggaggcatccgtgcccttggacagcctttgatcctgcggaggggccccgggcgctggctcctggacggtgcctcccctggaccgctcgctcccttccttcgggccaggcagtttcctctccccgctgtgctcggtggcctgggctctgcggcttccttagtggcctttctgggcgtcgcgagggtgctgaccccacccttgcccccacccttgtagtggccgggccaggtggccctcattcgtcagggactggccctggctgcccggtggctgagctgggctttgaccctggccactggctcccaggccctctcccctcacctcccactgactctcagggaggagagaggagagggggtgagcaggccgcactcagcgcccagctctctggagctgctagacgaagcctcctggacagcagcctctgccaccgctcggcccaggccatgcccagggcaggggtgtggccagtgtgtgtggggacctgggtctgggcggggtcttcactgcacctgccctgggcctgggctccaggcccaccagtcacagctgggtgaatgaaggggtgcctgagagttggggaccctctgtcttggggtgtcttaggtgagtctgggaccctctgtctgggggtatttctcaggtgagtctgggaccctctgtctgggggtgtcttaggtgagtttgggaccctctgtctgggggtatttcttaggtgagtctgggaccctctgtctgggggtatttctcaggtgaggctgggaccctctgtctgggggtatttctcaggtgagtctgggaccctctgtctgggggtgtcttagctgagtctgggaccctctgtctgggggtgtctctgaggtgagcttgggaccctctgtctgggggtgtcttaggtgagtctgggaccctctgtctg

SEQ ID NO: 110376 - DNA, 1037 bp, Homo sapiens
aaagaatgctagaggggcagccccgccagctggtgcaagcatggcgtgcaacgtccacgaagctgagcaggatggcctggacgacgcacccaccacggggctcctggagagaatgggcagccgcccgacgaggcctgccggggtctcagccctgcacctccgcagctgtgggacgccatgcctcctctgagatctccggtctgtgccgcctccacccttttgttcagacatagctatcgctctcccctgagcccccatgacccacagccccctggcctgcaggcactcctcctccagggagcccactcagttgcccccctcagagccagctcccaccccctccccggctgccaggccactccctccccggctgccaggtctctccctggcccagaccccacaggcccctgacatcccatgcgcaattgggactcaatgcctatgaggctgcctcgccccgaccccagcaaccacccctcaccctctgtctgacctgtctgacggggacccctcctcaccagccccccggtctgtctccccatcacctcggtatgtggtttccaggtgccctcagggggcagccggcgtctctcttttggtttgtttatttccaagcaacagacaaaagcgccactcccgggtcccgcggctctgaggcttccaccaacaggggaggccaggagaagcccagtgggcaagcccctcgggccgtacccaggcccccgccaggcaccagcccacctaccactgcccagaaacccacctgctcatgcacccacccacccatgggctcccaaacacaccccctcactactgtctccacccgcccaattcctcccccacccacctatgcacccacctgcccactaaatcccaaacccagccacccgtgcgtccatctattcaaccagagcatgtctgtccacccccagaccgccttctgcctgtgcagccacggcccccaccagcctcgacctgcccgtcccgtcatccatttatttatgccccgcttgccgatgcctgcggctgaataacaa

SEQ ID NO: 110377 - DNA, 1442 bp, Homo sapiens
tccgagggttgacgcagcccctggacctggaggaggcaggagggagctccaagccttcagagggagccatggggcaagtaccaggtaccccctggtgatgctggttggtgccgggtaaattccaggtggcttctgggctccagaccgtgaaagcatgctgctgttttaagctccacccctgcccgtggtattcattccacagccccagagcaagttcccctgggggccgtcctgtgactcccccggccacaccgcacctcacccggagtccccagcccgccccacccagcctcaggtcacgccttcctctgagcagcctccctacactgcaccagctcccgggccccctcctcattccctcctcggccccaccccctgcctctctcctggcctcaccttgccccctcctcttctccggggcgggcggcacccaggccagacacctcctgccagcccatgctgacgccggggctgtgctcagtacgggctcaggatgggctcaggacaggcgaaggcggccgagactcccgggccggcaggccggtgccgcgtcagcagcgggctcattagcggagttaactgtcaggcataaggagggggaaaaagctcaatttgtaaacacttggtcaatatgaggtaaagccaacaggatggatttgggaccacattggacaacgccatcggctgcaccggacgcccagcaacagtaggtaaattaggtcatcattaaattatcatgaggaaaaacgcataatcggcaccagcgctggtagaaagattacggttatttacaaaaaccatgctgtttgcaaatttgtgcaaaattatttgttcctagcagagttttatagagctatctgcacatgatctccgcccgagattcccagccctgcatattaactaatgtctgtggtttaattggaaatagaacaggccacattgtaaatcgcttttctgccatctgtctctgtctccacacggggcctgggagtggaggacacagtgaacagatggatgacagggaccctgcgctgcccggccccaccccactccccgccagagcctcaacttacccctgcaccgcccggccccacccactcccctccagagcctcaacttacccctgcactgcccggccccacctcatccctctccagagcctcaacttacccctgcactgcccggccccacccactcccctccagagcctcaacttacccctgcaccgcccggacccacccactcccctccagagcctcaacttaccctggtcacggctcgaccctgacgctggccacagccacggacactgcaaagaaccagcccctgcacagccacacacagggttgggggcggccctcagtgggcttgaagcggcaacgggcagtagtgtcttcagacctgaaaattaaagaaggtgacggaggccatgtctcagcaat

SEQ ID NO: 110378 - DNA, 2631 bp, Homo sapiens
acaagctctgtgcctcagtttcccaagagtaccccaggtaagaggcccatttcctcctctccttcagtccaggaggtgtctggcttaggagacacacagtcctgggtctgcagctctggtgccccttgtccctctccaggtccttgtccctgtatccaggacctcaggtgcggggtctgctttttctgggaagcacccctagctggggcagaggcagctgtctgagcttccctttgcccatccgtccgcctgtttcgagcctcattgcgcaccagactgtcccaagagctgggcgcagcgggcagagcagatcctgctttcaacatcctggcctcggccctgcccacccacacgggccaccctccttctgctcggccctccccccagcagccccttccagaccactgcctgttagacctgcggacccacactgccgtgtccagcagcagccctggatgccctgacacctcccttcccaaagcccatccccagtcagcttctggaaccttctctccaggttcccttcctgaccactggggtcctgccagctctgcctgcccatgggtgctctcgcccggcccacgccagccctgggctggacagcaggcgggagccgcaggatttgaggcaccacagtccccaggcagctggcctcctaccatgctggggtgttatttagagggtttggggcgagacgagaacagcctaatggggctgaccatgtggaaggacgtcttatctgggcccgcgccggccatccattaccactaatgacaccggcctcgcgcctcggccgctctcggccaggtgggccactctgtcctcattgtcctcttccagggatggccccgagacctgcgggaagggcctggggtctccctatcgtcccagagcagcagccccacgtcgcgggcgccccgtgatagatgaagcatggaaattagttccagagtttaactgataaccgcagagcccacgacactcggttatggcagctctaattgatgagctcattaagtccattattagagaaattgatttcaaataggcacttggagtgcgcggggaggcaggtggagagggagcgcggaaggcaggggaagtctcgaaatacataatgaggcacgtaatgttataggtttgtttaatgaaaagcctcaactgcacgctcgtggccgtgtgtgttttaaacacccattttatgtactaataaagctcccggcgctggggtccctccttggccccagcccactgtgctccatggctgcccctaattaattaattaacccgggcaaggcgatcaatgagttagtggcgcagaatcgacactcccaggccgtgggttgttgggaggggtgagggaggccggtggggccggcggcggaagtgggtacctgggcttcccatcctctgccctctcggcctcaccctgcctggctcggccacccgaggctgaggcagaccctgtcctggatggtggggacctgggttgccatggagctgctccacccggccagggagaggtggcccagaccctgaggcccagggtcccagaaccagggcgggagacagtcacggtgaccctgacctgtctgcttcagctccaggggtccctcccagccatgctccacaggctaccgacgccctcctctcggggctacagggctcagtctgggatggttgtcagcatccccacccagcctctgtgcagccccagaccacatgcacctagacagacacacgtagacacacacaggtactcggcatcccacatgcagacacatgtggacacacgtggacacacagagatactgacacagaaatacacagaatcccttacagagacacatggtcacagagacacacgcagacactcacagacacgctacacacacatgaccagcccttcctttctgcaacgtgctccggtgtgtgtccagggctctgtgctccccggctcccaggcctgtggctgtgcctgccctctgggtcctctgctccgaggcttgacacctgctctgtccggccctggcctctcgagccgcctgtgctgatgaccactggccaccctcctgccgccgactcccaggccgtgagtccggaggccccaacatctccacccggctgtcccagaggcttctcacactcaacatggctgaatcctaacgatccccgatcacttgctgcccagaagtccccgtacctagtgaggggtgcccagccttccaggccccgccatgggccccgcagcttctcccggccccttcatcccatagaggttcccatggctgcaccatggaaatgcacagaacccaatccctcctcatgctgcctctcggctgcccgggtcccctcggcgtccaccccatcgctgcagctcagcagccattgcgcagaacagacccctctggcctccagcccgtggccacgatgaccctggctgtgcctcccacaccaggtgctgtggcgagggcctcctgctgtcccctgtctggagccgctccccaggtgaccgtgctcccttcgcccagcccttcccgccttgtcccaccttcctccacggtggtcaccttcacctggggtcccgcgtgcatcccgtggaccgactgccacatccgcactaggacgcag

SEQ ID NO: 110379 - DNA, 1335 bp, Homo sapiens
gacagggcttggccccacagctggggaggatgatgctggctcaactcccagagggacgccagctgagggaggttgttgagctgggctgcggaggggtctgcgtcggcaagcaggcctggcatgctggggagctgaggggcaaggggagcgcctttgagggcccccagcccagccagctgcatctgcagcctcccccatcctgcccctcactctggcctcttagaccaccgaccccacaaggccccctcctcagccatcagcaaagacaggctggctggtcctgctccttctttaagcaccttcccctgacctgcaccccctgccctcctccctggcaccccagcccacccccttcccttggaggggcagcctccacggccctcccggacccacaccgagggggcttctgtctggtcaccatggggaccttattaaacctcgggggcaagtctcaggccccaaattacgcccccacccgcaacgttatctggcctagctgacgtctccttcctcctgcagacaccgcacagctcccatagctctgcctctccatcagccgtcttctcacagcctcttcctggtcccctccctgctcctcttgtgtcattcccacacacacctgtcccgccgcccgctccgccttctcagggttgctgcctgaggccacatagcctctggggtcctgcccctcccctgctcagatccccactggcaaccctgtgctccagaagcctgctgaccctcaggtgtgcgcctgttccccctcaaccattctgctttgtgtccctgggtcccacaggcaaccagttagccttccagccctcactccagtgccaacggtggtgcagggcacagggtgggtgcccttaagcctagtgcagtgaccaggggcaccccagggctggggccgccgggaccatcctccctggggctaagtcaccccaagttctgggcctggatgtgctaggtgctggggagagtgggggcagagggtgccacacaggtcactcctgcctccaccgtaggggctgggggtgcagccctgagggtggccgggaggcggagatggggaagggccaggcctccagctgctgataaagcttcattaatggcctctcgctaatgagaaagccgagctgattatgacaaatcgaagggggcaggggctaagtggagacaccagagacaccctggggcaggggtgggggtggaagggtgggcagggtggaagggagaggtggttcccaggctccttgctcctccagtgcccccaccctggcccttcacctgcccaaatcaccacccacctccccacgccagctctccaaagtgcat

SEQ ID NO: 110380 - DNA, 1023 bp, Homo sapiens
gtgcagtcgtggggagtgggccctccggacactcgctgtggggacatccctggctggcttggaccctgccccattctccagctgagacccagcccgcccatcacctcgccgggcctcggcttcctcatctgtaaaatgggcctgtgcttgccctgcaccgtggcggcgtgagctccaggaggtgctgctgggccggagcctggtgcacagaagggagctcccgcgggtggtgtgctggtcgctgggaggcctcagggtgtgcgggcccggcctgccccggctgggagacttccaccttaaggtgtgaggagccctccgtggccgagttctcctccgcccccgccgccctggtgacaaatactaatgtctaaatcagcagccgcaggccgccgcctgccgtgttctttgctgaaatgtcacctgttcctatctaacgatttgcataatgcaaaccttctcactcgtaaaatacagattaagaggggaagccggagtcattctggaaccagggagccatttcaaagggaacgaggagggaggcctgggaggcgccgtgctcttaaccccgtccctgccggccctgcctgcacctccacagccggtctggcctaacacactggggccgagctggggtcaaggttgatcccatgatgctgggcgggtccaagctgtggaagggcggggcgtgctgcccagcccttcccctggtcgcacgtgtggacggctgtgtcccccatccccttgcaccttccacccatgtgtggaggggaggctggaggggccgggggccctgggctggggctgctcctggtaggtccttgggggcctttcgggctgtcctggccccaggtgttttaacgatgtggcctcaggccgaggagggaccccgagcccaagtcatgattaggggtttctccagccccccaaatctggctgggtgtgtggtctcagcaaagggggagcaggtgctgaggagagaggagatcccaggactctgctgggcacagggggcgtggccagggc

SEQ ID NO: 110381 - DNA, 1024 bp, Homo sapiens
ggactccaatgaaaggagattggaaaactaccctcaattgaaattacatttgtaaatgaggcagagttttctgttcagagtgtgaacgttacggtaaatctgctccagaaagtcgaagaggcggcagcggtgggcaggccggggacgccgcaggggcgactgggactgtgccccggctggggccagggtccacattctggagaggtgcccggcaccatgctggcccctggggacagccccaggagaggagaggggctgtggcggaagcccggagagttgggcctagtttgtcagacatcagacttcacttcccactctgtaaaatggggcgcagggcggcctccttgagggagggggtaagacagaacgaggggtgagtcagagcttagttggtctcctctctgccttccaagggtgcccccgcccctccctcccacactgcacactgttcccggcccctccctccctccagccctctgtgcatctggtagtgttccgggtcctctctgaggcaactgagcgggtacggtggggacaggggcacttcccgcaccagggtgttgggtctgaggctgtcctcgtggtaggggagggctggacccagatcacctgcctgaccacgtgcccaggacattggccaggcacactcactgggacactgcaggaggggagcacacagggagagcagaggggaccatgtgccagacgaatggacctgccccctccaggacagtggcgaacccaggggaaggtggccttgggccctggaggtcctctcccagacagaggcagggcctgtgctcagggctcagggatggccatgcggaccccgccagcagacggagcctggacgccagcagctcccgtggccacagggtgcggggtggtaggggggctactgcctgctggtctcacctcgtggactgctggccagagtggccccagcagcagcggtgaggtacccagcacctcctcaaaggcctttatgtaaatcaagtcctaattaggccatccggcgtttgtg

SEQ ID NO: 110382 - DNA, 1068 bp, Homo sapiens
cagggccgagtggggctgtggctagggtggggcgggatcagtgtcagcctgtctcctcaatgacctgtggccttggcagccccctgaactctcatccccagccccatcctccgggccacaggcttgcccatgccctgcctctgggggctgtagatgtgggtggagctgtccatagtgtggctgcactgtcttgctcgggtgggctgggcctgggcatcctgtggggacagtgactggagaaggggcacagatggcccaggtcctcctcgacctggccacagcccagagctggagagcagtgtggccggcgtgccaggtgggatcccccagggtcctccaggacgctagtcctaggccacgctgagggcaccgtgagctttgcctcttctgatcagtgggctctccagttgattcttccggggggcttgaggtgagttgaaaacccagacttccctgctatgaaacttttctgcagagagcagggtttagagaaggctctgatcttttgctatgagatgggctgacctggggaagccagtaaatgctggaaagctggtggcaagctttggacatagcacaagcaggctgtccctgcttgccagggcttggggtgtgcatggcgtgggtgtcaggccccacggggaccaggagggatgggagcagaggagggagctgccggctcagcacgttgtggggcggggaatgatggtgccagcgacgtattgatgaccagacaacagtcctaatgtagagcggccctgggtttctcagatgccttgggagacagaccaggtggttgggtgagttggtgatcgaggctgcatggggctcagtgtggacatggggtacccccggtagagtgtgaggtgtgggtagaggcaaggactcgccagacccaggaccagggctcatggacacccgggtgtgtggtgtgttggggagatgggtgggagaagggcagggctgccgtcaaatgctgtgtggtgtgtgtgtggcacacgtgctatgtgctgtgtggtgtgtgtagtgtgtgctctgtgtggtgtatgtggtgtgtgatgtgtatgt

SEQ ID NO: 110383 - DNA, 1108 bp, Homo sapiens
gtgctgcagtgatgaaaatgggggatattattgccgaattctcacgtgtcagtcacagtattgaaacttctctttcctgtcagttgcagtattctgcggaaaccctgaacaagagcggtcgtctgttccctttggagctcaacggtgagcactttaggagctgtggccggaggcctgagcagggctgggactgggctcctgggctgggagggtcctggacgcagaacatgagccggatctgcagaagcccaggaaggtgttcgtgtgccctgcactggggcgtggggtggtccctgctgccgtcctccaacggctgggcccgtggtcaagagtggtctgtgagcaggacggctcgtgtagggtgcgggcccagccaggtctctccctcctcagctggtggggcccaggggtctgctgcgccctttctggaaggtgcaaggcccaccctgtggccacgaaaagaagaggacggcgtggctggcagggcttgtagcgtcagctggagcgtgccatggcatactgggcggcccacccactgtccgtgcagtggagggtgtggctgtgcctggttcacccgcaggtgggcccttcattgatggagagcaggtgccccgagtatggaggctggctggtgttcacgggccaggtaaccctggggtcccaggtcctcccccagcgaaggtcccaggggcatctccctctgttggccctgcttacctgactgtgacacgcccagcgccctgtgtcacgcagagtgggcccgttaggaggctcaccttgctgagcgccagatgaccaaagtgaaggtgttttaccagattctttcatgagtagatggaagtagcatgtgtgaggccccagctggccagagccccaccccctgccgggcctgtggtgcgatgtcctcacctcagcctcctggggttcatcctgcacacggggtcagaccagccacctccatcctggctcagagccccgcagcgcttcctacactcctcacccagccggccgctctccctgcctacacctccacgtctcctccccacagcccccatctctctcccagtcaccccaaggtcatcccagggcctttccccagaggcaggtc

SEQ ID NO: 110384 - DNA, 1051 bp, Homo sapiens
gatggatgagtttggcttcaagaatgtgctcgtggctggtgccaagggagtgagttttctctgttgcttgttcagtccattacagatcgaactccttgttccactctttcccctttctcactactgcacttgactagtcttaaaacgaaacagaaaaggaaaagaatgtgcttccgtttcacaatatttaagaaatttaacctgaacatattgatgctgctttaaacaccctcctgtcgcctgaccttctccctcatcagagtgggtgctagaagggaagtgcacccttgcaccctgaaggtaggctgggaaacggttttgatttatttgaagctcttcaatattaccccaaaatggaaactgacattgtttagaaacagtgacttttctttaaattgggttagttagcgcaggaaaactaggtggtagttctttcagacaattgtagttttccctcgtccggcgccattgtcccgcctccttgagtcctccttgtgcgctgggtactggcagtcctgatccccttctgtggcttgatagttgattccccgtgctgtcccgtgaacttagagcttttgattctgcagctttgtccctctgttgtgttctgtgttgcgactttgagggtcacactcactgaggccttggtaattgtcccgcccctttggatgcgtccttatgtttcttagattgcacgtggggaccacagaacgtttttgttaccacttgaagtatataagagaaaatgccaaagtaattttttctttttttttttagtgcatgcatttctagttatagaggtagttgctctatagtgaggcctttctagttatagaggtagttgctcacatgcaatgatgtgcacaggaaacagaaataggaagaggctctaatccgagagagtacacatttttagctggtagataaaagaactaagaaaacaggtatttttcaccggtgcattgggaacagggaaaatgtttttctaaaaaaggaaattaaggctaggcgcggtggctcacacctgtaatcccagcactttgagaggccg

SEQ ID NO: 110385 - DNA, 1050 bp, Homo sapiens
ccactgccctccaccctgtgtgacagagtgagactctgtctcaagagaaaagaaaaccgtttttaaatgtatcagtttaaatactgtctcctgtcctgagacagccactatttgtggttttgtctaggcttttacaattctttctgtgcttataaactatgtacatggccaggcacagtgactagtgactccttcctgtaatcccagcacaatgggatgtgtgcacatctaaacgtcagtgtcttgtaaatggtacatgtggtttctctttgcagtgttattattaaaatctgtctcagttgcacgtgaagtgtacaccttgctgtgcattacatcacatgatttaccacataaggagtggggtgtaggaaggggcccctgttttcagggtgagatgaatgtcaaccgagccatgcttctgttttccaggatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgtt

SEQ ID NO: 110386 - DNA, 1024 bp, Homo sapiens
aggaatcataatttagtttgaagtctaaaatctagttggttttattagacccccaaacacagtgggcacactgccaaggagctccatgacttctgctctagtaagacagccctggatagacagatgcagctgataggttatgttctacatctagtttgcttttgtcctgctaaactccagtttagtatggtttgatacacatagttcactgatataatgcttttatttttttgggtgggggacagagatgaggtctcactatcttgcccatgctggtcttgaactcctgggttcaagtgatcctcctacctcagtttccaaagtgctggtattacaggcacaagccactgtgtcccaccagcctttgaatatttcttgacatacagtttgaaagaaaacaaagtatgtgtcatggttcagtagcattttccttttattgcagctttaccactcctgaaggccctaaaccccgttccagatgctctgactgggcaagtgcagttgaagaagatgaaatgaggaccagagttaacaaagaaatggcaaggtacacattttggaccaccttgaagtgttaatctgtggcgttttcagtaacacattaaatttgatatttgtcttagaacagtggttttcaaaggtctgggctccagaccaaaggcatcaacatttcctgggaacttgttagaaatacagattctcagacccttccctgggcctgcgaatggggtggggcctggccatcctgtgaaaagccctccaggcgggtccactctttcaagcttgaagaccactgtcctcttggtggtaatccttccaagagtggaagtaggtgcacaatggtgttactgctggattgcaggctggaggactatcagaactaactttctttttttttttttttttttgagacagtctcgctctgttgcccgggctggagtacagtgacaagatctcggctcactgcaacctctgcctcccgggttcaagcgattctcttgcctcagcctcctgagtagctgag

SEQ ID NO: 110387 - DNA, 1050 bp, Homo sapiens
gccctagccccagtcggctcgcgaggcgcgcacagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccaggtgaggccgggctgcgcggcgggcgagggagcgcgtgccccgtggggcgggggttgtgcggggccggggtgtgggagggcggaggttgtaaggcggtcccgaacctcccgtgcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagaggtgggcgcgggacccgggggtcggggcgcggtggggcccttgacgaggccgcgggctccagggacctcgtcgcgctctcgcggtgccgggatcggtcaggtcggcaccctgcgtccttttatcttggtctccgcgcggcccgtggactggggcggccgcagcaggcctgggaggcgctggaacactccggaagcctcttgccaggatgggagtcagctgaaccggcgtcagcccgagttagccagttcgagtctgtgttgtgctcccgggagaggtcagggtctctgacgagcttctcgtgaacacgtggaagtcagggacacccgagtcccgaggagaagtgagttgacagggcttacctgcttggccattttctgggttaggcagtgtgcagggagggtggagatgcgagcgaaaggagggcttgatggggtgggacggccgaggagggtctggag

SEQ ID NO: 110388 - DNA, 1035 bp, Homo sapiens
aggctggagagtgagtctctgaagcaagatggggactcagtctgaggctttctctgccaagagacacgtgtgggaggtgtgagttccagagcaatgagcacacctgtgtgggaagtggtcgtgccccttgcagcagctgtcacgtctgtgtctggacaatgtggtagtgttgccctcacactgacacaaacatgttctgcttttccagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtaagtgtgacctgtacagtgtgtggctggccaggttgccctagggcctgctttcttggtgacctctgagctgcaggacactgctggtgtggctgtaacagcttgaactaatgaataggtgctctcctcctcactccgcaacaggtgacttttcagacacctctgcgggatccacagacgcacaggattctaagtcctagcatggccagcaaacttgaggctcctttcactcaggatgacacccttggactggaaaactcacacccggtctggacacagaaagagaagtaagtgttggtgctgctggacatgctggagcttcaccctctctgtccgatggttcttgcaggaaagtgctgtcttgttctatcaggccttggctggattttttgtttgtttgtttgagatggagtctcgctctgttgcccacgctggagtgcagtggcgcgatgtccgctcactgcaagctccgccccccaggttcatgccattctcctgcctcagccttccaagtagctgggactacaggcgcctgccaccacgcccggctaatttttttgtatttttagtaaagaaggggtttcaccgtgttagccaggatggtcttgatctcctcctgacctcatgatgcgcccgccttggcctcacaaagtgctgggattac

SEQ ID NO: 110389 - DNA, 1048 bp, Homo sapiens
cgaagcaagacaatggcttgaacccgggaggcggagcttgcagcaagcagagatcacgtgactgcactccagcctgggcgacagagtgagactcttgtctcaaaaaaaaaaaaagagatctgaacatactgacttactgattctttgaagacaaacttggagttcactatatttaacacttaggacccctagtatctgccactgggctgcgggggcagctgcagggacacacacctgttgggtgcctgctggttccacccaggagcacagccagcagcctcatgcctcctgccccctggcagtcgggtgcacgtggagcaggtggccttggcctcgacagggttcccagggtcccactggaagccccacatggaactgtgcctctgggacattgctccagggacctcgggtgcgggctggccccatcctgtggggaggtcctgggagggtcagtctggcccgcctgcctgctgacttgggtgtggcctgagcaggtaaaggcgacacaggaggagaaccgggagctgaggagcaggtgtgaggagctccacgggaagaacctggaactggggtaaggaggccccgtctcctgtcctccccgtccccatccccctcgccatccttgtccccatccccctcgccatccttgtccccatccccctcgccatccctgtccccgtccccatccccacctggcctgggaccgctgggcacccgaggcaatggctgtgtgtctgttctcctcccacaggaagatcatggacaggttcgaagaggttgtgtaccaggccatgggtgagtgcccgggccaccgaggccacgtgcctccacgaggggctgcctatgccccaccctggccctgccctgcaccctgcctaggaccccaccctcctgaggccccttttcctaacacacgagtcccttcaacatgggcccggccgtggaagcactgaggcgagttgcggggaagctggtggtagtgaggctggtggctcccacggagccagggcttggcaggccccacagttgtgcagatgctgagctagca

SEQ ID NO: 110390 - DNA, 1034 bp, Homo sapiens
ctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaaaacgggagctactggctcacggctgatgccccagacagcctcgaggatctgcaggtccccagacaccaagcctgggtgctctccagcagacggcgtggtacccacagctaatgcctgccccttcctagaacgaagagtcactgaagaagtgcgtggaggattacctggcaaggatcacccaggagggccagaggtaccaagccctgaaggcccacgcggaggagaagctgcagctgtgagtgctgggcgaggccccaccctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaacactgaagccgctctggtcttgatgaag

SEQ ID NO: 110391 - DNA, 1031 bp, Homo sapiens
catgccctctctgtcccgggcccagcaaccctggggctcttctgggccagggaggtggcctctttacccccagggttcacccacaacccccaccccagatggacaggggccgcctggtgggtggtcctgcaccaggccaggcagcccgggacactgagtgggcccagggtgggggtaccttgcacacacaccgcgctggggaggcctcgaggaatcagaaacacacggccgagcagcccagtgccacgccaccagtccacaggcgctcacccgcagccaccaccagagcagacccagacagcagggacctgccgggcgctcctccctccacccgcaccatccctgctggggacgtccatctgtgtccccaccaccctgccaggctcactggctatccaggcccggaggctcctgcctgtgcacccagctctccaggttaaggtgcgcctgccaagcagggagctgctcccaggagagtgtcccctccccagcccgaacctgtggcctggaggagcttggcctccctgaggtccacacccgcagagctcaggggcctttgtcacccccaatgctggtgatgaggtgcaggccccgggacaaggccatgctgctcactcgcctctgtgtggtcagcactctggacaacccagcatgggtggggatggaggcgggccctcagcattgagggacttcctggaggtgggggctcctgagctgggccccagcgtgggagggagcatggccaggctgggccctctcctagaggaggctgggaatcctggtcagtgcccgacctgccccacctctcagctgtcgagagggtccacagtgttcccctgggaggccacacctggccggagggcagcccaagctgggcggattcaggctggatctcccccgccccaacgtgcccacggcacagctcatttccctctgcgccaggtgctggctcctctgccaggaacatgagctcatttcaccctctcaggcagggtagggcaaggcagaccccaacccacaggcgacgggcc

SEQ ID NO: 110392 - DNA, 1064 bp, Homo sapiens
ggaggggacacacggcccagctctgagaaagccccggggaggggacaagatgtggaggctcctgggaacctcatcccgccctcttcctacacaggacgggaaactgaggctggggatgggcaggggcagctctgggaagggggttgttcagaggggcctctgctcccactcgggtcatggccttcacacgcacctcggcccgcaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggtgccgccgctggggctcctgggctggccccaagggtgccccttggctgcgggttgcgtgaggatttgggtctaggggttggagcttcgggggcagaagctgtgggggtgcttgtggggccaagtctcagccaccccacacctcagggccataggcagctgcgttgggacccgtttcc

SEQ ID NO: 110393 - DNA, 1050 bp, Homo sapiens
gatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtggagtaggctgggccctgccctgagatgctgggagcagcggggagaggtggagaggcttcagccctgcctcccaccccttccccagtgcatccacagggacctggctgcccgcaatgtgctggtgaccgaggacaacgtgatgaagatcgcagacttcgggctggcccgggacgtgcacaacctcgactactacaagaagacgaccaacgtgagcccggccctggggtgcgggggtgggggtcatgccagtaggacgcctggcgccaacaccgccttcccacaccctcccagggccggctgcccgtgaagtggatggcgcctgaggccttgtttgaccgagtctacactcaccagagtgacgtgtacgtgtcctgcagagctcaggcttcaggggtggaggcgggaactgggcagagccaggaccccagctgcagtccccaggcctgtgccctggagctcctgggtgtggtttctacccctccctgggggcagcagcgcagccctggcctattcccctggtgcccgcccaggtgtctgtcctgggagtctcaggacagcctgacctcaccttcccctgcagctggtcctttggggtcctgctctgggagatcttcacgctggggggctccccgtaccccggcatccctgtggaggagctcttcaagctgctgaaggagggccac

SEQ ID NO: 110394 - DNA, 1110 bp, Homo sapiens
atatcttcactggaatcacctccaactattaacaaccttttaggcttggaggggatcctccagctccggggcaggctggacgtacattcttggccgtccctctatcggcgggataaaccttctcggttgtcaataagttaaaaattaaaactctccgccatgtggccagctaaatgctggaagtgttggggtgtgggaacaagagtgccaggggcccataaatagctttacaaatatacaggtccagttttaaaacaaaactgcggtgccagaaaaggccctggtcctctgcttgcatgggtgagaccccctggggcctccctccacgcccccccacgccccgcccagggccatgcctgcctcctgtgcccccagggtcgcaggcctccgttgtaccagccttttcctcttccatatatgttatatatatatatgtatatataccatatacacagcatctatttatagaaatgtacactagtttccggaataaaccttttgcataaaaggtaaaggctcccatcttcaggtacccgtaatttcagtctctgaggggcagggtgggaagtgggaaagcctggaggtggggaggcggtgccactaacaccccaggcacaaggtgctggacatgtggggcttccctgcaggctcagctttgggtgtgggaggggccgaggcccaccctgtgatgtcccgtggtgcaaaggcagaggccggagccatgtcgggcccagctccctgccccacgggggtcccaccgggtgggcccacttacattctgcactgggtccccccagaacaaaggcccctcggtgctgcagcaccagtcaggagaccgttgcacagcagcggggacacccagggtacctctgcacctggaggcaagatgcgcacgcacacaggcacacgcggatgtgcacacacacacacacacacgcacacacacacacacagaccaaagctctgtgtagctgtctctccatctgcactgagtctcatgccggggagtggctgtgcaccagcagcagggtgggctgctagggacccctcacattgttggggaccagtggcccttcacgtccgcgagcccccactgctgggtggggccgg

SEQ ID NO: 110395 - DNA, 1006 bp, Homo sapiens
tcttggaggccctcatctgcccagggcaccacagcccccatgatcgtgaacgtattgccaagtggccacaggcctgaggacaacagcccagcagccatggccccagaggggcagccactgaggggcagacatgcccgtggaaaccctggacctggtggtgtttctgtgtttgtgtccacgctggccctgggagctcttggcattgtatgcaggatgggatcataccttgggggtccgtgctggaggttgcctggctcacgcggagccgcctgtgtcagtgctgaccacttgcagccacaggtgtgggcagtgaggccctgtgtggcaggacgcctgcccgtggccacatgcaggctgtgcttccacagggagaacgtcatcagtgtcgctgagctcatcaacgccatgaagcaagtcaagcacattcccgaaagcaagctcaccagcctggccgcagcactggatgaaaacaaggatggcaaggtcaacatcgacgacctcgtcaaggtgggcctcgctggggaccacgcaggccatccgccacctgctctggagtggggtggggcagggggactgttcattgcatgtccggcaccctcctgggcagctaccccctcctgtcaggggtttgggtctgtcactgcgactgctcctttaagccgctgctctcatttgaaacatcagaagtgagaaattattgaagttacaactcaagtgttgagagagaaaacgcacctagtggctacgcatgtccctggaccccgcccccagctggtggcactggggagccgggggggtgcagcaaacacctctcaggggcccccgacgctgaggggcgactgcacagggagcctgggggcacttcacacctgccgggggcccccaaagctgagaggcaactacacaggggagccgcggggcagcttgggcaccgccccaaggctgagaggtgactgctgggctgagctcccaagtgcagccactcaggttccagggtagccccgga

SEQ ID NO: 110396 - DNA, 1047 bp, Homo sapiens
gactacaggtgcacaccactatacctggctaatttttgtatttttagtagagatgggatcgccatgttggccaggctggtctcgaacttctgacctcaggtgatccgcccacctcggcctcccaaagtgctgggattacaggcgtgagccaccgcgcccggcccctggggtgtttttaagtgaagagttggtgccctgttctgaggcccttggggtcctcgctgtgggggttgctgacccccaagcctctctggtgttttgtttactaacgccgtcatcgggtcacgcagcacagcaacaaacagaccttgtagaacttgagacactgtcttctctgagagctattctggtgatgagatgggcggacctgctgtggggccagcagggttggggggctgcccatctgctgaacctggccttggttgcagtggctggacctgcacctgcatcaggagatccccacatcgctgctcatcctgtcccgggccatgtacctcccggacaccctctctccagccgaccagctcaagtccacactgcagaccctcccagagattgtggtacgtgctgtcggagaccccttttacctcatctcttcataggtggctccgctcttctggggtggggggaggtgtgcaagcgcactcattcctcaaccatgggcgaggagcctgcctcccaccccctcgcgagtgcccccacccagccacctgtccccttccttccatccctcctcaccagccccttgcctgccatcccccgtgtggcacagttgccagtggtcccgacctggccacgtgttggctgctgtggatctgggccgcggcccttggagctgtgtcagcagcgcctatgctccttcccacatgtcaggagtcatcgggcgagcgcagagggcggcccaggggcctcccagcaattgcgggcagcacctcggcagtgccttctgtcctgtgtgtgtgaagcccaggtggtgacggggcaggggacacaggacacaggacagaggtgaggggcagcaggggcctctggtggcttctgggctca

SEQ ID NO: 110397 - DNA, 1012 bp, Homo sapiens
ctacctctgggactcctgtttgcttttccagttggtgtcacagtgaccttgggctgagcagaagagaggggccctttgggtatgaggtcaagatgtgtcttcagagtgtctggttccctcgccttccatccctccttcttttccatcctgggcacactttggcagatgggggactgggggatcaggagaaacagcaggtggcaggagtggccagggtggggctggttctgccatcaggacagagggttggaggtggacttctttgtctcggggttgaccgtggccgttctgcacttcccaagatcctgaccctccgtcacaggcttccagtcacttctaacctagaactgggctttggtggccgtggtttgattcttgcttggcaaaatctgttagccacttattctggagggtgttcacacagacactgtcacccaccagcaactgtcccagatgataattcactgctttgttttctagctgattgctgaggaaggggtggacagcctgaatgtcaaggagctgcaggcagcgtgtcgggcacgaggcatgcgggccctgggcgtcacggaagaccgcctgaggggtcagctgaagcaggtgcgtgaatattggcctggtgccaggccggcacgggctcaagggaaacatcagcctcgaaaggccactcggaggctcttcccaaactctgggccggcctggcgaggcgacactgtgacctctctggggacggccaggatgtttgggctgtttctcgcccttctgctcctaccgcactcacacccctgcattcgcacctttcattgccttttgaatattgctttgatttttcttgtttgcttttagttgattttaaagaccttaataacttactattttggttatctgtagtcagatgaggactggagttcacctctgagatgtcggacgtgttcacattttgactctttctgaactggggccatggaaggtttgggtggcatggcacggtctgactttggagccgcccctt

SEQ ID NO: 110398 - DNA, 1027 bp, Homo sapiens
gtttgtttgtttgtttttgttttgtttttgttttttttttgagacggagtttcgctctgtcacccaggctggagagtgcagtggtgcaatctcagctcactgtagcctccacctcctgggttcaagcgattcttgtgcctcagcctcccaagtagctgggattacaggtgtgcatgcctggctaatttttgtgtttttagtagagacggggtttcaccgtgttggccaggctggtctcaaactcctgacctcaggtgatccacccaccttggcctcccaaagtgctgggattacaggcatgagccactgtgcccggcccacacgggtactttttaaaaccatgaaataaaagagtttgagaatgtattgcacttagatgagagtcagtgtgttgtgaaatgtttctgggagtgggggtcgggcacaggcgtgagatgttttccttgcccgaaccacagtctgagcagttggaatgcagtgccctctctgcccttgcaggaggagaggctgaagaaggagcttcgggtcaagctggagctggccaagttcctccaggacaccatcgaggagatggccttgaagaacaaggcagccaagggcagcgccaccaaagacttctctgtgtttttccagaaggtgctgtgatacgtctgagtccctgtgacctcaccagggagccttccctgattttctgtttccctttcgctgtgctcagcagagtggagctcccccaggtgctggctggcgcttgaaagtttacccaggaggctcagtcgggggccagtggagtgtcaggagtctgcccccacgagctcccagtgagttaagctgtggtggctgcgcctcgtcagccttcagaattatgggcgtctgtgtctcatcaccctgcagctgtccaggagcagtagaatctgacccatgaggagcctgagaccctgatggtgtgaggtgtgggtggcttggccgggctcctctgctgggcattgccctctggctggagtcagtcaagaagatcccaggtcccagg

SEQ ID NO: 110399 - DNA, 1050 bp, Homo sapiens
ttttcctaatgattgctttgtagtatagtcttaggaaacacaagagaagccctccttatagagcaccctccaagagaaggtgtggctcagcctatcctggtgactctccaccacgctagtaatgcccagtcctcagcctgcagccctcacttgctggcccccgagcccagagtgctggccggtgtcctcggaggactcgatcgctgggagcacccagtggcccttggtgtcagcaccataccctgcttttctggaggctgctggtacctgctttggaccctgagaaagaagtgggttttgggaatggtctgctaagtggttctggaacttagagtcctcagtgggtcctgtgagtcgctgcctgaggttgtgcctataaaccattataggagaaatgctcacaccccttgcccttgttcccacatgtgctctgctcccctctgatggattccgccccttccagtttctccggatctgcgctgacctcttccgcctggtgccgttccttgtgttcgtggtggtgccgttcatggagtttctgctgcctgttgctgtgaagctcttccccaacatgttgccatccacatttgagactcagtcactcaaggtaagggcagcatcccaactgcttgttttagaatgagtctgaaattcattgtgatggcttccttgtttgtgacttttcaggtgctagatatttttgagactttatgtatcttcatattgtccttgtgctgtgcaataattatttagtggatgctgggttttggatttgtttctctttatttcgttatttatttatttatttatttatttttgaaacagggtctcgctctgtcacccaggctggagtgcagcagtgcgatcttgtctcactgcatacaacctctgcctcccgggttcaagcgaatctcctgcctcagcctcccaagtagctgggattataggcatgtgtgccaccatacacaggtctcgccctgtcacccaggctggagtgcagtggtgcgatcacggctcactgcagcctcaagttcctggacttaagtgatc

SEQ ID NO: 110400 - DNA, 1025 bp, Homo sapiens
ttttgctgctatattatggaggctaatgatcagaaagcatttttccgactccggttttactgtcttcaggtagttctctacacactgccttgtctttctaaaatacagatgtcctatgtgtccccagtcttcagggggtgactctcactgcccattggggttcaagacgagtctctcactggctttctgactctcactgcactacttgttttgccctcatctcagttactcagctcatctctttctgccatgtttttcctctgggcctttgtgtggtcaatttttgttcctttcttctgcccatgtgcccccttaccccatgtgtttgggggataggcatgctttccctcttccttccttctgccaggtctcagcttgggccccacactgaatgctgtgcctgactcctgcctgttttgggaggctcttgtcttttccatcgtcacccactcccattctcattctgttccagccacacgggcctcttgcctgctctgaagccctgcagctctgctgcctccgactagtgcccttgttccttctttgacctggaatgctgtccccaggtatctgtgtggcttacccctcaccctccttcaggtctttgtgcttctccctctcgggcaccttctctgaccactgatttaaagtactctgttgtgaccaggtactattacagtttatctgtgatcctggtgctttatgaagccaagacgagaggatcactccagcccaggagtttgaggttgcagggaaccacgattatgccactgcattccagactgggtggcagtaagactctgtcccaaaagaaaaataaaatttaaaaaaagtattatatatatacacacacacttctgagacggagtctaactctgtcacccaggctggagtgcagtggcacaatctaggctcaccacaacctctgcttcctgggttcaagcggttctcctgcctcagcctcccaagtagctgggattacgggtgtgtgccaccatgcccggctgatatatatatatatatat

SEQ ID NO: 110401 - DNA, 1048 bp, Homo sapiens
tttttttttttttttttttttttgtatttttagtagagactaggccatgttggccaggctggtctcgaactcctgacctcaagtgatctgcctgtcttggcctcccaaagtgttcggattacaggcgtaagccaccatgcctggccaaaaaaactttttttaattattctgttgctatctggcactccacatctgccttagattttctccatagcacatacctccaacattccatgtgaattcctggctgcattgggtcatctgtgaaggcagggacttttttccttttgcttggcttgctgtcatgtcctcagcacctggaatggtacctgagtgactgtcaggcattcagtgactatttgaatacatacacagccctcagtacttcgtatgccttagggggcataatatgtcccagaaatggtgtgaatgaaggggagtggtgtgagcattttgccttgatgtggagttggaaaggtggagggccatgggctggtggcagaggtcacagaagagccttatgcaccattagcagggctggagaactgtgacttaaccaatgcacaggaggcaaggctgggaaggtgtggacaggtgggagagaatgagcagaggcagcattgcccggactgggccatagcgtgagagtggtgcaggagagggtccttggtccaatccttacagatggaaagattgggtagttgctggtactgttacctctctgtgaaccaggggaagggaaagtgggcctcgcttctgacctaccttatttccttccagaaggaagctctgatctcacctacctgcctaaaaatgtgtctctggagcttcactgtttgcttagaagagaaagccctagatcttgagcatggcatgtggttcctgcctgtctttcctttatgtatctatgtgtatatatgtaaatatatacaacactttttaaaattattttattttattttattttatttttttgagacggagtctcgctctgtcacccaggctggagtgcagtggagtgatctcagctcgctgcaagctccgcctc

SEQ ID NO: 110402 - DNA, 1038 bp, Homo sapiens
gctgccacgcccggttgatttttttgtatttttagtagagacggggtttcaccgtgttagccaggatggtctcgatctcctgacctcatgatccacccgcctcggcctcccaaagtgctgggattacaggcgtgagccaccgtgcctggcttgtttttgtttttaaatagagacagggttttgccatgttgcccaggctggtcttgaattcctcgactcaagcagtccttctgcctgcacctcccaaagttctgggaatacaagtatgagccacccctctgagccctggttctaattattctctccacatttatatgtgtttagaattcctcatcacacaaagcaagtcatgaaggaaagatctaggtgcatataatagggaggttatacctgacaaggctttgggaaagacttcctgatgggatagacactagagcagggagcagagagcagaacggggattgggtgttggctccatgagggtgggggtgagtatcagatggagggaagagcctgtgcagagcttctgtgatagagcaggaagaagctggtgtggctggagcagagggtgtcaggcaagttcttttaggtcctgttaagagcaatgtgaggttttaagggtgatggtgtgacatgaatctatttgctttggaaagaagattcctcagattgctctgtagattgagttggtgctggggaaggttccggaagagtgtgtacagaagcccaatctgtggtcactctgttcaggtgaaaacctttcctttgtccctgctttgggtccctgattggattggacagccctgtctccttgaaatgtggtgtggcctgtgatttgctctggccattggaaagtgacacgtaacttctgagtggaagcgctgagacacgtgctttatcgtgttccctttctcttgtttctgactgtggaaacaaacggatatgtactatgggcaagaaagaaaactttgggctgggcttagtggctcatgcctgtaatcccagcactttgggaggccgaggcgggtggacacgagg

SEQ ID NO: 110403 - DNA, 1253 bp, Homo sapiens
taattgctttttctttcttttttcttttttttaataccatagtgttctaagaacggaagcatctgggctggatggaatttagcatcaagcagagtcccctttctgttcagagtgttgtaaagtgcataaagatgaagcaggcaccagaaatcctcggcagtgccaacgggaagactccgagctgcgaggtgaaccgcgagtgttctgtgttcctcagcaaagcccagctctccagtagcctgcaggagggggtcatgcagaagtttaacggccacgacgccctgccctttattccagccgacaagctgaaagatcttacttcccgggtgtttaatggagaacccggcgcacacgatgccaaactgcgttttgagtcccaggaaatgaaagggattgggacaccccctaacactacccctatcaaaaatggctctccagaaattaagctgaaaatcaccaaaacatacatgaatgggaagcctctctttgaatcttccatttgtggtgacagtgctgctgatgtgtctcagtcagaagaaaatggacaaaaaccagaaaacaaggcgagaaggaacaggaagaggagcataaaatatgactccttgctggagcagggccttgtcgaagcagctcttgtgtctaagatctcaagtccttcagataaaaaggtatttaggagacgttgtgtaaggggtcatgtgaccttgagcagtgagcatggccaccctatgagggcacctgcacgagtactggggcgggcggagaaggtgaggacaggcctggtacttccagccacttgcctgagccctggctttgggttggagggtgggctccaggatgccctggcactgcctcctcagttctcagctggctgctgagccagttgagaggtctagagaggtgagctaagtgttcaagattcaaatggctaaaaagaggcaaagcttgtttcttaacgtggttctgccagtttcagagcccttgcttgacaacgtcaggctacactcttttcatggatctcatctccaaggtgttctttagcctgatgtggtcagtggagacaggctgggctctagagtgtgacttcttaagtctgcaccatctgatgagtgggaagcagagctgtgcagaggtgctcccgctgtccttaccctgtggtccagtgtccacttactgtctcctcagccaggtggtccagcagatggcctgcctccctgaggcctagggatgtgtcttttgcctcctgttcttgg

SEQ ID NO: 110404 - DNA, 1017 bp, Homo sapiens
actggaagagacaaagaccacctgttgaaatacaacgttggtgatttggtgtggtccaaagtgtcgggttacccttggtggccttgcatggtttctgcagatccactccttcacagctataccaaacttaaaggtattgtgttctttgggttgtttttccaactttctcttctgcacttaatctttctcatctccaggcttctttcttactctttctaaatagccctgctatggttcatttttgcagctttacctaaagttagtgattgattcaagtgtgatgtgttgccatttctttttatattcaactcaaatatgtacttcatctgattgaattagtgttaagggacacatgacctttgccttgtataacttctgtttttatgatagtttattatttagttacgatgattgcttgtttcaggatgatttgcagcaagagtgttttatgctaagtttaagttgtaaaaatgtccaagtgaattttattaggcctatgggaagaatggaaaacactggaagtgatcatctttgtcttatgaagcttgggtagataaattgatttttacatggagcggctgatgtaacatattaagaatgtacggccgggcacggtggctcacgcctgtaatcccaacactttgggaggccgaggtgggtggatcacttgaggtcaggagttcgagactagcctgaccaacatggtcaaaccgcgtctctactaaaaatacaaaattagccggacgtggtggtgcacgcctgtaatcccagctactcaggaggctgaggcaggagaatcgctagaacccgggaggtggaggttgcagtgagccgagatcgcgccattgcactctagtctgggcaacaacagcgaaactctgtctcacaaaaaaaaaaagaatgttatatgtccctgatacagagcaaataatggttggtcaacccataaatgtgtttttagaggaatagtaaaagataatgtggtttgaggtttttctgaaagttcttctagagtga

SEQ ID NO: 110405 - DNA, 1081 bp, Homo sapiens
ctcctgggttcacaccattctcctgcctcagcctcctgtgtagctgaggctacaggcgcccaccaccatgcctggctaatttttgtatatttagtagaaatgggatttcaccgtgttagccaggatggtctcgatttcctgacctcgtggtccgcctgcctcggcctcccaaagtgctgggattacaggcttgagccactgcacccggcctgaattttattttcatagttgtattttagaatttcaaatatctctttgtttttctgtgttctcttttcatagcacacagggtttctctgttgggtatcttctcttcccttgccttatgtctgtggccctgcagagggccattcatttctgtgtgttttggattcattcatactggatgcttccctgggtccaggggttccttggtgctgggctcgtgtttaagagcacgacacttagagctgcctgcaaccatgggtggggaggcttggttatccaccctcctttgcattagagggtctgattggccattgaccacttaattgggggaatctccagaagactcactggagaggtttttcctctggagcacttcaggtcttcaggaaatatcctttgattcatctgggccagtgttctgcatgaggggacagggagtggtaactgcccccaccctgtgccagggagatccccctccctcctctcacctggcacagagatctgaccttttaacctgcttacctgtattcaccttctcatttgacttcagtggaatctggtacctcctttcttttattttgggcccgtctctttctttcctcatccccctggctgcactgtgggacgtggcttcttcctctcagctaagagtaagactagtgggcatctgtggggttactctgtggtctgagctgctctctgaggccactgatgctcctgtcactctagcactgtgagataggggggtagctagctggtaggtagcagggctgggatttgaacccaggttgtgtgatgtccgtatactgcctccttcactgcctctctcactcctttcttgcacatgtcctcttgtcttatttggtatcttttt

SEQ ID NO: 110406 - DNA, 1039 bp, Homo sapiens
gtaacagtggttagatttgtgataaatatgtgcttggatgtaaattgtggaaaactgagatttgaatgtaaaaataactgacatattagggtatcaatttaaaattaaaaaaaaaagtactgtatatctgaagagtcatcattgaggagctttggagagtccaaacataaagtgtttcaagactcacctaaagggaagtcggggcccagaagcgaaagggtctggccacatgtgcctgctgtcacctttctctttctcagatgttttcatcttgatttaggtgtttctagatctcttcatcagctatctcattaatcttgaatttgttcaacttcctcagtgttcattgcaaatactataatttagaatagcaaggatatttaggacttgtatattttctttaaaagaaaatatacctcactctatcagtacactaaatttagagacgtgttccttttaaatgactggcttatttaaaaatgagccagctcttcctgaagccagattcagcttaccctcgaagtgtaagcataaatttgattgtgttatattttgctgagtgcttagtggatagaagtgacagttgagtttctgcccacagtgtgtgtcaggtgtatgcaggttcttgggtgtcctttaatcctgactttcaggtgaccctggtgctaacaactaggatggcgcaccacatcattgtcacgcgcccatgacctcagtgttagaaatctacacagatgtctgggcacggtggctcacacctgtaatcccagcactttgggaggccaaggtgggtggatcacttgaggccaggaattcaagaccagcctggccaacatggtgaaaccccatctctactaaaaatacaaaaaaattagccaggcctggtggtgcatgcctgtaatcccagctactcgggaggctgaggcacgagaatctcttgaacccgggaggcagaggttgcagtgaggcaagatcacgccactgcactccagccttggcgccagagcaagagtcaatctccaaaaaaaaaaaaaaaaaa

SEQ ID NO: 110407 - DNA, 3004 bp, Homo sapiens
tgcagatgttttagggcctcttggctaactcagattcatgaaatggacaaacagtgcactatgttagtttatttgagcactttttatacacacgcacacagtgtctgtgtacatgtacagatatacttcagtcttgatgcagtttcatagttcttaaaatctgtctgaagaatgttgtgttctgtgtagccctcacactgtaagagttcacatggaagtaagtctgcgttggttctgaaagggcacagtgtcagttgagctgacatatactgggtggggtggaaggcgactcacacaccacacctgattcctgttgcttccagacctaggctcatggaggaagccaaagatttctttgttctcatgcatttcatggctttggtcctttaaattctggcacatttttagttacttgagtgttgaggtgagtcagaactaccattgtaatatgactcctgtgttctggacttgcagagtacatgatagcaaaataaagccatttggggctgctgcctgccatcattgtaacatgacacttagactttattatcaaacctaaattttttgccgttgccaaaaacaacaaatagccacagaacgtaggtgtgacacttttttgttcggaggtagttttggtttcctgatttttagggattaccttcatagagctttggagttttaatttcttgttatttggttctccgtgatgctgtttttctcattgtagacatgggtcctgtttttgtcatgtttatgaggagatgataactgggggcccttttggaacagggtagtgaggcaagggttggacaggccccttactcttgctgagtcagaaggcggcacttctggccaggtctctgccatggtccccaggaaggatggggtgtgcctcagttgtttccactcattagaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtttgtgatgtttccaatgctgaatgcctgttagcatatgaggcaaagtgtagtgttataaaaaacagcctgttgactgctgggcccgattctgatatgagttaggtgaccatgagaattgctgtttgaggtccacactgacacacacccattgggtcacaccccctttgcatgtttgtatttcctccctttcatcacatttgtttgaaataaggtacttttatagggttggtatttcagaacactttaggtcatgttgtagtttaaattcttcttgaaaaaggtatatgtgataaataaaaatttttattggaataattattacatggtactacatcaccctgaggaagagaataaattaaaattacacacttgcatgacaaaggcctgtgaaggaattaatgtgatttaagtgttttgtaacttcattttttattcctttagtagagcaaattcttatttttttcgccttcactggtaacagcttttgtgggagcccacaccagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggtattaataaacacatacaatgaagaaaacagataacaaattttaagaccaaggtaagataactaatcaaggccatttaatccgtcacattcatctcataatagaaacacgttcatattccagtggtcaatgtagatttcaagttgaaaggcagtccctttagttgggggctgtccagagctgcagcagggctttgcacggaaggggtggccctgttagagttgcttctcctctagtttgtaacttactggacttttgtggaaaatatcagcgtcgctaccctcagaaacaaactaacagcacacgttaggaggagtcctcatcagctgttctcattgccagtgagatatattcagtattgtagatactacactaatttccaacata

SEQ ID NO: 110408 - DNA, 1034 bp, Homo sapiens
attataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtcccggcatggaagccagtataagcatttccaaatgagggaaaagtccttggctcgtttgatccagttgagttgaaagggttgccttggcagcagaggctcctctgatggctgacatcagtcactgcgtctgggcctgagacgtgcatggagggctgtaaagccacggattcccctcgctggagaggctcctgtctgatagcggtagatgaaaaataaggtcgttatgactttggcaacttgcttcatttctttttcatttgacttacaacacacttctctaacatctagcccttttaaatttttaattaatttcaaagcttcctctggccaggtagacttttgtatacagaccaggtgagagcccttttgccttagtgtgaaaatgtaacattttatgcttttaaaatcaatagattcatcaccttagttttttaaaaaaaatctataaatagggtaattgctgaggtgtgcggtttatctttgagatgataaagctaaattatagtcttttgccagagaaactgaggtaactgtcattagaaaaggtttcttaaaatactcacaaagctgttattggcttcttaacttctaaaatttggggggtcttgcatttatttattatttatttatttatttatttagagacagagtctcaccctgttggccaggctggagtgcagtaagtggcacaatctcggctcactgcaacctccgcctccttggttccagcaattcttctgcctcagcctcccgagtagctgggactacaagcggctgccaccacacctggctatttttttttgtatttttagtagagacagggtttcgccatattggccaggctggtcttgaactcctgacctcg

SEQ ID NO: 110409 - DNA, 1099 bp, Homo sapiens
ttattgttttatgtagaatgttagaaattaccactaatttacctggcagtgatgtcaaattgactgtaattagcaggtagaaaattatttgtattatattcatctgattcctatactggatgagcaaggagcatgcttcctttgggacattcttacagcagggtgtctctccaacagcccgacaggcctcatctttttggttggatacctttgaactccatggttacgtgttaggtccacatttgtgtttttttctagcctacctatagttgttggcctttttgcatataactctcgggtaatattttgaagcatgctgaccatccaggcatatagtattttcaagaaatgactgaggtaggggtgggggtcctggtccggctgatgggggtttgctcagcactgtgccagtggaagcaggtgtattgtgggcagttttgtcattgtcctcaagtccttcgcagacagtgcacagcctgctgtctgcagtcggccagaccaggctcctccccagcacactccctgtgggatggccgctgctcaggacacagtgggacaaagttgggttgataggatattttagattcattttacctttgacaagggcaggccttgaattgggagcagcagccacctggcctcactctggccacaggtgacacttggtccttgctgccacctgcttggggctatgtggctacggctacacaaaagcctgtgcaggttagaagacgactgtggtgtgcagtggtgctctgggagtggagacttcctctgttctcagagactcacccccagccctgaccctagaatttagggatagccaggaagtttctagtttgtgtaacctagaagggtcactttaataaaaattgttatgaactatagtattttagatgatgagtgacttattttaattccactttaacattttactgtgctgttaacttggaagacctgtttgaaattagtcttgatttcacactcatttaatctgctgagcacagggctgttgtcatttgtaaacgcaaacactgtggaggtacttctcgccatcagcttccttctttacaaaaccatcatttcaacatgaaaatta

SEQ ID NO: 110410 - DNA, 1020 bp, Homo sapiens
gtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccgtacatggagggggaccggggcagccgctaccagggggtcagagggatcggaagagtcttcaaaaacggtacggagatattcagatagagagtgagacagcactctcgtgcattttcttacccctaatttctattttttaaaatttgatctttatagaaaatactggactaagcattcaatctgtttttttaaattaggaaaatgtttgcagtctggtttatttgttgagcatagaataagatacactgataacttttgtaacattggtttgtgattaatttcattaaaattctgtaaacctattattcagaaattatttttaatactaatttacagaaatgttccatggcttgcctttatgtaaaatgcagatctgaaggaagggtcctgttgtctcgaccttgtgcagcaggctcttgggggctcgctttacctttcagtgcatgaggaatcaggggtggtcaagcagacaaggtgcttggcctctgattccccagctggggtgggaggcaggagcaacg

SEQ ID NO: 110411 - DNA, 1037 bp, Homo sapiens
ggttcaagcaattctcctgcctcagtctcccaagtagctgggaccatacgcacctgccatcatgcctggctaatttttttttttttttttgtagagaatggggtttcagcatgttggccaggctggtcttgaactcctgacctcaggtgatccgcctgcctcggcctcccaaagtgcttcgattacaggcgtgagccactgcacccggcctcaggtgcatttttattttctgtctgagaacagcaagtcccaggctttgaccctggtgctttgtccttaggccatagtggaggacagggagctcccgacagaactctgccctgggcctgtcttgtagagaggtgatggctgttctctgagcactcctttgcctcacacacttggccgcatttaaaaatacctgcccactgacagttgttcatagactctagttttatgggaaccagaaactatacttaacattgaaagtttagagtgaactataaaaatatggagcttgaaaggtagttacctgtatttactaaaatctttactcctatttcattgactttttagcactgcaagaagctgaagctcgttttcgtgaaattaagcttcagagggaagcccgagaaacacaggagagcgagcgcaagcccccaccatacaagcacatcaaggtggcgtgtgggagctgcgtgcacgcgtgtggagggagtcttccccgagggccgtgagaggttcttaggcacacccaggctatggctggggagaggactgtcaccagccaggatctgtggtgcctggcatggatggccacacaagagaccatgagcaaatggcatggggggatctgcatgggggttcttggatccgccttggagtgtgaggcttggcttggtagcttagagaagggttggggtgacagtcctgaccgggctgcttggagcaggaggagctgagggatgagcctcccacctgcaccaggctgttgccaagtgctgggagtcagtcacatacggccagggctcagtgactgagccccaaacacgtagatc

SEQ ID NO: 110412 - DNA, 1018 bp, Homo sapiens
ataagcctggtgccagttccagcaacagcacaaaaggttgcttagaaacacctccccagcacccttgttcctcgcctgcctgactgctgattcacccagactcttgctttacatcctgtcagatactttgtagccattttctctgttgtggggatcaccgtgtaaagtgggttatgtagaagcttggttatcagacagcgctcctgagacaaggtcgtgtaggaagcaagggttggcatattgccacttcgtgaatacttaatacatttttcattggcaacctttacatacagatatgtctgagatcctttgaatttaatttatggagactttgtacacgccctccacggaggtatgctgatgtgtgtggtgcccgttctaagtgatcatgatggggagtcttgagccccgacactgaggattggtcagcacgctttttgtcatggccacatgcttgtgatttccagggagaatttgttaacgagtacgttggggagctgatcgacgaggaggagtgcatggcgagaatcaagcacgcacacgagaacgacatcacccacttctacatgctcactatagacaaggtaatgcggaactccactgtgagcttctgcagtgtgctggacctggagccctgatggtcacctgtagaactggactttgccctgtggcagcgccagcatttgtctccttagctgcttattttcaaacatctgcacattttcttctgaggtgcagcgtgtctttcagctgcgccggagggctagagctaaccacctctcagcacccaggcaccctgaggctctgcttgtccgggtgtgcatgcagagcgttcccagcagccttagtacagggcagggaagtagagaggacacagatgaggaagtctcagcatcttcttttgtttttaaaaagtgattgtattttattttttaattttcagtgctctttgggtaaggtctcagcatcttctctgttgtgtagcagaatcgtttttgcttggttgttgcttgtatgc

SEQ ID NO: 110413 - DNA, 1015 bp, Homo sapiens
tccctgtcctgtcctccccggcgctcactaaggctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcaggtacaagctctggggaccctgcatggggctcctggctatgggggcagagtggccatcgctgagggctgcgtggggctggactggaaaggctctgggggaggtgggtgctgatgtggagtctcttttggtttgaatatctcttttaccaagcaaaattgaaaggccatgggtcaagccagtacagatacaaaaataataagagtatttttgttgacctaatacacgccccttagcttttgaagagaaaggcaggtgtttccaatttggtgtctgtctcctcttctcccagggacggagctgacttttaactacaacctcgattgtctgggcaatgaaaaaacggtctgccggtgtggagcctccaattgcagtggattcctcggggatagaccaaaggtaaggctgtggcgccctccttccccccaggctctgtgttggcattttgcactcctggagacctgtgtcccccgtgaacagcggcttcctccaggctggcttgttgccgggacaggtgggagcaagttccctgctgtgggctggggaggatggctctcaacaaaggccagtggttaagagttcctcactgaacgtgtttcctggggctgccagaacaatgcctcacagac

SEQ ID NO: 110414 - DNA, 1150 bp, Homo sapiens
cacgatagagaaaagtgttggccatgggtgcgagagggtggtccctaacgtgacagagcttttacagagtcatgccagaaagatgaatacccaagttgaaaatcagtcccttgggagagggcaggtcacatggaaatcagcacagcagcccctgcctgtccacgccgcgctgggggacactcctgcacccggcacagctcctctcagttgccgaaacataaagagacgctaacaggtggtccttaggggcctggcaggtactgtggagtcaacaggccctgccagggagcccgcccgggctgtggtagacagtttgtctgcccgtcctgttcgctggagccagcactattttgtgttcatttgacctgacagttgtaagtcatcttcaaccacgataatgttgaagtcgtgattccatcacttctgtgtgctcacatcttgtgttctgttgcagggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatagcgccaggcggccgcttggccggatccaggggcggtgcagggcggccggccctgcctgcgggagagggcgagcatgaactggcccggaggacccagctcgagccgccaggacacagacgtacaggcctcctcgggagggagcgcctccccaccactgagccatcctcagcagcgtccgctgcgtctgcactgatgaccgtctgagcccagctcagcgttcctggacaaacagcctcactcctcagcgttaccgccacacttgaatttctccgaatgtcaaggttccctcccactctatttttttaggttaaagttaattggcatatggaatgttttaatctcctctgaaatgtgtagcgtaggcttttcccaagggtcgctagaaactcgtcttcgcgttgccccctttctggctctcagcgccg

SEQ ID NO: 110415 - DNA, 1049 bp, Homo sapiens
agtgagaacccagctgtccgtcctcaggccggcctttcttccggcgacacccgtccatggctggctgggtccccttcgcagtgtttgtctgtcttgacatctaaaccccggcgtgtgcagtgcccatcttccaggactaccttattttccagaattaaacctgttttataattcaagttaatgcaaatgactgtcagttgccaaatatcttgatcctatgagtgtagttgatgactgtttgttagtcagtagagtaaaatgctgtgtccacggggtgtcacagcctcaccataccctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagacttaaaaacttgaaattcactttttggggggagggatatactgaaatagagagttgagacttgccagttgggggaaaatagcatttaaaatggaaagctgtgtttggaaaattgtgtatgagtatttttgtattaaaaacattttaaaggcttttttcttaacttattttatatgggattgtttgattttttttccagttactttgaattgcaaagcatcgggtgtggcactgatgcctccgatgggtggggctccctgtcctgactgtgtcattttgcctttgacctgacccgctggggagaggcagtgccaccttgggaagtataacaacaaatactggaaatagcaggcataactgactgactttggaaaaatgctttcttcttctttcagaaataatttgcttcccaaattcccattaagggtgaaatggtctagagagaaggaagcactgctgtcccccagccctgcagtcggctgagccgggtggtccccaggcccacagccaagtaagtcaagggagtaccccgagggctgatcctacctgttccccaccctgtgggccagggtgtcctaggaagcccccagccctggcccaccccgtcctgatggccgcct

SEQ ID NO: 110416 - DNA, 1048 bp, Homo sapiens
cacccacgcctgcggcgcccacctcgcctctgacacccaccacacctccggctgtcgcccctaccactcagacacccccggttgccatggtggccccgcagacccaggcccctgctcagcagcagcctaagaagaacctgtccctcacggtaggtgtacactggtagggcccacaggccaccaggtaggtggtacggccctggccacctcccctagcgtgggggtgccacggtgcctgcagggggatgcaggaggtggtcctggcggggccctggcacccacacccctctccccgctgtagagagagcagatgttcgctgcccaggagatgttcaagacggccaacaaagtcacgcggcccgagaaggccctcatcctgggcttcatggccggctcccgaggtatgttcataaggcagggcctgggggtgcaccgggccgggttgggggcgggtgcccccagacacccacccagcagctcctgctctctgcagagaacccgtgccaggagcagggggacgtgatccagatcaagctgagcgagcacacggaggacctgcccaaggcggacggccagggtagcacaaccatgctggtggacacagtgtttgagatgaactatgccacgggccagtggacgcgcttcaagaagtacaagcccatgaccaatgtgtcctagaaccacctgcctcacagctggccgtcacttgtgggggtccacgggacgatggctttgccagcttaaagtaaccggatggcggacacctggcccccgaggtcccccggccgccgccctgctgctgacccagcctgttttaagttctggatgcatttctctggggtatttggggcttatttttaaaattttaatatgggttcttttttgtgtgatttaagacactttttggactcaacgttacatttttgaatgtagtaagtaaattaaccaaaaaagttacaacttcctaattttagtgacagctctgcctgttagactcttactttttaaaatcttttctattttccctcgctggggcagtgccctccta

SEQ ID NO: 110417 - DNA, 1036 bp, Homo sapiens
agactccacctggtgagatcctgtggctgggctggggtgccgctgtctttgtttggtgtcttggcaaagtgtgaggtcgtggctccaggcgttcccctgctccttgaggtccgggatcctgggggtcctgcccgctgcccgccaggggtttggcccttcccctctgcggcgctagcctagaagagggtgggacgttctgagctcggggtgggggacgtttgccggtcactgctgctggcgccctgactgttgccgtcctccagccccactcaaaggcatcccgaagcaggcgcccttcagaagccccacggcgcccagcgtcttcagccccacagggaaccggacccccatcccgccttccaggacgctgctgcggaaggaacgaggtgtgaaggtaggcccgtcccccagctcctgtggcaccccggggcccgttgcgccctggtgccgtcactaaggcagggctgtgcttgtcttggcagctgctggacatctctgagctggatatggttggcgctggccgagaggcgaagcggagaaggaagactctcggtgggggttggggcctgcgtgtcggcggcaatgggggtccctgcgggccctgcccagttggggtgggttgtgcccacgctcggcgggcagggctgtgccccgtgaggctgctctccgtgggtgggtgcctgcttttctcctcgctccttggtggcctcccctgggaagctgtttgattccctgccgctgccctgagctgacactgcagacgcgcccgggcactggcgaggactcctgttttgtccacagatgcggaggtggtggagaagccggccaaggaggaaacggtggtggagaacgccaccccggactacgcagccggcctggtgtccacgcaggtagggctcggggctgcaccccatgtctggcaccactgcgggtgccccttttgttccgattgtggccactagtgtgctctgtcggagaatatatatatgtatgtacatatgtgtgcagtctgtatttatgtatatatacgtatatg

SEQ ID NO: 110418 - DNA, 1050 bp, Homo sapiens
ggacgggaagagagaagccacagatcgggggtccttcttacgtgggggtgggatctgttaacatttcatgttctacaagtgtctggagccctccaggaatcactgtatctatgtccgcctgtggttcttggtgtccgcggtgccagaggtttccagtttacagccctctcaaggcatgcccgcctctcaggcattcctgttctgcaaatgctcctgggtgttctgctggagccgtggggagtcagtctcgaggacctcaggggacagccgaagctcccatgacctaaccctaactgaggagggtgtggggctgggcagccgccagctcctctcagccgggaggtctgcggcctgggcgcccctaacttcatgtggttcttaccggcagtgggtgagtgtgaagcgtctgccatgctgccactggagtgccagtacttgaacaaaaacgccctgacgaccctcgcgggacccctcactcccccggtgaagcattttcagttaaagcggaaacccaagagcgccacgctgcgggcggagctgctgcagaagtgtgagtggccgcggccgccatcgggcattgtctttgtagtttccagtcataggtttcttaggttctaaggtaccaagactgccccttcaaggtggcgttctgggccaggcatggtggctcacacctgttgggaggctggggcaggtgggtcgtttgagcccaggagtttgagaccagccaagaaaccccatctctaccaaaagtaccaaaacattagccgggcatggtggtgcgtgcctgtgctcccagctactcggaaggctgaggtaggaggatcacctgagcccacgaggttgaggctgcagtgagctgtgatcacaccactacactccagcctgggagagagtgagaccctgtctcaagaaaaagaagataaagttctgcataaagttttttgttagaagtttatcactatattaaactttatgttctgaaaacatgctttaaaaacttcagaatttaggctgggcatggtggctcacacctgtaaacccagcact

SEQ ID NO: 110419 - DNA, 1030 bp, Homo sapiens
ggcacctgcctgctctacgcccctcatccccaggatttcccacccgcaggctttctgcgggagcagtggtggccccggcttctcacccttcaggttttcttgcatctgcgcaccggtggaagagtaggcccagtggactgggtgctgctgggaggtgggaggctgctgggagggcaccggatgccggggccttgcaacctggcagaggctgtgctgctcagggaagcaaggtggccctggggtgaggcggggggctcagaggaaggggagccctcaggaggaagtgttgggggcaactgccagagagcccggccactgcccagtgcccatccggaagctcagcagggagtgggcttggaagtgggcaggggcatggtggcgccggcagcatcctattttgcagatgaagggcgccctaatggagatcatccagctcgccagcctcgactcggacccctgggtgctcatggtcgccgacatcttgaagtcctttccggacacaggctcgcttaacctggagctggaggagcagaatcccaacgttcaggatattttgggagaacttagagaaaagggtatgttgtgctgctttaattcatgttgggtggagggaaatggatctttcttgaaaaatttttttctgaaatgaatttgatttttagacctttacgtttttccgtgtgtcctggtccctagaatattaactgtatatgcaccatcctcccccgtaagctgctgcctggcttttgccatctttgaaaacaaactccaaacagcccacaggccccatcctcactgctgcggtgtcagtgggaggctgtgtcacgccactcgccgtctctctctggtcggctccgtgagggtaggggctctgcccattcaggtggtatctgtagatcctaggttctagggcccagagcattccctggcccagagtacatgctcagaaatgcatgttgaaaatatcaacgatttagttgtttaaatgtgaactgaaagtcacttagaaaatattcacaaggctgggctc

SEQ ID NO: 110420 - DNA, 1050 bp, Homo sapiens
ccgggctcccaagacgcgaatacgcgcgcctgctcgtgacgtcattttttgcggtcttcccgagagccagcagagggcgccgccatgatgttttacggaagccgatagtccttgctcagcggcaccccgtccttccggctctcggctttgccacaaagcttcccgaagacgcggccgctacccggagacgcggtcgccacccagaagcgctctcccgggaagccccgctcgtgggaccgcgccacctgcgccgcctctgcggcccgcagcccgacgggcgccgccatgttggggtcctagcgagggacgcgtaggtgtcttcataagatgccggggcagcggcgcgcgctttcccccaagatggcgtccatgcgggagagcgacacgggcctgtggctgcacaacaagctgggggccacggacgagctgtgggcgccgcccagcatcgcgtccctgctcacggccgcggtcatcgacaacatccgtctctgcttccatggcctctcgtcggcagtgaagctcaagttgctactcgggacgctgcacctcccgcgccgcacggtggacgaggtaaggcaggcgtggcgccccgcggcccccagattcccaaccttcccacctccgacccgcacacccaactccggaccctcctcgctccctcccccaaccttcccatcccccttcagactgttaacccccccggcccgccctcacgccccctcctcgctcctccgaatacctccctccagtcctcacctccccctgggtcctcatcccccgcctcgatcctcatctcccacctcggttctcatccccaccgtgggtcttcaggaccccccgcccctcctcgccccctgggaatcccccactagggtcctcacctccctacttttcgtcctcacccctacccaagttttcacctcccctgggatcctcaatctcctccccgccgggccccgggttctcgctacgacccccaggtcctcactcccctccctgggcccccgggtactcatccccacccgcccccgcctcccccgccttcggtcc

SEQ ID NO: 110421 - DNA, 1024 bp, Homo sapiens
tcccccgcgcggggcctggtctgcggggcagctccctgccaggatctgcccaccttggcttcagtaggccagcgtgggcagagtccttcccggcccggccatcccgagggtgtcctgccgtgtttggaagctcagagacccgccgaggctcattccaggcggtgggggtgggtggggtggctgtcttcaccgcaggaagcttggaaatagggagaagtagaaagcacccgagatgaccccggctcctccaccaggagcgcggccgggcgcggcgtccctagcgggcttcgccggggtggcgtctctggggcctggggacccccgccgcgccgctgacccgcgccctctgcccccagcgctgtgcttcgccgtgagccgctcgctgctgctgacgtgcctggtgccggccgcgctgctgggcctgcgctactactacagccgcaaggtgatccgcgcctacctggagtgcgcgctgcacacggacatggcggacatcgagcagtactacatgaagccgcccggtgagtcccgctcccgccgctccccgacctccgccccagacagccctcgggggcacgcactccagcgacctcagggcaggcctgggcgagggccggcgtgggtgggcctgagccggggcccctgtgacctgagccttctgggtgaccgaggcctccggtgtcagcggggctgggggaggcacggccggttcctcccgctgagtgacctgagctggccctgcgacgcagtggctccaccgttccctgctgtggatgcgtctccctggcgcctgctgcggtggggcaagggccgctgggctctgtgggtcccatctggtgtgccttgcggggatggggttgcctgcagtgccagggtcctggggggagagggcttgtgtggcaggggccggggaccctattggggcacagaggatggggtgggggcaggggacctgaccttgagccttggccttcacttctggcctgatcgctgggccgcttagctgaagggttttgtcccagcc

SEQ ID NO: 110422 - DNA, 1061 bp, Homo sapiens
aaccaggatggctattcacgtgaaaattccccatttaacacttttcagattggatctgtgaatgatgtttctttctccacagctgcaggacagagagaacatcttcatttctttcttagattcatttttttttcattatgaagacttgcattttaaagacagactctggaatttcattagctagcattataaatgtagtaggcccatagagatcatttttgctagaaaaaaaaagagtaccggagtaaactcttcctgagtttgctcaataagagtgaagtgagcagcacagaacaggttttcttcttccagggcatcttaagaaggccacagactagggagtgactgtcaagttcagcaatatggagggtgttggagagcttgccaagaccatcagtttctgtagagagaatcccatggtccattttatcatcaccatcatcatcatcatcatcatcatcatcatcatcatcatcatcactatttgtctgggagagtgggctcctggacagacttgtgtggaatgtttggggtagggagtcatgggtggtgagtcagagaggatgcttgaccattctgtgtacatgtgttggattcatgtcccctccctactttcagctccccctctctgccttgtgttataccagttattccctatttctgagctcacattcttgggtcttctgcgtcatagctcctctcaccaccagctcttcctgaactttcataaatatatggagctctcttgcctgatgataatccctctcctgatctcttttttcttatagatttattcctcttaattcctttgctttattttagtgggttcttggtagggagcagagagaaacagatgtgccacctttaactggatgcctgttggatggttttcagcaaggaagttttcaaattgcatggtgctgagcagagaatgggttgtaggggaaaaaaaggcagaggagactattgctgccatccagatgatggccagggaaaaatcggtagagatgataaaaaggtccagactccagcgatattaggaggtggaagtgatgaggttt

SEQ ID NO: 110423 - DNA, 1123 bp, Homo sapiens
cacaaataataataatattattattataattataattattattattattatttggagacggagtctcactctgtcgcccaggctggagtgcagtggcgcaatctgggttcactgcaacctctgcctcccgagttcaagcaatcctcctgcctcagcctccggagtatctgggactataggtgcatgccgccatgcccggctaactttttttttgtattttagtggagatggggtttcaccatgttgcccaggctggtctcgaactcctgagctcaggcaatctgcccgccttggcctcccaaagtgctaggattacaggcgtgagctactgtacccggccaatatttttataagttgttacttagctatccccacaaatgccccaatacagtggattgtaattttgaaaatgatactgacttgataatttttccctataattttaatttttacatttcaggctttaccaagttttggagggagagaataagaaaaaagaattgtttctaactcatggaaaccttgaggaagtggctgagaaattgaaacagaatatttctttagtacaagatcagttggcagtatctgctcaagaacattctttctttctgtccaaacggaataaggatgtggacatgctttgtgatactttgtatcaaggaggaaatcagcttttgcttagtgatcaggtgggtatttgccatagtagttaaaaatgctttttaaaaaaatgcttgttgtaaaagatattaaagaaaatgttaacatgaggaaaatattaccccaatttcattgccttaatataaagtatatttctatatctcctaatttttgttcacatataaatatgtttttcagatagttttgatgagtgtgcacagaaatttaaaaatgtatataatttttcagacacaaaagaatatgtaatgtttatactagtgttaaaaaataaataaaaccgcctctgtatttttttttcactcatcttagcaaacacaggattgcctttatagctttaaaatcctctgtgtacacttaatggtacatgctcctcctaatataattcctctctcatcctcaaagagtgactaccatgcttaatttgttcattattttcttgctt

SEQ ID NO: 110424 - DNA, 1036 bp, Homo sapiens
ctagaaactaattgctttattatgggtattctgcctcgtttgctccaaccagagcatagtgctaatgaagtcagaggtccaggttcagtagactgaaactgatttctttttgagaatatatggatagatgtattgcagatgtctgtctgcactcttggagagcttgttttcttggtaatataactgctagatacttgagtaaaaatgtaacttttctgaatcagaatatcagcaccaagttagtttctatagctgacaaaacatttgaatgatataggaaatccaataattacgtagaagtgctaaaatcaactggccaactaggacctattgaagtaattttaacttaagaaaaactagtaacatatacttggattcagtgaatagtgtcctattaataatgattctgattaaaagaagtataataagatctctattttggtagccgttactatatatatggtagtaatagcagtaaaatttagtaattcatacccttgacttagtccacatttttcccttttaaactgtaatttttgtttatatgaatattaaattagttttcattcattgagcttattatctggtcacctaaagtggaaagtgaaaataatcttaagatgatttcaaatttaggcatacagtttgaaatgtaattgcttttctttgtataggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattaga

SEQ ID NO: 110425 - DNA, 2034 bp, Homo sapiens
gtccagcctcgccgactccgcctcttttgacactacgcctgcgcaaacagtcatcccccacgaccacgccgtcgccttgtgcgcttgcgcgcgtccaggcgctcccgtgaggcagtgcgaggcgcgcggggcacggagggcggtggcggcgggctcctgcgagaagcaagcggaacttcctgaggtgactgacgcgggcctcggttctgggcgcaggggtgtggggctggaggagtggccgcgatccccgtctgcacccaggtgcctcttttttttcctgcgctcctgggggctccttccaggtgctccagcagctgcccggggatcagggcccggtccgctgggcgaggagctggggcgggggctgtgcggggcctgtcacccccgtcttctgcagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggtaaatatttagttgatcttcagaagatgtgccatgcttatttgcgtcttcttacgtacggagggcagggaagagaggctgcctagcctcctggtggcttgggtttgtttggatccatttattttgaattaaaaacaaatgctgctctataaagtgtaatgcattttaaaccattttatctttggaaaaaaagataaaatggatccaaatagatccactttcttgttaattacttttcgttactgttgcggttttctgagaactagcctaattgtttctgtttctctttatcatcatcaaacattgcagctacgactacctgtcatttatcccgctctcggatatcatgtgatatttgtctgtgtcttctttttaaaaacactgtcgtcatatttgtggtctaatacttgttttcttcccccctaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcagaaatcaggcaagcctattctagaaggggcggcattggatgaagctcttaaaacgtgtaaaacttctgatttgaagacacctagactggatgataaagagctggagaaattagaggatgaggttcaaactctactgaaattaaagaacctaaaaattcagcgacgtaataaatgtcaattgatggcttcagtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttg

SEQ ID NO: 110426 - DNA, 1061 bp, Homo sapiens
gacacagaggaggggtgtgtgggcagccagggtgtctctgtggactcccccaccccagtgcagggggtctctgtctctggctggccaagaggcggatgtggacagccccaagcacctacaggcctggagcttggggccctggatcacagcctacctgatgccagctgctcttggctgcaggaagggctgcgtgctgtcttgagaaaggaaggaagcccctggctgggccacccagccatccccgggaggcaggccctggacatcgctttgcccggagttgtccccttactggggactgggcagggcctgtgggacttcccctgtgggtgctctgagccaagcctgcccagccctgctcctcatccctttgtagagaggcagctccagcaggtctgaggccgttgccaaccccagggtcctggggaccgtggaggcctcgccttcttggctgctgacctcactggccccactccaggctctgatcttagtgtgttttgggggaaggtcccagccttctttcctggcccttgacagccgctgaatggcaggacccatcccaaaggccagtccagagtcttcagctgagtctctgccccacattcccccaggcacgtccaggaggtccccaggagccccctgcagcccagcctcatgtgctggtgcagcctcacacggctttcacatacctcgggaagttctgttggcaacatctagaaaacgcaggcagagggagtgggaggcacgcttgctcctgggccacccccagctccccggcagcggcagccaggctctctggttggctgggatgctggcgtggagccatgccctctcggtgccctgggtccccctctgggcatgggggtttttgggggagctgggaagtgctgcgtcagaggtggggctgctgtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttc

SEQ ID NO: 110427 - DNA, 1051 bp, Homo sapiens
catgttatctgggagggagaaggcagggactggttaggcacagggagtctggccctcggtccctgtaggatccagggtgggaaaggggactaagcccctactcgccacccctggtgctctggtgctgagctgaggcacttgttccagcagagccatccctcaccacagaggcttctgttcatggggcgtccgggcacatggggcagcccgcctggtcctggagccctggcccagcagggcatacccttgccagcagggaggagcccatgtgccgacccagctctgccctgccgaatccacaccgccaggctgcattctaccagggaggttggcaggactgccttctggaaatcatgattcagagacggcaggtgacatggccctgttctgcacacggaggttgtgagctgcagtcctggccacacacgtgccatgcaggggctccagggctggatgcccctgtcagggggagcagccacaggcttctgggcccccatgttgtgcaaaggagaggcccctgctcaggaagacccccagccaggatcggcgcccaacctgctgtggtgccacctgccatgagactgccagtgggcttggggagctgaccgactgctggaagcccccagctgtgcccagcaagtgcaggtgaccctgcatcaattgcccgcctccctcaccataccccgacggccccccttctccactagtcacccagactctgcggagtgcggccttggaggactgtgcactgtgccaggagaccctgtcatcctctgaactggcagccaagacccgcgatggggactttgaaggtgtgtgggaggctctgggtcaggacactgcactagacaccagtgggggctgtgggagccacaggagccttcctcctgggggaggggctgcaggccaccctgtccgggcatgtgggagctgggagaccgcccccccggaggctggctggaggccaggcggcttggcagtctggaaaggagggcccagggtaggttgagggtcccggcccagcccacctgctcctgccgtcgctgatgtg

SEQ ID NO: 110428 - DNA, 1061 bp, Homo sapiens
aggcccgggactggctcagagccctgttgtaccacctggtatatgtggtgagcatgttacactgaggacattttaggtgaagttacaggaaagttgtgtatctgggcaacagatacacgcctgtggggtgagcgtctgcgaggacacagacttttgtcttgaccagtgaccttcgggctccacggccccttatcatgccccaccccacacaccggtatctccttctccatgcagcagctccacagctgggtcctgctcctcagacaagatggggccagaggcggccccagcagccacgcatgctgccccacaggccacaagagagaagatccggtccaggttccacggcagccacgacctcatccaccgcctgttcgtctgcatttcaggtgtcatgtcagggcctgagaccggtgcatggcttgaggacacacgggctgcgctttaggggaggtcaggcggggcgtgtacaacctccccctcactttcctgtaaacagcagcccactctgcccctaaggagccagcactcctgttcatggagaaggctggactgaccccacacaggcaggaggaggaggggagctgcgggtgagggtgggaggcgttttcctccagggagtggcggcgggggcagtggggtgggggcagaagagccaggcgctaggcatcacctctgggcagggtccaccctgggctcccagccacgtaggctgctggggggctgtgcctgcgaggggtggacatgctttgcaggtagacacatttggatgcctgagtggctgtgacagtcacaagcactggcctgggggtgggcacagtgcaggggctctgtaagtgtccctcagcgcgtagcctggccagcttagtggtgatggctgtgacctgtgcataaaaggtgtgaatgtcagcggcagaccgactgtggcggggctgtctgtctggtcgtctcccttcccctgatctctctcgactcccgagtttttattcttgcaagggaatcctcccccaaggggttgggcctcctccctccctgactgatctgagaacacgctggcctgg

SEQ ID NO: 110429 - DNA, 1049 bp, Homo sapiens
gcttttcctgtcacagacgtgccacgatgaacagcctcgcgcgaacagcctctcctctttcttttgggtgaggccgtttttgagatgcagcatgagcttcacggccgtgtgaggcagagcaccttttccccactactggatgctttcctcaggggctcagacccagttcactggcaatggatcgtttttctccgagtttgacatgaaaccatcagaaattctttgacaggataagtgggagagtttttggtttggggcctgcacatcttttgctgctgggggtggtggggggttgtccaggtgacagccagtggacgcccaccccctccagaagctcctcccaccttcctggcgtgagctctgtgccccatgatggacacagcctcttaacgcggcctcagcttcccaggccttatgcagctcagcacagacgctgaggctcagctgaggaaagggaaggagcccaggtggtggtgtcatcttccagggaagcgtttctggcagtgctgaggatccgagaaagcaagcacatcacagggtgatcaggacagtacatgttcggttcaatttaggtcagtgcctgggcccagcactgtgcccggaggtagctggaaatcaggtcagcgggcggcagcacatggcagctgtcccatccaaggcacaggcggtgtgcaccgtgggagcatcattcattcccccactcatctgtgtctcaagcatgttccggggtggctgggccaagcaccggagacccaccaaggaacaagagacatagcctgtcctcccaggtgtcacctcacaccaatacgggggtgatagcgcagtgggggtttttaaacagacagacacaggagaccagcttcacacacacagaaagttcacccaaattcaaacagccccgtgtcaggaagcatggctggtgttaagtgacgtttgtgcgaggccggtcgtgtgcacaggtgtggctgtgtttggttacgcctcccattctgcagtgggagagactgagacggagagggtggtatttgcctcagctgagagcatctgga

SEQ ID NO: 110430 - DNA, 1002 bp, Homo sapiens
actgagaattcccatttcctcagagaagcagagcaggtgcgtgcctcggcctatggagtcaggatggtgtcatgcgagagccagggtgccgggggcctggttggggtttcacttctaaatctgggtgctattcacatgggtggattcagcttatgaaagttctgcccagctctgcaaagcgcacttcctcacaatagccatggctgtgctggaatgtcccatgtgggactcagaccacagacacacccggagcttctcgcagcagagagcagcccacagtcggcctgtaggagcctgctccaggagcttcctgctcagcatcactgaattaactgcacctttgggtctcggcctcaatgcttcttcctccaggaagccttcccggcctcagccaggtgccctgctgcaccctccttcatggcttgcattgtctttggttgcagctgtcattattgtagttcagtcattgtttgtataaatgcttgtttatcatctgcctcacccaactgcaggctaagtccacaagggcaggagcatgcctgccttcttcctcgtgtcctggtacccagctcctgctgcatagccagtgcccaatggtatttgtggaatgaaaggatgaaggtttatgtgtaaaccagcatgtattttttcactccttagagtttttattcatgcagctaacacatgcctaacaattagggctttcttcttttcagcaaaagtttccagaatcttgttttaaaaaagaaactgtactagaatcccagccggccaccttgaacaccgttgtcctggccggcgagaccggagccttgttccgtggtggaggagacgtgctggtgccttgagaattcagttgcaagcattcagtgcctggctgttgttctgctggtgcagactccagggtgctgcgtccactcctggccaaggaggctggtgtggcttttgggaccctcacccttgggttttgtcttgattcgtagggatttgctgcagacgctg

SEQ ID NO: 110431 - DNA, 1168 bp, Homo sapiens
cccaggcacctgagacatggtctggtcccaagagacccaggaggaggcacccagagaaggtcctctgggatgggtgccctcaaggagagacgggctgagacatggatgatcaaggcacactcggagcttggcagggctggacggtgcgtggagaggagtgggtgccactggaggtggcatctgggaagcttgtccttcagcaggctttgagccggactctgggggagggacagtgaggaaagccggcctcagccacatgcggccccagtcctggggaggggagcttctcggggcatggtgggcaccacaagggaggtgggtcctgtgtgggggatgaggggaggctgctttggtctcgtggcttgtggagcgttggccaggctgcaggaagggaacccgtgcgggcctcagctcgcacctccagctggttttgcttttggagaagatggttccaggtccagttctcataaagctctgcagataaatttaaccacaaatccagtttttattacttgcaagaaggtagattttggtaacaaaccttgaggctaatttatctgattgcagcactgatgtgtgcagatacacttttctgattactttatgacccctccaatgaacacaagctaatcaactgcaaaagaggatgaagtctgggtaataattctcactgcttttttctaaacttatttacaatgcaatcacacaaggcaaagcatgaggcggcggccgtgctgggacagtggcgctgcagagtcccagcgggcgtggttttcgcaggtggttaagttgggccgtccgcggcacccagggggccacagggcctgacatcctggcttttgtgtctcaaatgcagtggcctcgtggtctatgcggacggacctctgaacttggaccgcaaggtggaagacatgtccgagctgttccggcccttccacacgttgctgcggaaaataaggtggggatggagctagaggaggtgggggaggggagggggacaggagggccacaggtgggcgctgaagtcatgtttagccgccgcctccaggtcctcctcctctctgtgaggaaggatgggctggttaatattccctagggaggggtcacaaacgacccatgggggtcacagagtcctggcttttgcccctgcctgggcatcgcatggggt

SEQ ID NO: 110432 - DNA, 1039 bp, Homo sapiens
tggcttgtttgaataatttgggggctggcagggaggtgaagcacattgggttgaagggcaggtgggggcagttggtctggctgatggaatacctgtgtggaacctttcctgccagcggggccgtctgggagagcagggaactcaaggcagcctgtagggtcctgtggggctcaaggacgtgaacacagcacatggaagctcaggcctgaaatccaccgaggcaggatgcgcggggtcacctgcttagcgtctctgagctgtctggggccaaggttagagcccaggggtcaggctgctcatccacaccctgactccagacggggattccccatgcccctgccaggcggatggtcacgggggcggaggagtgagtggaccacagagagcttagtggagcttgcagctgggggggaggcggaagtggggagggggaagaggggagggggaagaggggagggggaagaggggagggggaagaggggagggggaagaggggaggcggaagtggggagggggaaggggagggggaagggggagggtccagtgggcagcggccagcaggtgtgggactgggcagagtaggggatggggagcccttgagagagatgcccgtggagatgtggatgtcagtgaagtggtcggggagtggggggtgggcacagaggccacgactggtccaggctcaggctggagagacctcactgaggccatgctgaggagccccaggggaccccggggcacaggcacacgtggcagtgcactggggttgagcatggatacccctcccgtgggaaatgggggtgcagaggtgggagcacgcggggcggtggcagtgcagtgggctagggccagcggcggggcctgcaggggacagaagtgcttaaccccaggatgcgccgaacaccccttgttggagtggggagcaatgggggctgctgccggggccagtctggacacccctgggccaggccgctcactcccctaggtcctggtgccacctcctccgggagggctccagcgtggtctctatctgctgggc

SEQ ID NO: 110433 - DNA, 1051 bp, Homo sapiens
gtctcctccaagagctccgtccactctgggttacgtggtgtggtctgagcctggtaggccgtgcacccctggaggatctgggaaagccatgaactggtgcccccaaaactatacatacaaatgaaatttcccatgtggtttttatgaggttcacaggcccccagacagccaggacctaaaagtggtttttaatggcagtaatgcccacatcaggaacaagtgttcccctccggccctgcagcatgggcagcagcaggggctggggagccgtgctgcagccccacgcaggccacatgtggcaatagcctgtcatcttcatcttcatctcccaatcaggaaactgaggcaccgagaggaaggtgcccttcaaggtggcgggaacagtctcccccaggcccccaccatgcggactccccagcctcctccccttgccgtgctcccgagcctgacctcagccccgacaccgccaccctctctattgtgccgtccccatcctgcccgcctcccctttctaggaatccctggggtgcggagtcttcatcccacgctgccccgtccctgtgtccaccctgcccaccccaccttctgagccacctggttggggtgtcctctgccgaggcttgggttagttacaggggcccgcgggcaggttctccctcctccccagcctcagtttccacctccgtggagtgggtcctggggcagtcatgagatggagcgtgttctgtgcccggctggcctggcaggggcatgcatgcacaggggtgggcacagctccttgtgtggtcctggtgccccaagctctgtgcccacctgcagcttgggcctgggcgatcagcgccgtctcattctgtcacctgggaaatggcttcttgtcctgcatcacttgatcatccctgaggggacagcaggtggattggttctatcctaaacctggcgaggccccggcctctagacaagcctccctgtgacaacaggtctaccagggcctggactcagcccctgtgccagagggcagcttggtgaaattcccagttgctgagcgcacgct

SEQ ID NO: 110434 - DNA, 1006 bp, Homo sapiens
ggggtgggcctgcccaggtgctggtgcagagcttgggtaccatgcagtggtcacactctgccactgactaatggtgctgccagcatctgctgcataattgacagatggccctggaagctgccgctaaaaataccctggccgaggttttcttcccagtacaccaagcactcagaggcatttccaacacaacggcaaacggcatgctgcaaagttttatcaagtgatgacgaggggttttcacaaagttccggaatgttcttggtgtactcttcccacagggtcttgctgaatccttgcggccatgggaggtggggcctgacacatgctcctccaacaggggggagtctatcactgtgtcaccgtggtcctgagggtcccaccctgtggggctcctgcaaagtggccaagctggctgcaccccagccctggctctgggcctggccctgctgcggtgggaactcagcagcattagggccctgtgtgtggccaggacaacttttctggccggatcaggctctgggctcttttttgggctgttcagtggcagcctccaccttccatgtgttcagatgttcccacagatgttctggcccctccagggacagcctctgtgggtggggagagtccctgcccccaggagctcaggttagaaagaccttctgcccaggggacaggtgctgggggccctggagcctggaggaggaaagtgccacggaggagaggtgctagacctgccccgtggccccaccgatgaggaagggggatcagatgctattcctcatggcaacctttggggaggggctctgttccctttacatgctctgtgacctgtgtgcttttttgttgactgacagagttgatgataaagcctggttttaagtgagtttgagaggtgggggctgccaagctaggtggccccttctcaggcttcccgctgccacaggctttaattgggatgtatcaccgtgagaactgccctgtgagaaggatctggagggggatgctc

SEQ ID NO: 110435 - DNA, 1139 bp, Homo sapiens
agccagggtccggcttctggggagcatctccttctgtgggtgggagggggtctgtttccacatcagagactacactgaggtgataaaggggccctttgccatgccccaaggggcagaggcctctagctgcgtggaactctaccctctgccattggagggttttctctggggccactgaacactccactgagctgagtagacgatggctgtggggaaggctgccagctcttccacccttcacctgcccctccgagctggctgtggcttctgctgcaagtgagagcaacttggccgggagacgggtgctgcttggtgagacagcaggtgcagggaactgatttgttggggtgtctaaaccagtcccccaatctaaagcttcccagggcactgatttaccagaccatctgggaaactgcagaggcctgggcttgcttctgagggaggcccacgtgcagctttgcataagcaggttcttatgaaacatgagcactggtaacagctgtaaaagcattttaaataaaaatttagtgaggttaaaaattccatctcagaatgtacacgtgaatgtttttggtgcgtgtagagttcacgcctatgttttttgctggaataactgggtgctgtaattctgcgtcgcactccccccagaagtctctttgagaggtggcctcctggggacatccacattcagcctcagggtccttccttcactggctgcgctgggggagctgcgctgggccacctgagttcacagtgaggccggctgtatcttgccctggcttcctacgagcaggtcacatgggtcagccttcaccttgcccttagggggcaggggccgtgctctgccacctccacccctcctgtaggtagaggggagcccccagtccccagtgtctgaacctcagggcctggaaaacaaacatgcgtgcttgtgtgctcccttttccttcagaatttattctgcaggtggtccagttggggccttctggtatcaggggtgactctcagagcttgaaaacccaaagtccagctgagggcgagctggagggcctgggagacgtcctccccgtgtagcccagctccaggcacagaacccaggcccagccagtgctggccgtcttccagcatgagtggggcga

SEQ ID NO: 110436 - DNA, 1015 bp, Homo sapiens
tttatgcagcggatgcggtgagatttcaggtgccaccagcaacctgcattccacgggccgaggagctgtgggggtctcctctggggctctgcagatgagatgggattgactggccatgatcaatatgacagcgtcctcaaaggaggggcagacgcagcctgcggccctttcacggggagctttgtgaatccaattccttccaagacaggagcaaaagatcctatttatttgcctgaatctggaaagagataaaagcttttttcttttcttgtaattccagccagggtcgattctacatggacatatttttctgcatttttgtaaattccttacagctgaggtgtgtgaagtgcgattctcattaaactcacagggccaaagctgagcctctcgactgatgccactttaaatattgggtatgggaagagctgggaggtgggagtttgacagaagaatgaagagaacgtaatgtttcctttgataacttttccttggagttacatgaagaattgggtgacagtaagaaaggatataaacaattcattgtaagctgcaaaatttagttgtatttaaataatttaatatgatttaagagtcactaggatgcagtgggatggtcctattatcgacccttaatttatttttattcactgtagaggatgaatctatccggacctgcttgcagacactggctttaaatgagttcgttcccaaattccatgcatgctaagcgtggatgaaagaagacgtaatgtaacatgattgtacttttcttttagagagtcccatctattaatactttttgtcccatttgtagttgtcatgtttgttctgataaaggatgtacttacgcattggattatgatgggctggagagtgatcactgggctctacttgtttagggagaagctcagagtctgcgggagaggagatggtgccatccagccaggctggctgtggaggggatggtttctccctcagggagctgctttattcccccaggccatattttgta

SEQ ID NO: 110437 - DNA, 1019 bp, Homo sapiens
tcgatgcagctgcgcagagtggtgcctgttcacaggatcggatcgcagacctgtgtgacacgacacccaggcccctgcctgtgaccgagcagcccgagcagctggaagcatgtgccttgttagaaaggaggcgttgatgttttaggaccttatgtgcacacagctggagccatcataacttgtggttcatgacccttctcatgcggtcaaccaccccgtgaagagaaacgcagccagcctaggggtccaggaactgtaactcaagtccatggtgagagagcccctttgccagtcagctggcaacgtgaaggagccctccaggtccaggcattggagcaggtgtggccgtgggatcgcatacgtggctgctggggtgggtgacccagctgtgccacctgcggcaggcagaatgatggcccccaaaggtgtccatgtgtgaatccctggaacccatgaatctatgaggtgtgtggcaaaggggaagtaaaggttaaagatggaactacgcctgctcgtcagttgaccttccgatcatgaaattttcctggattatgtcggtggccccagtggaaccacaggagtcctcagtagtggagaagggggcaggagagtcagaggagctgggcctgggaagaaggctgtagacgtgcaatgccgctggctctgaaggtccgggaggcggccgtgcgtcgggaagtagctgtgcaagctggaaaagggaaggaaacagactcttccctggagcctccagaaggcacgcggtcctgctgacacctgcttctagtccagagagacccaggctggaattctgtcctccagaactgtaagatgtgaatgttgtcatcttaagccgtggagtttgtagtgatttgttgcagcagccacaggaactagcacacgcctcctggggacacgcacagccagctttgctcacaacagtaaagcccggaagtccgtcccccaatccgcaggtgtggccgagtgaactgggggtgtccagttacgggaggaggggcagc

SEQ ID NO: 110438 - DNA, 1059 bp, Homo sapiens
cctgagctcgactttgacgtgggtttagcaaccaggaaaaaagcccaccttgtccctgctgcctgagaatacccagaccttagtccatggccagcatctctggtccctcggcaccctcaggcaacgtgaaggtcaccccaaatgccttgggttacattgtttccttacagtgagtttgtttgttttagtggcgcgatctcggctcactgcaagctctaacctcctgggttcacgtgattctcctgcctcagcctcccgaatagctgggattacaggcgcctgccaccacgcccggctaattttctttgtatttttagtagagatggagttccatcatgttggccaggctggtctcgagctcctgacctcaggtgatccaccctccttggcctccaaaagtgctgggattactggtgtgagccacctcgcccggccaccttacagtgagtttctaacctcgaaaatggagtcaaataacggaatgacaaggcagatagaaaccagagcattaacgtttttgtgttgcatttacaaacaatatgtgtttgctatttttcgtaattgtaaggaaatctggcatggtagagtatctgatagataaatgtaattctcatgtaaaatatctaagtatttgtgttttttgtttgtttgtttgtttgttttgagacggagtctcgctctgtcgcccaggctggagtgcagtggcgcgatctcggctcactgcaagctccgcatcccgggttcacgccattctcctgcctcagcctcccaagtagctgggactacaggcgcccgccaccacgcctggctaatttttttttttttgtattttttagtagagacggggtttcaccgtgttagccaggatggtcttgatctcctgacctcgtgatccacccgcctcggcctcccaaagtgctgggattacaggcgtgggccaccgcacccagtctttttttttttttttttttttgagacgaggtgtcactctgtcagccaggctggagtgcagtggcacaatcatgactcactcactgcagcctcgacctccccaggttt

SEQ ID NO: 110439 - DNA, 1424 bp, Homo sapiens
tctaggctctgtttactaggtgtggatgactttggggaagttccttaactttaatccttagctgcttcatgggtaaaatggggaacataacagtgcttatttccttactgggtgatgtgaggagcacatgtggtgatattaatatttaggaagcgcagtgccttgtgcagatgcagagaaggcacctctcagctgttgttagttttcttattccattggactctcacctgcatgatccagaaccctttgtagttggtgagggctactttcccatgaccgctaaggtctccattcactctgcatttctacgtccccaccacgctgggatgctctgctggaaatgctcctgtctcacctcagtgccctggtgaaatccagcctcttggtggcttatccccaagaccagccttccaaattcctttgaactctgactcctgacccttactaaacccaaaagagagagaaaaaccagatttggggtgaattgctgtatgggccagggcatggagaatgagggggctccagaaagcttcccagggaagtagtaatggtctagctgggcctgcagggatgcaggaggctggtttcagagtggtgaggggtgtgcaggccaggacagccacaaggcacatcttcagcagccgtatttggaagcctcaatatcagtgaagtgggaggagagaggcttaggaacagcctgggtgtggacatcaggtgtttccctttgctctgcaggctgatttctctgtcttcctttgtcagtagcttctcttttctaaattctaagacacgctattgatgtggcggggagaacaagcccctatatgatagatgtgcacccaaatgtaagatatttcttgagatcagaaacattcgtggatatgagaacccaggacatgtggtggatctgggactgtcgtgtggtctgaatgatcttgtgagtcctaaggtgatgtcgaggcacctcccacctctgttgaaaccaactagacaagtcttttcctagccagagcctcttccctgaatgtctgtttaaagttgaacacttaccaggtgaggtgttgctttgagaagcatttgtgctccgggctggagtgcaatggtgcagtcatggctcactgcagtcttgacctcctgggctcaggtgatcctcctgtctcagcccctggagtagctgggactacaagtgtgcaccgtcacatctggctatttttttaatgtgtttttatttttattttttgagacagagtctctctctgttggccaggctggagtgcagtggtgccatcttggctcattgcaacctccgcctcccgggttcaagtgattcttgtgccttagcctcctacgtagctgggattataggcgcacaccaccacacccggctaatttttatatttttagtagagacggggtttcgccat

SEQ ID NO: 110440 - DNA, 1004 bp, Homo sapiens
cttcccttctggttcctgaggagttggtgtggtcatgtgtggcagtcctgactcgcacctcctcccagcagttagcacggtaccttgccaaggtggcaggagccaggaagaagagtaggaggtggcataataattacaattgcaggctttgggatcaggaagtcctacatgcgacaagaatgcttacttcctaagatgaatataggattaaggatgtcattgcgtgaaatagtaagcaaataacctagggacaggaaggaccagtacattattgagctcagctttgtttcaatgatgtaagtggcagtatttatcaaattaatatctttgtttttcaggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacagtaagttttatcatctcttgaatttttaattttgtagggctaattaactaccttattccttgtagcacattagtgaaagtgagttccataatgtcacttctaagtaaccccacttcttgaaggagtatgtataggagctttctggtggttacatcagcttacttaccgacattgagctacattcgagtcataaagggcagagccctgaagacaaaaggctgagaaggaatagcttagggtttggtaatctcagaccttcacaacagttgtcagtgtcatagaaatactaaaactttttgctttttaaaattgtttgtagactgggcatggtggctcatgtgtaatctcaacacttggaggcgtgaaggtaaaaagattacttgagcctaggaccagccagggcaacataggccccatctctacaaacaaacaaaatgtagccaggcgtggtggggcgcacctgtagtcccagctacttgggaggctgaggcaggaagatt

SEQ ID NO: 110441 - DNA, 1050 bp, Homo sapiens
tgcctcagcctctggagtagctgggattacaggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaa

SEQ ID NO: 110442 - DNA, 1028 bp, Homo sapiens
aaaaagaatttgccctagattaaccgatgaagttactaagctaagcctgacttttggtccttgggccaagtgagagtggtcagcttcacctgctgggaggagcagaggtttcaggctagtccatcccaaagagaaaggcctggggctgggcatgcatggtgcgttctcccagatggggcacagaggcatagccgtgtggaagtgggatgccgtggaatagaggtatgcacatgcgcacacatacataaccccccaggtacatttgtaaaaaccatacctccccactcagagcagaattctggaagggtggttactggctttccctcctgagggaggtgttggtcctggtgctctttgcagtgtatacttcaggattgttttagtttggggtaagcctataacattagcagtcatactaaagtgtagagggatacaaccttactttcctcttaatcttaatgcttgttgaaatactttcttttgaagctggagatgaaattgtggacctcacttgtgaatctttagagcctgtggtggttgatctgactcacaatgactctgttgtggtaagtgttggagtgtgagagtcggctgtttcttgggtatgggtccctggccagtgccagcatctgacagccttggtcacagactccaagtcaaggttacagcttatgctaaagaagttcatgcatcttgtggaattgagcttttagaaagaaaataaacagtaacaataataataacaaagaagttcatgcattcagtgacgagagcccaaaatgaaaaatgtttctggaaaatcatttgttatagccttgtcgcctatggagtaggtctgtgtaacctgaccttgccacacctgggcacaaaagtggtttggggagaatctcaagacccccacatctgtcttcagtccctgattccacagtttacaccagctgtgtgaccttgggcatgtgacttagcctcattcactttccatgaaatggggacaggtcactcatgtcagcagggcatggtgtaagaca

SEQ ID NO: 110443 - DNA, 4769 bp, Homo sapiens
cccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggcagcccccagatagtaaggaaggtccccaggtcttgcagtcagcacatggtgtggctgtggctgtgttcacgctccaggagactccactaaacacccagcagggagagacacagcacatcagctgggaggtggagtgacttgggaagtgggcttgactgactgggagaggtgcacagatcctctgtgggtgggaggagggtggggcctctgctgctcaccagagggttccacagagggtgtcacacgtcagaaaaaagaaatggcttcgtttatcacttatatcaaactgattgcttctttctcttttgtttttctccttctgtttacaagattgttgacggtgagtggtttcgtttcctttttcactgggtttggagaggaaactggcataggtgagagccgcggtgctgcaggtcttgccagaccatccccaagggcttggagcgctccaagcaggaagatgccttcgcagatgctgtggtcagacccacacagccagtcccccttgtgcctgctgaagaaacttcaccactatcattgagcactgagctatagtcctttcttgtggcctaccagattttggagaaggctggtagctcacagcaggggttggggggtttctcctgggaagataagatagtggcctccagagctgggcagaaccttctgggttatagctgagcatggcagcagtttgtctctgggggtcccaggcagggaaggaagagggtcttaagaggcgtcaggatgggagtggtgaggatggtaagagtagagagcctccaacctgaaaatgtgacctcttaccttagaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggtaccaacgtgcccccagctctgctgccgccatgctaggatgtggggccagggcatgggaatacttttcagcaaatctgtgagcccttggccctggaagggcttgcccaagcctctacccagcatctggatacagttggaactgggtccagaactgagtccagctattcccactgtaaccagaggatgccaagcgctgacacagtgtgtgcagacagtcccagtggccccagacagggatcctggggctggtaggggcctgggggagggcagggtgactcaggttgtgtgcaccttctcatgttcaccctcccacatgcccttggggcagttggctttcctgaaagtctctcggatgcccgcgctaaggcagagtcaggaggccagggacgggactcttgtaggggataggggccactcacgtgacagggtataataaaatgtttgcgttgactgagaaactaacgtgaagcactgtgctcttaggccctcaggtactgtcagttgtcccatctgcatggacggatactcagaggtaagtaaaccaagctgtatcttccaggcttctggtttctaaacttcactgaaagaattggatgagacaggatcttccccctcggtgggattggacacccctactcacagtcatgcctgggccgtcacttattgcagatctgcctgtgaggggagaatgtgccagtttctccttggaccctacaactttcaccttcagcccctatactcctgtatgccctgagcttccgggtgcaaatgcgtcctccttttttgtgccccatcctggctctaactgaaagctgctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaatatcttttacacattcatttgctctttggaatcaatttcccccctttttgccaaggtgcggggttcttatctgcctcacgttgagtgtattttgcattggtgtgtgttcaggaagtttccatgtcctaaatcca

SEQ ID NO: 110444 - DNA, 1385 bp, Homo sapiens
caaatttttttttttttttcaagacagagtctcactgcgtcaccccagctggcgtacagtggggtgatcttagctcactgcaacctccgcctcctgggttcaagtgattcttttgcctcagcctcctgagtagctgggattacaggcatgtgccaccacacttgggtaatttttgtatttttagtagagacggggcttcaccatgttggtctagaactcctgaccttgtgatccacatgccttggcctcccaaagtgctgggattacaggcgtgagcaaccacgcccggccattttttgtatttttagtagagacggggtttcaccttgttggccaagctggtctcgaactcctgacctcaagtgatctatctacctgcctgggcctccaaaagtgctggaattacaggcgtgagccactgcacctggccgatattttaagcttttaaagctgtctttagtttttaagtttctttgtaagtattttaataattgttcattaaagaaactctttatggtaactggggtaaaatattcttgacacagatcacagaaagtcttaatgtaattctgaagcctctgaattgtttccccacagatggtgagctttttggagtaccttgtatggtgcaaaatggcacccaaaacagtatcaaccagaaacagtgagtggtttctggccctatggttcccagggaggctttctgagtcctggcaagcagcctctacactccgtagtcaccaggccaggaggtggataagagagaaggccgagtggaaggactgtcttgattttcaggagtggtcacagtcccactgtcctgtgtgcgggacacagcactatgtgttatacccaggaccaccttcatcgaggtggctgctgagccaaagagggtgtttctgcatgtgggtagcttcaacaaaggaggaggaccatgggagaagtaggaaaacataacttagcttatagggtctttgactcaaaacagaattcttatacacaaagcttggggaaccacaaatttgttaggctctgttccatgggcaaggtatcaaccttgcgctacctcagttttcttttcttttttttttttaaatggagtctcgctctgtcacccaggctggagtgccctggcgcaatcttggctcactgcaacctccgcctcccgggttcaagtgattctcctgcctcagcctcccaggtcgctggggctactggtgtgtgccactatgcccagcttattttttgtatttttagtagagacagggtttcatcatgttagccaggatggtctcgatctcctgacctcgtgatgtacccgcctcggcctctcaaagtgctaggattacggtgtgagccactgcatttggccactaccttgggtt

SEQ ID NO: 110445 - DNA, 1080 bp, Homo sapiens
ttcgttggtggtaaccagttctggtaaacagtctgaaaattgaggctgacagtttctagcatgtggtggaaaagtaatacagaagtcaaggtgaaggggttaattttgacaattttctaactcgtactaagataagattttctttatggcactatttaaagtattacgagtttctagaacattaggtttagttttattcaatacatttcctattttatgtttctgtatataaacatacacatgcattttagttttagaactatacatatattttaatattcttggctttgtagatgaggttttgaaaatagaattttttttttctattccagactccttttagttttggcatgaatcataggacaccaccctaccctgctggggattattgtcttctgtgcagaagtgaacggaaagactcatcattcttagagagtggaattaagactgcgagcaaattggccctttccatggctcccaagggcaacagcgtgctgcacctgccactgtgggtgtgcccggactgccgcaggaccgtggagaaggaggagaggcatggcggccttgaccagccagtggtgagtggctgccagcacaggcagcgcagggcgttggctccccccgcccaggttatggggtaactggcagtgaaagaaatggatttgcttttgcttcagggggcactccctcctgcaccaccttctagtctgtgtctcctggtacgttcctcctggtcttccctggccacactgcagtaggtggcaggacacctgccctccttgtctgggcacaattcagtcatcaagctatgtgaccctgaagggtgatttttggctttgagcttagtatttctttggtggtacagtttcttgaaaagggagtacaattttcatgtgtttagttctcaacaattcgacatgcaggtaattctttacgcgatgctcttaagcctcaccttcccttttacttatttgtgctgcttcagcctcttcgaggccacagcaggcttggctgggaagaccgcacccttactcttatctttgacctgatggagttttggtgggcccttgttccgggcag

SEQ ID NO: 110446 - DNA, 1480 bp, Homo sapiens
tgtctttgcagcccttctaaacttgccattttagaggggagatgtgctgaaatccatgtccgtgtagtcagagttctgatgcactgtgtgccttgagacatacagggagcagcacttctcataagctgaacactctgggcctgtgaagagggatgtgtgcgtggtggggggaaatggggaggggggagggaatccctctgggaattttctagtctttagcaattcactacatcttctgtttatcttttactttttcttaaccaggaaaatgaacacttgaaaaagttccaagtgacgtgggaactgcataataaacacctgtttgaaaatctggtcttttcggagccacttcttcagagcaacttgcccgcactggtgtcacagatcaggtattttgccttaacccgtatgtgtctttgtggtgtgacagcacagtcttttctcctgactggtgtgcgtgtacccgagtaccactgagtatgaaagttcttgcaggaaaaataacagggcttaaagaaaaagatagtttgggccaaaagctcaaaacctgagaagcaatacaattaaacttttaaatgataagtcaatataaatgctactaagatttaacaccacaaattcctcatacagaaaagctacagtaaatatagcacttttccttgacaagacctatccttggccgggcagctgtggtgtggttcatgctatggctcttggacatgtaggggaaatggaggagggaagaggcccaggtctgagggtgcccaaggccctccggatacagcttggtgtttcccacacattccgttgctacccgaggctctgttgctctgtctcctggtgtagcgcatccatgtggcttcttcacgcttgggaagctggctgggttctatgctttcactgagaaaaaggggtgcagagtgcagcagtcactcactgagtatttgctcggggtcagagtgagaagatttaggctgggcatgtgtttgccctgtggtaccatgttcagttagaaggcatgttcctcctgatgtgacgttactcagcagaacgctgttccctgcactgagtcatgcatgagctaccacaggtctgcagtttggtgattttgttctttggtgttttattctatttaccacatgtgagcacattcccataatacagacccatcgtgacagcagccatctacatttgaccacgttaacctatacttaggggtgtggtggctcacgcctgtaattccaacactttgggaggccttaagcaggcggatcacctgaggtcaggagtttgagaccagccttgccaacatggtaaaaccccgtctctactaaaaatataaaaattagccgggcttggtggcacatacctgtgatcctggctacttgggagtctgaggcaagagaattgcttgaaccccagaggcagaggttgcagtgagccaagagtgcaccactgcactctagcctgggtgatagag

SEQ ID NO: 110447 - DNA, 1313 bp, Homo sapiens
tgccagagtgggtccagagttccttctcctttgaaatgcagatgctcaccttgtctgttagaagttgaggtgccatttcctcaatagctccgaggccgaccccttgccctccacgtgccacttttcattcctacagctctgttctcagtaccttgcaagtaccaagcacatggcagacagggtaaaggccgggtttctgcatcaggtgtgtgctgtgagggcgcactgcagcatgtttgctgaagacaaaagcgattagggtctcctggtacccgagccctttgcagctcagcccccagcttgctgccgactccaggtctgctgcccctgtattcctggtcctgtcccgctgaggaagcagtgcccgtgaacatgatacatgtcagcagaattactgaaaaataatgagccatgtctcggggaagggtcttgcaagattaaagcattttaaaatttcctctagttaaccaataagaaagcagttactggcgagaacaacttcacagacaccatgaggcacatgttatcgtcccggctgagcatgcccgactgccccaactgcaactacaggagaaggtaaggctgggttgtggtgtcagcacgactggcccattggaccttcactgggctgagtggaggcctagaaccgacccttagagagcatggtctagtcttgtgcattggttggcttggtaactgtccttaattcctgatcagatgtgcttgcgatgactgcagtctctcacacatcctcacgtgtggtatcatggacccccccgtcactgatgacatccacattcaccagctcccacttcaagtggatcctgctcctgactatcttgctgagaggagcccgcccagtgtgtcatctgcaagctcggggtccggctccagctctcccatcacaattcagcagcaccccaggctcatcctcacagacagtggctcggcaccaactttgtaagttgtgactttgtaataaagtttccgaaatttaagtcgccccagtaatgagaaatacatacagtaatgtccacagaagtatgaacatcattattgtgcttttcatgacaagggaccctgaggtttttaatgcagcttttaaaacatgaaatcagtaaacccaaacttttaacactgtttatctgggaaaaaaaaaacatggtaaattaataaaggccagtaaagaaaaaacatgttggtatgcagagaagaagtgtctctaattccggcctcacatctcctcattctcctaaagggtgaccagtccgccgtctgtcctgtctccctgtcagcccagcactcatgcttgt

SEQ ID NO: 110448 - DNA, 1047 bp, Homo sapiens
catgactggccttaaagcaaaaaaaattagtcttctgttacataagtgcctttaaagttttgttcaactgactatttctgaaaatttcagccctaagttgaaaaagcaaacactaaacagctaaggtttaaaaagcaaacactaaacacctaaggttgccatcggtacccctttaattttaatcacaaattgtgttgtcttgggagtagcagagagactagttttataccagcgctcttcaggtcaaatggaaacgttaatcagtctggttaaatttttgtagtttccttaatatttctacttttggaggtttttctgtttgttttttgttttttactcttccaaatggcacaaatgttaatcttccaagcatttttctcatgttgaggttactaagaaatgttagtggtaggaatgatacttaactaatactctttgtaaatgaaagccgtgatctgtccaggaaatatctgtgcttagtggctggtttactcattgtctttcacaattgaatgacctcacagtgaccatctctgcttgtgtcagttgtagtgatgatgaagatgttgcaccattgtcagccaaatttgctgatatttatccattgagtaattatgatgataccgaggtggtggccaacatgaatggaatccacagcgaattgaatggtggcggggaaaacatggccctgaaggatgaggtatggacatggcttcttcgtagcaacaataaatgacataaaatgatggtctgacattttaatattttatattactctgttttgaaaagtgcaaattacaaaagattgtctttaaagtctcctcagataagcagtaccagcagtagttcctcagaagctgatgatgaagaagcggacggcgagagtagtggggagcccccaggggccccgaaggaagatggagtgctgggaagcaggagccccaggacagaggagagcaaagcagacagtccacccccatcctacccaacacagcaggtaggactttgcttgctgttttgccaaggatctctttttctgtgtgtatt

SEQ ID NO: 110449 - DNA, 1053 bp, Homo sapiens
agttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtaccagttattcttgtccaaaggtagctctaatcagtcaaaaatataatttatttcaaaccctaatttattatttaaaacattgcttttgagctggaacagaaagggaggaggacatgacatggaatgattttttccagaccacagtttttccaaacacatgtgtgttttctcccctctaggggtcactgtgaagtggggtacatgtagcccataagtgaggtttgttgtctctttgctagggagaggcgtaggtggaagattaacagacacaggtttagaatagagtgtaataagtttgccacatctattgtaattacttggcacaaccatccaaattcatgcttaaattttgttagattgaatattgctcagtttgaacttttaatgatgtcttaataatagaatgctttttaataacatttttcaggtatgtagtcagaaccaggctatcttcatggtccgcctggtt

SEQ ID NO: 110450 - DNA, 1589 bp, Homo sapiens
aaaatatgtggtggccattattatgtggaaacataagatacaattatcaaaatacttcatttgcatctggtatgaaaatgttcgtttctgtaaacaaacttgaattgtcacttaccaggtcttacaagattagtttgtgttatttgacttagtttggcttagttggatgctgttgaccacatctgtgcctaaatgcataatgcgttagcagccctgaaggggtctcctggtccaccagtgagttgtggacagcttaagaagcaaatgagctatatcagaattgcacaaatttcagtgacattggaggaagtttcttagagataatcaacagcaggattgttgggcaagaagttctgaatgtagggagcagaaggtgggtgctgaacgtggagggggccttgtgtactgtgtctgccatcacttttgcattgttggggccttggggagtttctgctgtgctggggtcacagtttttgccttttggcacattatgtcattgtagttgtaattcttataattcatattttaggctttgtgggtaaatatttagtacctaaaaagtttagcatgggtactatgaaaaatttattttctggctggttgtggtagctcacgcctgtaatcccagtgctttgggaggctgacgtgagaggattgattgagcctgggagctcaagaccagagcaacatagtaaaaccctgtctctaccaaaaaaaaaaaaaaaaaaattcttgaaattaaaaagacttgaagactaatttctgttttcaagtgtctccataccagtgacataccgaatttatatatggagtataagttatttgaaagttcaaagtattgctgagaaaaatacagtaatgaaatactacataaaataaaaactgtaagtgccagagaatttaatttccaaatatttggggatctcccaactatctttttgttactgatttctactttaattccattgtgatctaaaagcatgcagtgtataatctctggttttttgagtttattaaggtatgttttatggcccagaatttggtctgtcttggtgaatgttccgtgtgagcttcagaggaatatgtgttctgccgttgttcagtgaagtggtcttcagatgctcattatgtccaattgattgatggtgctcttgagttctgtcagtcagcaactatgttttgactgattctctgcctgctggatctgttcatttctgattgcgtgcccttgaagacttccattgattcatcggtttctccttgcacagttctatcagcttttgccctacaaagtttgatactctgttattagcggcacacacattgagaattgttacgtcgtcttggagaattgaccctttttcattatgtaatgctccttactaccactggtaacttcccttgctctaaagtctgctctgcctgaaattaatatagctcctctagctttcttttggttagtgctagcatggtatatcttccttcattgcttactttttgaaaagatttattatagtaaaatatgcactaacataaaatttacaatcttaaccatttttaagtgtagaattcagtggtattaaatacgt

SEQ ID NO: 110451 - DNA, 1792 bp, Homo sapiens
gtgccaagtagccttggtcccttgttagcttcgagggccagggtgtatctttacactccctctctgggttactttgagacttaagtaaaaccactggaaacgcatttaatacagttaaaatatgattcagttaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacctagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggc

SEQ ID NO: 110452 - DNA, 1113 bp, Homo sapiens
tctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctg

SEQ ID NO: 110453 - DNA, 1136 bp, Homo sapiens
tttttaagtaaaaagctcggtacagtggctcacacctgtagtcccagcactttaggtggccctggtgagaggattgcttgagcccaggggttcaggaccagcctggacaacatagtgagacactgtctcttagaaaaaggtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgtaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcc

SEQ ID NO: 110454 - DNA, 2096 bp, Homo sapiens
gaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggaggatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaagggaaagcgtcgttgaccatcggagggtggaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggggctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgc

SEQ ID NO: 110455 - DNA, 1050 bp, Homo sapiens
tagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgctttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattcgtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatcgtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaaacatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagcccccc

SEQ ID NO: 110456 - DNA, 1355 bp, Homo sapiens
ccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaagtctgttatagagtgtacgactgtattaacacggaggcctgcctggctacttttttaacatattgttaagtaatattaaaatcatgtctttctttttgaaagatggaatacattagtacagcaggagacctcggctgcttctttctgctgggggagtggggggatagcgggagagggcgtgtaggtgatgtgtccgccatggggagccagggcaccaccccggagcaggtcccaggtctctccaggcaacggctcacccatcctggtgcccccaccatcctctgtgtgccaggcagagcaggcagcaggagacagaaagctcccaaggagctgcatcctggttacttcttactacctagaacactcagtagctcccacttctcccagcctcatgttcagcctgtctctgtgtgccctatcagagtatgacttcactctgagtgaaggtgaatagggcagggcctggttgg

SEQ ID NO: 110457 - DNA, 1075 bp, Homo sapiens
tcaggttgaagacctcaatgccaagtggcagcgctacaacgccagcagggacgaatacgtgagggggctccatgcgcagctcagggggctgcagatcccccacgagcccgagctgatgaggaaggagatctcccggctcaacagacagttggaagagaaaataaatgactgtgccgaagtgaagcaggagctggcggcctccaggacggcccgggatgctgcgttggagcgggtgcagatgctggaacagcaggtgtctgtccctcgggctccggacggcactgaccagatgtctgctggccggtggtggccgaaatcatgggacaggctgggctgaaggcttggtggcactgagtgggcagtggtcactgtgggggtgggagaagcctggtggggcgcttcctccttccttgagcagaaatgtgtgtctcgcctctcttcagattctcgcttacaaggatgacttcatgtcagaaagggccgatcgggaacgggctcaaagtaggattcaagaactggaggaaaaggtcgcctctttgctgcaccaggtgtcctggagacaggtagagtatgagggcgtttttcttcctgcttaggtttagtgtttttgtttctcttctcatgagattagagcctttctgtgtctgccaaggccctgatttgctggtgatgagggttgtggcgagcccctccctgctgtggggagagccacctggcctggtacctgggcgtggtcatggaaagcctccctgttatactgtttagttatggaggaggctggcatggcggcctgtcttagcagaggtggctgtcctcagggcccgtccgtcactgtcatgcagtcagagagcatatctcgggcctcaaagtgtgagctccctacgtgtcctgacctgtctgtgagacgggaaccccgcttaccttgtcatgtagatgtgatggccctgggtgtccagtaacatccccagctcagcctggcacgtggagctgggccttgcagggcaggggcccctcaccccacccctgggctcagtgcttttcctaccatggggtgccttgagggaggcctggcatg

SEQ ID NO: 110458 - DNA, 1016 bp, Homo sapiens
acgagtttcaggagacttttcattcagctctgtagttgttagtgggggttggtttgggttgtggcttcggtgactcctgaccctgcgtggggcagaggttagattcctgtgtccagaatcacctggttgaacccgattgtctgcagacaggacagtgtcatgggctccaaaggaggtaagcagggtgcatggccaggcccaccctgggcagctgggggccccctcactggagatcctctggtttacaatgggattcagcttcctgccttccctgctgtctgtgataatggcaaatctctggcaatgagaagactttatcatgtctggtgtgccaatccctgcagacattatggctttagaatatttacattccaaatatttaaaagacaaacagctcaaactggtaggtgggacgggataaggacagtgtgaaaggtggtgtggcctgaagacctcccatccgggctctggcctgggccaggtggggtgggcctgggcagggagaaggtggtcccttgtccctgctttgcttctctaccaaatgaatgatcactacccgctgcactgggggacgcagtgataatctgtggcctcagcctctgggtctagctttctcccctcttgctgtatgtgacagagtgtcttctctctgtcccttcctcatgcagtcggaacacacagatgggcacacctctgtccagagtgttattgagaagttgcaggaagaaaatcgactgttaaaacagaaggtgactcacgtgagtgtctttcacatttcgtttgagaagaacacatggcttacaaactgtaagtgagggttctttccttggctgatgcccagagtcgccccccgccctctggccactaggacttgatacacacagtccctagagactggacttttttgcttaaaacgacgtacgggacatgtcctgtccatctccatccccctaaaattaatccacaagtcagtaaaggagatgcaagagttagcagcaggaggtccattttctaag

SEQ ID NO: 110459 - DNA, 1020 bp, Homo sapiens
aactcctgggctcaagagatccacccgccttggcttcccaaagtgctgggatgacaggtgtgagccaccacgccctgccaaattctattttcacaagcaagttcataattttagatttcatatcatcaaaatgtttttttgagatgagggtttcgctatatatagcccaagctggtcttaaactcctaggctcaagcaaatcctcccacctcagcctcctgaatagctgggactacaggctcaagccaccacacccagttatcatcaaattatcaaagtggcaattccaagcacttttttgatgggataggtagaaactccactgtggtgggtaaccccaaaaagatgtccacaaccaaacctcccattccccggtatctgggaatgaaaccttacttagagatagggtctttgcagatgtaattagttaaggtggggacaaaatggattaggacgggactggtgtccttgtaagcagacagaagtctggacagacacacagagagaagacgaccacgtgacaacaaagataggagtgacgtcttgtcttgtggataaaggccaaggaacaccaaggattggtggcccccacaggaagctgaagaggcgaggaagggtccttccctagaaccttgagagagagccgatgccttggtttctggcttctggcctctagaactgtgaaagattaaatttctgttgcttgaagccccccagtttgtgttactttgttacagcagctctaggaaattaacacacccaaccccaattacttcttaaagaatttaaaaaggttcttaaaatgacaattttattttgagatagggtctcgccctgtcacccaggctggagtacagtggtgccaccatggttcactgtagcctccacctcccagactcaagtgatcctcttgcctcagcaccctaagtagttggattacaagtgcatgccaccgtacctggctaatttctgtattttttgcagagacaaggtttcaccactttgcccagtctggtcctg

SEQ ID NO: 110460 - DNA, 1011 bp, Homo sapiens
gattctcattttacagatgaagaaactgaaatagacagagatgaagaaatgtgcctaaggttacgcggtttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctcatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaacctaaatatgcaaaatgttaaaatattttcttattgaaaaataaaattatagaagatagtagtctgagaa

SEQ ID NO: 110461 - DNA, 1033 bp, Homo sapiens
aattactaataatcctatcactaaaaggattacaatgaacattttgatgtatttactttttttttttttttttttttttgagacaaagtcttgctctgttgcccaggctggagtgcaatggcccaatctcggctcactgcaacctctgcctcctgggttcaagcaattctcctttctcagcctcccaagtagctgggattacaggcgcccaccaccacgcctggctaattttttacatttttagtagagatggggtttcaccatgttggccaggctggtctcgaactcctgacctcaggtgatccacctgccttcgcctcctaaagtgctgggattccaggcatgagccactgtgcccagccaatgtatttacttttaatctttttctatgtttaggtatgtatttgctgtaataaggactggttatactgcttgataacattgtcactcaaacatatatcaagagcaattttatgccatttaagtttttttagcttttcatgttgaatgcatgcgtagaattcccagtgtatttgatcagtcctctgttgattgaaacgtaggatgtttttcccttttatcaataatactggaatgaacatacaaatgaatcagtctttgagcacttccttgaatgtttccttaaaatagattcctaagagtagaattcctgttcagagttttaagcttttattgtattaaattactttctagaaaagaatgtaccagtttatattctcagcagtaatgtgtgagaatatccgtttgcctttccagcactggatgaaaacaaaaattggtctatgtgatagctacttctgaccccctgcccaaggaacagaaaataaatggtatctcagtgttttaatattttttattaggctttctgtgaagaattggaatcaatgatacaggagcaatttaagaaggggaagaaccccacaggcctattggcattacagcagattgcagattttatgaccacgaatgtaccaaatgtctacccagcagctccgcaaggagggatggctgc

SEQ ID NO: 110462 - DNA, 1054 bp, Homo sapiens
gtagaagggggttagaatttgttctgtgttatatactagaggcagtggtgacaaacacaggaaaacagatttcttctcagtgctagaaagaacgttttaatccttaagtctctccagcatctgtttatgacagtgcttcagcgcccatgacacggtgggctctcagcgagtaggtggtcatttctttcctgaatgaataaatgagggaggctggggtaagcatcctcatcactgaaactaaaacaagcagaccctgggtatgcttctgtttgggccactacagaagaaatcactatgtggcttaggaagctggactaaacaccttaagtccttttcaacaaacactcagctccaactgtccgaccctagttaggattctgggttccttaacccattagtaaatgtatttgaacttaatctttaggaagccttttgagcctatactaaaatcattataaaaactagaatgaatatttttgagggcaggtctcttcttttttactgctgtattcctagtgtctagcatatgcttgatgcatagtgtaaaccaaatctgcattgaattaattactgtgggagaaaaacatactgtggaagaggcaaaccaatgaaggcaatgaggatgtggtgttgtagagacttaagaaatggattatggtgggcacagtggctcacacctgtaagcctagcattttgagaggctgaggcgggaggattgcttgagttcaggagttcaagaccagcctgggcaacttagtgagaccccatctctaccaaaataaaaaataaaaaaatagccaggcttaatgacttgtgcctgtagtcccagctactcaggaggctgagatgtgtggatcacttgagtcaggaggttgaggctgcagtgagcatgattgcgccactgcattacagcctgggtaacagagtgagaccccatctcaaaaacaaaaataaaaaacaaaaaaaaaaacagatcaagtagtaagggtacaagttggttttaattatttttttattttttatttattttatttatttttttgagacagggtct

SEQ ID NO: 110463 - DNA, 1067 bp, Homo sapiens
gaaggcagatccagttgagcccaggagtttttgagaccagcctggccagcatggcgaaaccctgtctctatacaaaatacaataattagctggtcacagtattgtgcgcttgtagtcccagctacttgggaggctgaggtgggaggatcatttgagcctgggaggcagaagttgcagtgagccatgatcacgccactgcactccagcctgggcaacagagtgagaccctgtctcaaaaaaaaaaaaagaataatgtaagttttggttttcattattatatccctgaggagtgacacctttttgcctttgacactagtagccaccagaaagtgtgacagagtaacccagcagtaatttattgacctgtcagaaggctagtgtggaactgttttttccctctataaagtcagttatcatgaacgtgagcaagaagcacttcatatatgtgataaattagtacagtagaataatggaaagcttccagtaccccttggcttcgtgacaggcattgtgcatggacgcttccctgcatagctcactcagtgttctgaacaaacccgtgaatttgtagcctgaaagagatgcaaataatttcacttggatctttgagctaattcagtcattttccccacagaccagagtgaactccgagcaggaacacttcctcattgtcccttttgggcttctttacagtgaagtgactgcatccagtttggtaagaatgtccttctctttggcagcttgtatgtgcaggtcatgttaggtcattcaacatcttcagatcagctaaatatgtaaaacccaagaaacaagaaagagcctatgttttatgtggtgtgttcagttagagaaaaacctttgagagaagttacaaatattgtaatcttgagtttgaatagtttctagttagggtaatttgaagtcctcttgggctggggtgcagtggctcatgcctgtaattccagtacttaagttcgagaccagcctggccaacatggcggtaccccaactctacaaaaaaataccaaaattagctgggcatggtggtgggaggattgtttgaacct

SEQ ID NO: 110464 - DNA, 1295 bp, Homo sapiens
aggtgcatgccatcacatctggctaatttaaaaatattatttgtagaggcgggggtctcactttgttgcccaggctgacgtcgaacttccaggctcaagtgatccacctgccttagcctcttgagtgttgggattacaggtgtgagccaccatacctgatgggaagccttcttttgaaatgcactgagtcctcagaggagtctgtggtctgctccttgcactagatgcagtgctcattgtataattaaatccaggtttacatagcacttatatcagtgggaaaaagtctagaaagatgtggattttcttttgaggctctcccagtttaggggtagttttgtttttaagtgtgaattgttagcactggaaaccaagtttgtcttaagttcatagattgattttcaagaagaggacaaaaacatttcccttcccattttatttctgtgaggaaagcatttaccatatcatcagtcattgtgtaaccccaggttttccttcttcatggcgaccatttggtctctaggtctctgcaatgaaatgtggcctcttgccaatctccccggaggcgctttcccttggagaagtggcttatcatgactaccatggcattctggttgatgaagaggaaaaagttttgattcagaaaaatctggggcctaaaagcaaggtcagtaggcatctaatctggtatttaaattacagcagaaagaagaataaagcaaaggaccagtcttcctgcccagctccacagagcattcatgcttcccctcaggttcttattctccggaaccatgggctcgtgtcagttggagagagcgttgaggaggccttctattacatccataaccttgtggttgcctgtgagatccaggtaggggacagccattccagtcactctgcagtttatttagatgtgtctggggttcacatagatttttttttgatacttatcgagtaggagaggagtctttgagcaatctctttgccaaagataagctcatggatttgggacttgatcaggacaaatgctgtttcactgattgaagttggcaaaggattactgggcttttcatttctaatttttaaattttcaaatatgtcagtcactaccatttatggagtactggtgtgtataggcctggcatcaggtgcttagtgtgtgtcatcgcatatgtgatgtcacgtgacccccacagtactctttgaaaaagcaggtatacagaagtagagactcagagacttgcctgcagcttacagctgtgagttcccctccgctccgtcagccgttagttcac

SEQ ID NO: 110465 - DNA, 1033 bp, Homo sapiens
tttgtaggatcctgaaaggtgctgtgttttctcatttctctgccaactttggtgcccaatatttttgtcatgctaaagaaatacttctgaaagtaactttgtgatcagtctgtcactatccattctacattttttattcttacactctagagatttggtttcttttgaaacctacatttttattcaagtcatctgaccctcttgatctcagtaaggaactcaagccatgctgtgtgtgttttggaaaaggttcgaactctggccagtgcaggaggaccagacaacttagtcctgctgaatcctgagaagtacaaagccaagtcccgttccccagggtctccggtaggggaaggcactggatcgcctcccaagtggcagattggtgagcaggaatttgaagccctcatgcggatgctcgataatctggtaagaatggtgccaccacttgatgataaaccttttgttctaaaagcatcagtgttggtgttcttacagcaagtgcgattgctgtcttttatgcagtatctgaataccttcaccttcaaagtcatgaagaagcactagggttgtttaacttctgaggtaaattacaataaaatgtagaggtgaaggattcctggtattgttttattttttaaagataaccttgtgtttggactcagtggggacaagagcacagagaatgcgtaggcagctggatgaccagctgtgtcagctcagtccccaccatcccacaagcaagcgagagaggtggcacttttgaaatcggtcagtcaggtatttaggcttttgtcttaacagcaaatcctggctgtctggggcctgatgactgtgttccatgggtatccactccctgtccacagcgtgggagcccctcagctgcttattgcagggacacagagcccggcatggtccagaaggcgggcttatggggcctgcagcacacagggaaagtgagcccacactgtgataggagggcagacacacaggatgtgttctgtgttacagggttgccgtgaagaatttcattctt

SEQ ID NO: 110466 - DNA, 1439 bp, Homo sapiens
gagatctggaatattgactgtctttcactctccttggaccctagggctacagaactggctacccttatcgataccctgctctgagagagaagtctaaaaaatacagcgatgtggaggttcctgctagtgtcacaggttactcctttgctagtgacggtgattcgggcacttgctccccactcagacacagttttcagaagcagcagcgggagaagacaagatggctgaactctggccggggcgacgaagcttccgaggaagggcagaatggaagcagtcccaagtcgaagactaaggtgtggacgaacattacacacgatcacgtgaaacccttgctgcagtctctctcgtccggtgtctgcgtgccaagctgtattaccaactgcttggtctgtgcctaccttactgttcatagttagatgacgtagagcaagttgggtagctggggcttcggaggctttgggaatccagcctttctgacccaggtgtaaagcgaaccttccttattcactttcttgtagtctgaacctaagtccactgaatgcattactaaaattcggataatactatctgcttgaaactgcttaagatgtaatgtaactccgcagtagttccagtatatctccgtatatagcaaaaatatacaataatttacatgtattaacctacaaataggagctcttcttatttaattcaaattatattcagggactcttaatacttcatgcacaaaaagacacttcagtcctaaacctgtattttagtgttgtgaactccagtggtttcaagtcactaaagtttcttaagtcttcagtgttttcttaagcagttttcccttgtggctccctggcgtgttctctgctgactcttgtcccctgcccttagtgttattcccctgctttctatcccaaagcctccgaatgcacacccccagctgccctctgcatggactgttgcatgtgagtagacggccatagtggcgagtcaccttctgactcctgttgggtgcggcatgacccaagtgcagcgcaggccatctgcaggcaccagcgacagacgctgcaaggggtgcttcgtttcagcgttaatgccgctcaagttatcgtttgtcctgagaggtgctcccatgtcgtggtgctgagacctcctctgaagatgggtctttattcctcctgtaacctacctctaacagtccacccagctctgctttaaactgtatgtagaagaggcccatttccagaagcccctggaatggaggagacaggggctgaagcagactcatctgtgcatgactagttcattaggagttcagttgaaattagattagatgctcctaaaaccatgggcaaccaaatacataaagtggggctttcttttccccttgtaacagtgttttactttatagatttatttaaagaaaaaaagttttatcttcccca

SEQ ID NO: 110467 - DNA, 2838 bp, Homo sapiens
ctgtcatttactttaatgcaaaactttggtgatgcccactcttgcctcacggtgcaggctcctccctaaccctgggtagcagcatcacattgcttttcatgaccctgtcatctcatgcttccagttggctttggtgttggatgattttcagagcagtgaaccaatggtctctgaggggcctcccctgctggtcccagggttatggggctcagctctgtcgtcagcctaccttatgacccagattcagctgggctttccagatggtggttttccatcagtcatgactttgacttccagcattaactggtctttatgtggctgcatcctgctcccatggcgactctgctgagtgacccagattagatgtggtcattggttcagtcctctctgtgatgttcagtgcatgaccagatgtgagataaactgaatagattggatgctatgtcacttattgttgtcataattctgacttttcaactgttcttgatattacagtggactaaagaggatggacatagaacttccacctctgctgtccctaacctgtttgttccattgaacactaacccaaaagaggtccaggagatgaggaacaaggtgcgtcctgcgtcggcactcagcgggggcttgggtgtgggattggaagggatgccagctgctttggggggagcgggtgcttgcttctagcagagggcatctgctgttgttgccactgttgcagtgaagccatctcttcacaccgctgctgttctaccaccagtgtgaagtatgagcagcagacattttttgggccctattgattcttgaactgatgtttgctcacgatgtttgctcaccggtcagaattggaagctgcaaaacctgttcttagcaagagcagactgctgtccctttcagggttcgttcaaagacttgtgagtggcatttggtgtatcagagcaggagccctgccagtgctcacatcactagacgatggacatgcagcgagtgtttcccccaagttaatgacagtgagagataggtgtcctgcccaagcatctggaagatgtggggagctgggaatagtctccatccctgcagacccacgccccactaagcaggcatggcggtcactcagaacacatggggccatcctgcctgcgtggggcagtgggagagctgaaatgtagcttccatgtggctggggcccaagtgcacaagcagcagggctcccaggcagcatggctgctcaggactgttgatgtgtgcctctccttcccaccctcagatccgagagcagaatttacaggacattaagacggctggccctcagtcccaggttttgtgtggtgtagtgatggacaggagcctcgtccaggtgagagcccagagtgtctctgactttagtgggtggtggctgtgtgaccgcctgctccaaagttattctgaaattgagagagtgactttatgaggtaagtattctaggcaaccagttacctttgttaaaaccttcatgatgagaaacggttcaggcacttttcgttgagttctagaaggagcgagcatgctgagggctgtgtccacccctctggtcatgccccttgtaatgcatgcatatgtgagggtggcacatacaccaccagctttggggctcagattcggcccgggttcagcagcgttctgtgtaaggcgctaggagagggtgggtttagggactcttgttctggtacatattgctgtctgcaacaaagtgctgcttgggttgcagaggggtgggtgcctgtaagtgtggtgcacatttacacacatttctacaaaatgactctaccttgtggcacattgaagataattgtgtaagtagttatctctgaaaactaatatgccacctaatgctttaacacctgactctgcaggggtagacgattgttggatttgtccagccgtggtcctggtttcgtgttcagtgtctgcacgtcctgccatcatcactgccacacttactgttgacagctgtccctgctgcatgctcttagccagctccatcctgtgctctcagctgatatttcacaggctgggcctggtgtgctctggtgactcagtttactgtttcaggatgcacctctctctgactgtacggaaactatcgaagggctcgagcttacagagcagacctttagtcccgctaaatctctctcttttagaaaggtactcactgccctgtcctcactacctgtctatgcgccttgctcccctcccctcccccctccccgtctcctctcttcaggcattgtcttagttactgaagtagcttcaaatggatctttaacctgtttgtgagattgtacagaaggttctgttctacctacttgattctttaattaaaacatttgctatgaggtgtgataacaatttccagcattcgaagttgttactgagaaatggccagtctgagcaacgtggtgcatttctgcagttccgcacgggactttggtcagtgcgtgttttgggtttcagaatttgccttttccatgactctgactgcagacagcctcttctgggcagtctgttgctgttggcagcggccactcccgagtgcccttccaccctcgctggttcaactttgactgtaaatgtcatgaatgtagccactagaggtcatatcattgaaagatgtcatttcagaggaatgggaattcagacagtctttgtcagcccttgataaaatgtatttatttgtacctcaaaaaaaaaaaaaaaaaccctaaataacatttttaaatgccacagaggagaaagacttaggagagtctgaaacccctcactgtgattccctctgtgtgcgggcatctagtatgtgga

SEQ ID NO: 110468 - DNA, 1323 bp, Homo sapiens
gctggagtgtggtcgggctgtcttggcccactgcaacctccgcctcccgggctcaagcagtcctccctcctcccatctcagcctcctgagtagctgggactacaggtgcacatcaccacacctggctaaatttttgtatttttttgtagagactgggttccgccacgttgcccaggctggtctcaaactcctgagctcaagcagtccacctgactcagcctcccaaaatgctgggattatagggtgtgagccaccgcgcctggcataacctgaaataattttggctgccctctggattcaattgcaagtgaaatgaaggattagagatgaagatgtgagtctacactgcaagctattcagcccagggaaggactcttgtgttcccatgtgcacctcaccaggggctgtgttctccaacacccttcatgctgtgtggtagaaatgcagaggggcagtaagctcaccccttggactctctcagtgacctgtgttgagcacctaacctgtgcatggtccagcactgggaatgccagtccagatccaagttggccctgctcgtagatgaaaatctgatggtcagagaggtcagccgctagtgcaggttgcacagcctcgggtggagctcttgttccacccaggttgcctcagtcaagtatggaaagttactgggcctgtgttttgctttagaggcttgtcaagtgacagggaggtgaggggagtggcaggaggggaagctaggcacatcttggtttcttgtctgggttgtccatgagtggcgtatgtttctctgcatctcagtcattgctctgtgtcctttcttgcagaggaatgtgattctctgttcccataactggtcttgacagcagcttaacccttagctgtggtctgtggaggagggagctctccaccactggggacctgctgcgctgtgcctcgggcttcagctgtctcagtatgagagagccccgcttgtcctttggggcatcaaaattgggaacaagggttttgatgtctctgtgccaatggatttttatttgtatttttatttttattttgagacagcatcttactctggcccatgctggagtgcagtagtgcaatcacagctcactgcagcctcgacctctcaggccaaaagaatcctcccacctcagcctcctcagcagctgggactacaggtgcatgccaccatgcttggctaatttttaaattttttgtagagacaaggtctcactatgttgcccaggctggtctcgaactcctgggctcaagcaatccttctgccttggcctcccaaagtgctgggattataagcatgagctg

SEQ ID NO: 110469 - DNA, 1549 bp, Homo sapiens
tgccaagtttaaattattgggataaaatgccctaccacagaattaaaaccaaaataatgctcatgtgatgtcccttaaggtggtgagtgggttcaggaccctcagccacctgctcagcagggagaaggcagggagggaggggtccctactcgcacaggacagcgggggacaggccagggcataccattcgagtccatcacagaagtggctctggcagactctctttggaataagaatagaaataagttttgtatctgaagttggttaagtttctctgaaattcgcatcagtcaacacccaggtcacagcttcctttatcctctcttggagaggatcagggaaagggttgagagagccctgccttctcagagggcggccgagcgggctgccccatctgccatggaggcaggtacaggctcatggcgtggcgtccacagctcctaccatatccttcttgcttctctgcagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgccgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgtgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagtgctgtgctgccttcagcggcagcgggtacctccacgcacctaggtgccatggagcactctgggcctcaggagttcctacctccagcctttgagggtctctttggattgcttggtgggagggttttgccacactggatcagatgtaagtgcagcctcggttcagacagggtggggttctgccacctgccgtgtggggtcagattgccttggacctttgctgaagctggtccaaaggaggtgggca

SEQ ID NO: 110470 - DNA, 1035 bp, Homo sapiens
ctaggaaggcactgagaacgcaagtggccctcagatgcttcgaaatagggcagggttgaggggtgttgtctgggttgccaagccctactctgagccactcctggccttaagcgaccgcccctgcctcttggcccctgcccctgggcagatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggtaagtgcacaggctgggcctttggggtcctggtggtgacttctgggcctgggtctccctgtgcagctcgggtggtcttttccctaggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggtagggctgtggtctgggacccacaggcctaggggctggaggcttgattccatagcgatgtaaagtgcccctgtgtgccagccccagatgccagggaggctgggccgctctcttggtgttgggacccttgaggccacagtccgtgggttgccaggccagcagccgctcctgcaggctctccaatgccatccccacaggcgccctctatcgccctggggttccgtgatgcggctgatctgctcagccccctggccctgctgcgcttctcggctgtcgctcgtggccaggacccaccctctggagacagtaaggactcgaccaacccaagcgtggagcctgctctcccctgggcttccccgggcggcgcccttccctgctgtggtcgccttctcagcacgcgccacctctccccagggctcagcagcctgcgccgcctgggcctagtctacttcctctacctcttcctgttctcgggcctg

SEQ ID NO: 110471 - DNA, 1102 bp, Homo sapiens
tcccgccctccaccgtcacccccgactgactctcctgtctccctcctgcccctccactttcctttctcgtgttctgtctggtccatttgctcctctgggtgctgtgcactgcctgtctccccgacaggggcagggacttcagtctgttcccggatgtggcctgagcgcctcatcagccccatgtgtgcctagtaggccccaggaagtctgtggccagcaggcctctcaggcaggatcaggcacttggctctcaccgcgccccctgccaaagcttttcccctcccctgaggtgtccctgcccacgctgaaaccctcagtgtctggcacaacccagaaacataaaaatcggtgtgcgtctgttagagggtgaacttccacaggctcggtgccgcagagcctgctgggagcccagtaatgttcaggccatctctgtcctgtcgcacttggaattcaggttccactctggtgcaccctttcagagcgcttgggaagaactcggaactgctcgtggtgtctgctagagaggatgtggccacgtggcagcagagcagcctctccctccgctgggcgagtagactgagggccccaacttcgacagaggccaatcacatccggtatgtgaggggaccccgctttggggcctgtgccctacagcgtccccagaggcaggagaagccactcgtgctttctgatgtgctgttcttagtgaacttgccgcccggccgtttggtttgatggaggccgaaagcctttctgaggcatgttggcttgctgtccctttttcttttcattttcaaaatacatttgcttgatttcacaaatcataatttggaaccaaaaatggagccgccccatcccagctggcgctgcggttcccacagcctcccctcctgcgttaggcctgaccctgagcctgccttgcccgtggttgcatgggcccaaccctggccggccaaggtggccacactggagttttcagcctagtggaagtggggaagttcatttttgccacgttattggttttgtcagtgacaaacagaacaagttggacctcctcttgcctcctgccctcacagactgtcctgcctggctgtgggcctgg

SEQ ID NO: 110472 - DNA, 1710 bp, Homo sapiens
aaaattacctctctgtcagcagacatgtaagtaattctcattttaaatgtgaaatgtgggccaggtgcggtggctcatgcctgtaatcccagcactttgggaggcctaggcaggcggatcacctgaggtcaggagctcaagaccagcctggccaacacggtgaagccctgtctctactgaaaatacaaaaattagccgggcatggtggcgagtgcctgtaatcccagctactcagcaggctggggcaggagaatctcttgaacccaggaggcggaagtttcagtgagctgagattgcaccactgcactccagcctgggcaacagagcgagactccatctcaaaaataaatatatatacatatatataaatgttaaatgtgcagtatgttttgtgtttttgatagcccctgaatcctatgaggaactgagatctctgttgttaggaagatcgatggaagagcagcttttggtggtggagagaattcagaagtgcaaccacccgagtctcgcagaaggaaacaaagcaaaattagaagtacgtggattgagtgtgtgtggagcgctgggagtgtcagcatagccccgtatatgaatgccagaattgtgtgaagttgtgcaacggccatgtgtgcctcaggccagatggggccagcccgtcacatggttacctatgatgatggctgggagtacttggtatggcaccggcagaggcctcccttggctttggcccctctctaggcctcgtgccagacccagccagaggcaggcatggggaccttcaccttcatctcacaggggaggacactagggttcacatagccagcgtgtggcagagccagactttgctgtggcagataggtggctgtgatcgtgcctctttcagtgaatggtggatattgcctgtgaggaggacgccgtgctgcccgtgttcctcgtcgtgctttcctagtggtgtgttgtcagctgttctgtagaaggatgcgccttgcccttagctttctcccccctacaccttctagtgcttagcaagttctagcagtgtatttgcttacattttagaaggctgctcgtgtctgtcaccctgggctcccctgccccacctggttgtcaccagaatgtacgtgatccagaagctgtgtgcctgtggctttgttcttggtgctgagcactgagctttatttcccaattcatgttcctgcagaaactgtttggctttcttttggaatacgttggcgatttggctacagatgacccaccagacctcacagtcattgataagttggttgtgtaagtaaaaatggtgtgtcatctgggatgtggggttaagcagaacaatttttctcccatttagagtcataaaaatacattccagagttactaaggtaggtggaatgatggtgtcagcatgccaagtgggcaggtggtcacccagggcttgtgagcctcacagcgcaagccggcttctcacacgtgccgctccagccactgtagagctgggactgacttttaaccacaaacaagttgattttgaaacaagtgaacccctttagatttgtggctgggatggggtggctcattgtaagtttcaagctctgggtgactgagcggtatttggaaagcacggtagacaccccgcccctcacccttcagtgaaacccagttgggtggctttgcatgccagggagtgtgtacctcttgtctgcatgggga

SEQ ID NO: 110473 - DNA, 1016 bp, Homo sapiens
atcacagctggctcagctggctgttttgacataaccacatcactagcttcttcccgtgtccagtgtgtggtcaaatagtggaggccgtggagctgcttgctcttggcgtcctggctcctattctctcggtgcagggggtgatgagtcccagtcggggctggccagcagaattgggctgtgaaggcctcagaataataggcttgcctggtgactggagagtattggccacaaagtttgaacagttgattttgttaaatgaggaatgtgctgcttagctagtgtttgcatgcctgattgaaaactgcaggcagaaagcaggctggatgcaccagcctcagagctgggaggaccgtaggcccagcccgctgcccagggcaggactgcacggccccctcaccatatgttggaagagtgtgctctaagacatctcattccttcctgctcaggctgagagacttcgaagaatgcttggaaaggatgaggatgaaaatgttaagaaaccaaaacatatgtcagcagatgatctgaatgatggcttcgtgctagataaagatgacaggcgtttgctttcctacaaagtaagatgtttgccttcattttctctttctctctctttttttaatttaaaaacatttttttggtattcattttagggatttattacagttgggaattttaaatctttttaaccagtttctctaaagttctttatctgggtgtttatggtatatcagatattaaaactttagagagaagactttaacaatagtatgtgcactcacttgctcacgctctctttctcactctctctctctgtctcaaaggaacacagataaaactgattactcggttaacatcaactacttttgttaataactgtatgattctatctgcatgacctcatcatactattgagggagctaactcaaggctagagttgtgaattttctttgagtgatgtcattgagtttccatgactggtgtagtttttaattcacgaactttataaatcggta

SEQ ID NO: 110474 - DNA, 2209 bp, Homo sapiens
cagtcttcgctagaaccagcacaatcaaaaataggtgctgggtgtttccagccacttgggttacggccagttgggagtgtaatgggtctgggttttctcagagtggcttaccttgggtatttctcaagtgccattgtgcctgtggtctcaggccaggctgttgcgtgtgagcatttttttctcaaatgtggacttttccagaccactatgggggaagcactggcagagtgctacaggaaacacttcccacgccagggctgggcttcactgtggggttttctgccttttgcccccagctgagctgactgctgcccactttggaggaggcggtgggctccttcacaagaagactcaacaggaaggcgaggagcgggagaaaccgaagtcccggaaagagctgattgaagagctcattgccaagtcaaaacaagagaaggtgggttagtgagtgttcttgatcatcttctccacggtaagacaggctcaccaaaatgtgtttgagcttttttttcctgtacctttttaggctgtgtttaatattttatatgagttcagtaaaagcatttattgtgagtaggaattttaaaaatcacataaagcatatacctcggacaggttttggttcttttgcctttttttggtttatgttttgttttattttgagacgtagtctctgtttcccgggctggagtacagtggcacgatcaaagctcactgtggcctcaaactcctgggctcaaggatccagtgatcctcccacctcagctccccaagtagctagtgggcgccaccatgctcagctaattactttttgtagagatggggatcgtgctgtgtcgaccaggctcaagcagttctcccaccttggcctagttctaaagcacagggtgggccactgcacctggcgcggatgggttttttgttgttgctggttttagtatctgacatgtgcccaaaaaatcacttttttattcatttgcagtgaactgctcagagcatctaaattaatggtttatggcaggaaaagatttccgtctgatgagatttggtagctttgcatttaaaatactcatttctcctggcctcttttctgtgttgaaacgtttggtgccaactgagtgatcactgtgtgtgtccttggcactgacattgggcctctgggttgaagtccagtagtaacggtatgtggtgtgtgtctgttattttttccccagagggagagacaagctcaacgagaagatgccctcgagctcacggagaagctagaccaagactggaaagaaattcagactctcctgtcccacaaaactcccaagtcagagaacagagacaaaaaggaaaaacccaaggtgggagccaagtactgaaacaaactcttcactcactgagcttgggtgaccgactttctccagagaaagggctggggctggacggctcttctacctgtctcctttagggcaagtttctgttgaacattgatactgaattacctgctgtgtgtaatcttggggtggaagtagattcagttacttgagtctctattgcaggtgaattaaactgaaaaaagtggtgtttctggatggaagaagtacttcagggtggacacgttagaataggtgtctgaacttccctgtgacatgtttgtctgttgatacataatacatacatttaatatacatttacttatttttgcctctgtaaacagttgtttcctactgcattctctttagtcgaaactattggaaaatgctgcatttgtttaagaaactgcgttctcagagaagtctagatcccagcagattagtgtcatgtggtcatctgtgcatctttgtcagtcagccttgatgttaccgttactttacttagtttcccacgtttagggcgtaatgcctggataagtagcgtttttgttgttgtttgagacggagtctcgctctgtcacccaggctggagtgtagtgcaacctccacctcactgcaacctccacctcctgggttcaagtgattctcttgcctcagcctcccgggtagctgggattacaggcgcgtgccaccatgcttgactaatttttgtatttttagtaaagacagggtttcaccatgttgggccaggctgatctcaaactcctgacctcacgtgatctgcccaccttggcctcccaaagtgctgggattacaggcgtgagccactgcacctggcctgttttcgt

SEQ ID NO: 110475 - DNA, 2498 bp, Homo sapiens
taaactgtgacctcgctaacttgtttattgccttgtgtctagtatgaactcacaactacacatttcttaggagtacctttgatgggaaatagtaccctcctccatgacggaaggagtctaaacccatttccacttttccaaatgtgcacgttttaaaccttaaggcagctgttacagccgagggagccattcatgccttgagcttgactagtgtgttcttttttacccttccttttggcaccggtagactctaaagaagaaaagaaagtgattgccccattatccttgaaagttgttttgctcttctcaaaattctgtgattagtagagaaagcctatcgtgcatgaaagcagattgggtgtgaactttgacatcactgtgcatagccctgaactttaaagtatgcactgttctgatgtcccctgtagtggaaatcacaagaattttttgtgagattgtttctgacctgttttccagcgtacacagactttactaaaagagtacaaagaaagggataaatccaatgtattcagagataaacgcttcggagaatacaacagcaacatgagccccgaggagaagatgatgaagaggtttgctctggaacagcaggtatggaaagaaactggaggagggtttttgctgtacatttcacagggaagtcaaggccaaggagaaggctgactctgcatgttttgcatgttcctgggcactcggaaggtccaggggatagccctcgaatcctgtgccttatctggctaggccaaaggagaagcaacctcttctgcaaatgttagctgaatggataaatgccttaactctactacacggcagcagtgtgcacaggagttctcagctgagcagcattgctggagtggaaactggcccctgggcttatttaagaattcccctccatgaggccgggcgcggtggctcatgcctgtaatcccagcactttgggaggctgaggtgggtggatcatgaggtcaggagatcgagaccatcctggccaacgtgatgaaaccccgtctctactaaaaatacaaaaattagccaggcgtggtggcgcatgcctataatcccagctactcaggaggctgaggcaggagaatcacttgaaccagggagtcagaggttgcagtgagcccagatcactctaccgcactccagcctgggcaacagagcgagactctgtctgaaggaaaaaaaagaattaccctccatgagtttcatttctgtctgaatcatgaatcattgcttagttgacccaaaatactctttaaggctgcttaggattcgttgtcatatttcaaatataatggaaatatatatatctaccttatctttttttttttgctgtgaaatggaagtggtaattttaggaaactttttttctcttctgtcagcgacatcatgagaaaaaaagcatctacaatctaaatgaagatgaagaattgactcattatggccagtctttggcagacatcgagaagcataatgacattgtggacagtgacagcgatgctgaggatcgaggaacgttgtctggtgaggctggggtgctgtgcacgggcctgtgggcgtggagtcagggagagtctgttcattgttagaccttctgctcttcttagagactagagaaagttattgcatgaaagttttactgatcattaacctctctacaaatttcacaagtgacagtttttatgtatttttgttttttttttaagttttcagaactttaagatggtgtgtagatagatgcttttatgggccaagaaagcatgttgatatccattattttatttgaacctcaaaatagctcgttctacccatgagctcagagaaataaggtgttttgcccgatgccagagtcagagctgtggggagaacccacctcactgactccaggtgcctcactgaatgcactactttgctccccctactttatcaattccagcctaatatttgtaccagtggcattgatgtagttcctttagcttttacctactgtggaattatagcagtttgaggaaaatcatattgagcctcatatctgtagataacaacatgaaacagataaattttggccttaaataatgttaacagagtttaagattcagttcgggtctgactgtcttgaaccctatttataaggttgcagtcatgacatcaattacttgacatttcttgtaagttaaagtaggtcccatttccagcatcttcagaacaaaggtgtacaaatctaaaactgactctcaaagctttgtcttgtcagtgtgtgaaagttaaggcgttaaagcctggggctgccttctgatatttggctaatccagggggtaaaaggcttaggaattagggcagcaagcatgtggtgcagaacccgccatctgcggcacaccaggaggccccgccactgctcggcttcacgggcgtgaagagaatggccagttattttaacccctctgtgcctttgtctttgctcttttcattgttca

SEQ ID NO: 110476 - DNA, 1016 bp, Homo sapiens
ttggagctggagagatgtgggggcagtggatgacataatgcttttaggacgcctcggcgggagtggcggggcagggggggggcggggagtgagggcgcgtccaatgggagatttcttttcctagtggcacttaaaacagcctgagatttgaggctcttcctacattgtcaggacatttcatttagttcatgatcacggtggtagtaacacgattttaagcaccacctaagagatctgctcatctaagcctaagttggtctgcaggcgtttgaatgagttgtggttgccaagtaaagtggtgaacttacgtggtgattaatgaaattatcttaaatattaggaagagttgattgaagttttttgcctatgtgtgttgggaataaaaccaacacgttgctgatggggaggttaattgccgagggatgaatgaggtgtacattttaccagtattccagtcaggcttgccagaatacggggggtccgcagactccgtgggcatctcagatgtgccagtgaaagggtttctgtttgcttcattgctgacagcttgttactttttggaagctaggggtttctgttgcttgttcttggggagaatttttgaaacaggaaaagagagaccattaaaacatctagcggaaccccaggactttccctggaagtctgtgtgtcgagtgtacagtaggagttaggaagtactctggtgcagttcaggcctttctcttacctctcagtattctatttccgatctggatgtgtcccagatggcatttggtaagaatatctctgttaagactgattaatttttagtaatatttcttgttctttgtttctgttatgatccttgtctcgtcttcaaagtttaattagaaaatgattcggagagcagtgttagcttatttgttggaataaaatttaggaataaattattctaaaggatggaaaaactttttggatatttggagaaattttaaaacaatttggcttatctcttcagtaagtaatttctcatccag

SEQ ID NO: 110477 - DNA, 1073 bp, Homo sapiens
aggcgtataccaccatgcccagctaatttttgtgtttttagtagagatggggtttcaccatgttggccaggctggtctcgaacttctgacctcaggtgatccactcgcctcagcctgccaaagtgctgggattacaggtttgggccactgcacccggtcagaacccaggctctttcttatacttaccttgcaaacccttgttctcattttttccctttgtatttttattgttgaattgtaatagttctttatatattctggatactggattcttatcagatagatgatttgtaaaaactctcccttcctttggattgtctttttactttcttgatagtgtcttttgaagtgtaaaagtttttaattttgatgaagtcgagtttatctattttgtctttggttgctgtgcttcaagtgtcatatctaagaaatcattgtctaatccaaagtcaaaaaggtttactcctatgttttcttctaagaattttagagttttacatttaagtctgatccattttgagttaatttttatatatggttcaggtagaagtccaactttattcttttccatgtggttattcagttgtcccagcactgtttgttgaagagactattctttccccatggaattatcttagtacccttgttgaaaattaatcgtccttaattgtataaatttatttctagactgtcagttctacctgttggtctttatgtcgatcctgtgccagtaccatacagtcttgattactgaagtttgtgtcacagtttaaattcatgaaatgtgagttctccaactttgttccttttcaagattgatttggccatgctgggtcccttgcatttccgtacgaattgtaggatcagcttgtcagtttcaacaaagaagccaagtaggattctgagagggattgtgttgaatctgtagatcaacttggggagtattcgcatcttaacaatattgtcttccacctatgaacatgggcaaactttgtgtaaatggtcagattgtaagtatttcgggctgtgtgggcacagtgtctctgtcacagctacgcggctctgccattgta

SEQ ID NO: 110478 - DNA, 1022 bp, Homo sapiens
gtgcccgtgcagattgcttgattacacaattagaggaggctggcggaggattgttttaatttttttttttttgagacagtctggctctgttccccaggctagagtgcaatggcgcaatcttggtgcactgcaacctctgcctcctgggttcaagcagttcttctgccgcagcctcccgagtagctgggattataggcgcccgccaccacgcccaactattttttgtatttttagtagagcagcgtttcaccatgctggccaggctggtctcgaactcctgacctcagatgatctgctgccccagcctcccaaagtgctgggattacaggcgtgagccacacctggccgtttgttttaattttgaaggtgaagtgaaagtgactacatttaccaaaagtgattgaaaagccaggactgttcttaccctgtttttccagttcttgctcagagcaaggtggtttctttttcacttaatcaccatacttacttttcatgtagaacaagtcagtttgagttatcagttcatcatcttaactaaattccatgggggaaggaattagttttagtttcttaaacttccaggtttgcttattggacaaaatgagatagcaaggcagtgtttttaagttagattttttatttctttggtaatacaattttctcagaaacttagtagtcttttagtttagttgtttttagttggtcctatgttttggatcacccctctctactttattttgatagtgccaactgtgaagacatctgaagccataggtttggatgggaaggaggcatctttagcctgatcatcttcgccaggctgtttatctccttttgcttggctgagaagtcttaataggaggcttattcccagctatttggggacatagaagcagttagccattgcttatattttactgaggtctgtgtggtatgttgattgtagtcagttaacgattttgagaactgaaggcagcctggtatatatagagtaggtattagactgtgtttcttctaattga

SEQ ID NO: 110479 - DNA, 1159 bp, Homo sapiens
atctgtgtgatcttgggcatgtcatggttggcacttcaatttcttctctctataatgggggaagtgaggccagtcatggtggctcatacctataatcccagtgctttgggaggccaagatgggaagatcgcttgaggccaggagtttgagcaattgggcaacatcgtgaggccccgtctctacaaaatattttgaaaaaattagccaggcccagtggtgcgtgcctgtggtccgcgccactcaggaggctgagacgggaggatcctttcagcctaggagtttaaggctaaagtgagccatgattgtgctatcgtactccagcctgggcagcagagcaagatcctgactctaaaaaaaagtaaaataaagtaaaatgggggaaatgaactgctttagtaacatcatctgttttttctgtgagcagcgtagcttgacagccattggtgaactcgtgccctgtgcttccctgtccagatccccattctgcccgcaacatggagtataacggtttattcatagtagtcgagaaacactcactgaatgaatgaatgaggtgtagaactaagtggagtgggtaattcaacacatattaatttccttcttttttttatttttagaaagaaagaactttcagctaccaagaaagaccgtgtgaatcattgtctgacaatatgtgaaaacatagtggcacagtctgtcaggtaattgcactttgaactgtctagagaaaataagaactttgtatattttcagtcttaatgggctagaatattctttgtgtcccagctattttaaatggattcagaaatccatttaagatgaagaaggacccttttcccatatttctggctatatacaaggatatccagacactgaaatgaataatgttccctttttgtaatcttttatgcaaaaattaaaaccattatggtaattgaacaacatgtttatgtttagttaacacccttagcaactatagttattttaaaaccatctatggtttgatatttttgcatttgttgcaatagtaggaacagcacaagacagttcagtttgtctctcttatttgctttttcttggcagtttgctgtcctattgtacctctgctcctagcagtggctggagcccactcctctgtgcttcgggattagtggggatc

SEQ ID NO: 110480 - DNA, 1049 bp, Homo sapiens
ctcagcctctcgagtagctgggattacaggcgcccaccaccacacccggctaatttttgtattttttagtagagacggagtttctccatgttggtcaggctggtcttgaactcctgacctcaggtgatctgcccgccttggcctcccaaagtgctgggattacaggcatgagccaccccacctggccaggatttattgtatttgaaccatctaccattttaattttgatgttatgtagtatttgatgataatgaaagttaaattgtttttctttccatttttctgtttaagtgaatgacctgtatctagtttattcagtaacttcctgcatatatttgtttctttcattcttaatgaatatattcttaatttagttgctattatgttttgctttgccccaaaattgaaatcttagtttccttttagctcgttttagaactagtgatgggatgtgtcttccataaatctcttgtgatttgttgtaggctttgatggattctaatcttccaaggttacagctcgagctctataaggaaattaaaaaggtgggccttgcttttcttttttaaaaatgttttaaattttaaatttttataggtacacgtattttgtaggtacatgtaaatgtatatatttatggggtacatgagatattttgatacaggtatacaatacataataatcacaccatggaaagttggatatccatgccctcaagcatttatcctttgtgttacaaacaatccagttacatgctttacttattttattttatttttgagacagagtcttgctttcacccatgctagagtacagtggcatgaccttggctcactgcaacctccgcctcccgggttcaaccgaactttgggctggtctcaaactcctgacctcaggtgatccgcccgcctcggcctcccaaagtgttgggattacaggcgtgagccactgtgccgggcctgattgtacattttaaaataactaaaacagtcagggcacagtggctcatgcctgtaatcccagcattttgggaggctgaggcaggtgat

SEQ ID NO: 110481 - DNA, 1050 bp, Homo sapiens
cgcacccggcctgccctgtcactctgtgtgttgggtgaattcctgtgatctgtgactcactgctctgtgtcctacacattcggcttttcttctctccccacaaccccattttataattctcctttttcaggaaagctttattcccatttaaaaatttttgtttttaaaatggtattttcttacacttattttctaattaaaaatgagtgttttaagaagtattatgatttactgcaaataatttttaaacccagccttttagatcctctgtgatcataagagaaatgaaggatgtctcccaacacttgagcttcatccacatttcatcctcctgttctttcagctgagttttccccatcccattagggactgttggaatataaaactggcttttccctaacagggaatgaattgcttctgtttctcctgaaggagagctggaagaatgacttgcgttcttttgcatacacaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggtatgattgttgcctcaggtcacaaacatgcgagtgatgctgtgagtgagtctgtggagggtgagggcttctgaacagggagtcctgtgggagtgcttcttggggtatgttgtatgtcgtaatttagactaccatcatttgtgttatttttgaggcacctaaggacttctttccacttctcatttcttactgtggggtgaagagttgaattgggagatggtttctagatgcaaattgaaaaggcatttttccagagcagatttgttttcggcgtactagagtgactctttaacctagctgcgggaagatgactgtgccaagactgcaggtaggagaaagctcactgacgaggccttgtgggtctgaacgtcctgcagctatcagagcctgttggcttcctgttgtgcattccaacaaatcatcttcaaacccactttag

SEQ ID NO: 110482 - DNA, 1095 bp, Homo sapiens
ctgccacccagggcctggccctctgtctgtgtcggccatgactatggtgagtcttgtaggcttgagactgtgcctcgggttcctgcgggttctctgtaggtcagttgacagtttctcctgttgtttgggtaactgtggaaacgaacactggcaagtgctgaagcgagcatgtggacgtgcgatatgaaataacgacctggctttcaaaggcagtgaggctctctggaaaggaccttgctgagctagggatgtgggtgtgtagccattcccagtgggcctcatggcgtactcgttcatgatcatgtttgtgccatcttgatctctcaggatctcttcttttttaacagattaagccgggaatctccaaacagtgagtcagatgttaagatgtcttgcttccacccccacaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtaggagcacagggtttactctaggccctgcatgtgaatgactgacattcaaagaaccgattaatttggaagagaagcggcagaaccgagagttagaggtgtggactctggagctgcgctgctcgtttccaaccctaggtgctgacctctagctgtcttccctctgtatgtccctgtcaccgtgagtcaaatgcgggtgatgcctcctcaggtgccgtgttacctaagcctctcagagaccactgctaccctgtttctaaaaccagaggtcacgatatgtgttcatccacccagtaaatactgattgagcacccactgtgtgctaggctctgggataggggctgggtatacaatggtgagtatttcagctgcagcttctgccccgtggaggctgtggcctagcacactggtctaggcacggtggtatatgctcactcaaggagatagggacgtggtcgtttggggtgtcggaacaaaatgtcggaacttctctttccaatgcagag

SEQ ID NO: 110483 - DNA, 1014 bp, Homo sapiens
tgtgatatagtattaaaagtgctaataaatatggcatactgcctttaaaatgtctggtagctctttctcagtggcactcataatagtgttttttgatttttaaatgtgtgtcaagctgactctcccctccgtgtatgctgggctttattttccctttcctagtcaccagttttgggaaatagagatcttcattctcatgctgctcctctagtgcaagtgctccatttatttttaaggaattaatataacaaaaaatcatgggaatttagaaaacaacatggaagctaatgatcacattggtggaagtgatagggaaatatttagggggagaagttaaggtataaactttgtcaatgaagtcctattaaaaacaacaaaaaagtgaagcttaggatgcattttataaactctgaccagaacacctgtgtttctctgtttctaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttataggcaagttattagcaaggtctactcttacaattaactttgcagtaatactagttacactctattgattatgggcctgccctgtgctaagcagtctgcattccatcttccttgccaaaacttataatacaaatttcatctttattttataaataggggagttgggctgggtgtggtggctcacgcctgtaatttcagcactttggaaggatcgcttcagcccaggagtttgagacaacctggccaagtgagaccctgtctctacaaaaaaaaaaaaaaaaaaaaaattagctgggcatggtggcacatgcctgtagtcccagctgctttggaggctgaggtggtaggattgcttaagcccaagaggttg

SEQ ID NO: 110484 - DNA, 1041 bp, Homo sapiens
tgtttctgaccactgcttgcttagagggcctgcgtgtctgtgaccgcctagctttgcgcccctgactaggctgccccttaattacaaatgtctttatatattgctccagctaaggcttggagtagtcggttaagaacttgaacttcggtttttgcagtgaaacagcatttgagaatatcaccttctgataagccttattttataaggtgggtactgtagtgggaggcagtgtgagagatgcttgaaggatgcactgctgtcctgcatttcagcatcttcaggatgctgtgcagctgaaacatttgataacggtggaactgttcgttattttgcaagcctgtgattccctattgaatgttttctctcgccatttgacaaatgagtgtttctctgtcttcagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtaagtgggcagaggggcctgacatctttttttttattttttatttgagacagagtctcactccatagtgcagtggaggccgggcacaggggctcatgcctgtaatcccagcactttgggagactgaggcaggcggatcacttgaggtcaggagttcgagaccagcctggccaacatggtgaaaccctgtctctactaaaaatacaaaaattagttgggcgtggtggcacatgtctgtagtcccagctgttagggaggctgaggcaggagaattgcttgagcctgggaggcagaggttgc

SEQ ID NO: 110485 - DNA, 1055 bp, Homo sapiens
actattttagttttagagcagtaagtgttttgagttcatttgggatatttgacctgcgttgtagctcttcagaaaacacatgaatagtgaagttctttgtttcatgggttccctttagatgaaacccatagaggagaaaagtagaaacctcagcacgtaagagccaacatatatacacatcggatttaaacctaaagcacaaattgtgcctggtcgcagtggcgctgagtcgcactcagccaggccaggcattcacactcagggtgagtgggaaccaggactggctgaggcagcagtggacccaagtctccatcgcgcccatgcttactatggagccttctcgttctctctttttctttgggtgagagggtacacttgtgtttttgaatttatatgaggtaagtgtgtaatagggttttttctaatcttttttaagtggaatctggaattttaatcagatttattatctgacaacctagaattataatccagaaagtctgtggtattgaggacatattggcaatatgatgaatctctaattcttaaatcctgaaacttttttttttttaatcacttagggttattatagtgaagtcatttctgaatttggatcttctcttcacacctctttttctctttcctgagaattaagcttttgtttcgagttagaaagttgatagtagggaattgttccatggctgagcaatttatctccacagaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggtaacggccagtttttcagctgtgttttttctagttatgcttactaaggtttaagtttagatgatgatgtttgttgcttgttcttctggttaggaaatacattttctttggcggattgcattcctttgctgcggaaaacactgaaggatgagtcttctgttacttgcaagttagctt

SEQ ID NO: 110486 - DNA, 1649 bp, Homo sapiens
aaaaaaaaaaaaaagtagctgggtatggtggtgcatacctgtagtctcagctactcgggaagctgaggtggaggggggattgcttgagccccagagatcaaggctgcagtaaggcgtggttacaccactgccctctagcctgggcaacagagtgagactgtctcaaaaataatagtaataataatcagttgaattaaaaaaaaaaaaaaaaaaaccactgtgctaggcccatagtatggtaagagttaaagtgagccttagggattatttactcaacctctgtttctgtataaagtggaataggctcaattctttaagtgatagcatgttgaacctttccataccaactggctcataagtcacaactggccagtcaacaagagtaaaaattaactggtaaaaatcaaagcaaaaaacctacaattgtcaaatttgtgggataactcccccttttaaaatgtcatgcctgacagtaatttctctctagtttccaggttttcagtcagttgtgtcttttttgagcagaaggaagcatgctaagagctcaatcttgtggctagctgggggtctttgtgtcagccatgcatgtgatggtgcccctgggtgcttggggctgcaggggaggggtacagcagtaggggcctgttctgttctctcgtgctgtggagtacatagtgacatagtggggtggtccttggtgtaggtcccttgttcctacccctgggtctgagatttatttagaagtggtgttggggctgtgcggcaggcccctctgtaactgatcaatgtttgtgaagttgctgtttgagagttgaaaccatgacataagcagaaatggaaggaagaaagaaccagttatgtgaaagggacacatttacttttaagcttgtatttactgagataaagtattcttaatcaatgttcttgagaggtgtgggaaaaatgcaacatcctggttgcagttaaacccagaacattgtgtgttgaagagtgacggttctcaaaccgtcaagacgcgggtactgagtgggactaacctgctgtcctcttgccttggaccttgtgttccagaactgtgtcatgagtctctgcagcagcagctacagtgagttaggactgcagctgatcatcgatgtgctgactctgaggaacagttcctattggctggtgaggacagagcttctggaaacccttgcagagattgacttcaggtaagtgagtcacatccattagatttcatgaactaagctcaattgaaagttctgggatcacttgatgcaaggaatgatgttatcaagtaccctgtccatcagaaatccgagtggtttaggtagatgacagtgattttctcctcccagtggctttttgctgaactttgccctatgcttggaattttattttattttattatttatttagagacaagatcttgctctgtcgcccaggcttgaatgcagtagcacaatcatagctcactgaagctttgaactctaggactcaagtggtcctcctgcctcagcctcccgattagctaggagaataggtgtgtgccgtcacactggctaatattttttgtagaaatggggtcttgctatgttgcccaggctggtctcaaactcctgggcttgattgatcctccatcttggcct

SEQ ID NO: 110487 - DNA, 1033 bp, Homo sapiens
ctgcctattctgttagcattcatgtgttaacttaaaatcataatctccttagttttgttgagtgtctccgtggacaagacactgtgagggatacaaaatcagattggctttattcaaaccactggggtattataattcatttataatttattttattttttgccttttttccatgtgttctaaaggaattagagtttgtatataactataatgggggatagaaattgacatgtgccatgaagggaatgcaaaaaagtgccgtgggagatgagaagtggagaaaggaatttcttttttcttggaagcaggaataacttcatgaagcatgtatttcaacttaaacagatagtaggcaacgctgtaaggggagtatggctgcagcaaaagtgttcggggcagactgggaggaagggagggaataaattcagccattgttatggaataatgatcaaaatttattttcagcccgtttcacttaaaagttgagactgcttaactttttttaatctttaatcttaaacttttaaatgccatttgatctttaaaaatatatgttttaatagtgtattttaagtctctatatttttgttattagaatatatagaggctataacctactaccaagcataacagacgtcactatggaaaataacctttcaagagttattgcagcagtttctcatgaactaatcacatcaaccaccagagcactcacagtaagtctctttcttgatcggtcttactgacattgtaatagtttttggtagcttgtatggccagttagttgtatggtcatcttacggtgaggtgcttgtcttacagctcttacttatccatgaggcttgctaagaaattgtgcttctgtgaaaagaatctcagcttactccaggaatgtaaatgactatgttttttctgattattaaagtaatacacgcccaaaataaaaaaattcagccaatttaggaagacacaacaattaaaataagccaggcatggtggctcatgcctgtaatcccagcactttgggaggcca

SEQ ID NO: 110488 - DNA, 1013 bp, Homo sapiens
cttacactgtcttttctaggggattgagccctgggtagtcctgcttatttgaggttgcaatttgtctttcaataacttttactacaagatatggcgtgttaaaggataccattggggaaccaacataataatatcaggaaaactaaccacgtcagacctgccccattgtgtatcaagtacactatttttccatagtaataaagagttcaccccagccaattctcttttattttgtgcctgtttactcaatggcattaacatgcccaaatgtctgggtagctgtctcatctccagttcagcagaaccattgtcatatgccctagtaaaagcattccttcattggacacttaggccccaatactttcattcagatctactacctgatttcatttctcaaatgatttttatggagctctgatttataggaaagatgttagttgattaaaaataaaacaatttctgagctggtataaaatgtattgtgacatgccttcctcttggaattgcaagagaaaggaagactgttgtttgcttaaaaattgtctataatttgactttgcaaatgtctgcttccagagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcaggtactggtactgagttgaaacagggactccaggacttggattttgatttccttagggggaatgggggtggtgagcatatgaggggaaaatactataaggtcattgccagtgatggcttgtccctttagtcaaatttcagatgttacctatatgcataaacacatgcagttggcagctgttctgtgctgagtattttaaagtagcctcttcccaatatagcccctcagttaactacaagtaaactcattttgaatttcattttaatgggcaccatatgccagtact

SEQ ID NO: 110489 - DNA, 1058 bp, Homo sapiens
ttcggttgtgaagacaaagaaacctgggatgacttcacatcctgggcaggtgtgtggtggtgacagtcatggaaattgggaacacagatttgtgcgggaaacatcagtttcagtttgagtttggcttatcagttgaatatcaggcacagatgtctggccaactctcaacatagggtcttaaatgacttcagttccccaagcaatttgtccttcccatgctattggggtggagaggtaatgtctgtgcccatatcacagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggtaatgtcccacttgggtgctggattcatacagccttaatgactatgggtttccagactacctttgtttagtaatctgtcccttctttattctctttttgctttaaatgaacaaaattgctcagattgtgacactaaatttaacatcaaaatgtgaccatgtggatgggtgcagtggctcgtgcctgttattccagcactttgggagactgaggcaagtggatcacttgaggccaagagttcgagaccagcctgggcaacatcacgaaaccccctctctactaaaaatacaaaaaattagatgggttgggccgggcgtggtggctcaagcctgtaatcccagcactttgggaggccgaggtgggcggatcacgaggtcaagagatcaagaccatcctggctaacacagtgaaaccccgtctctactaaaaatacaaaaaaattatctgagcatggtggcgggcgcctgtagtcccagctgctcgggaggctgaggcaggagaatggcgtgaatccgggaggcggagcttgcagtgagccgagatcgtgccactgcactccagcctgggtgacagagcgagactccgtctcaaaaaaa

SEQ ID NO: 110490 - DNA, 2024 bp, Homo sapiens
tgcctcagccttctcagtagttgggactacaggcatacccaccatgcccagctaattttttgatttttttttttttttgagacagagtctcagcctgtcgcccaggctggagtgggttggcgcgatctcagctcactgcaacttctgcctcccaggttcaagtgattctcctgcctcagcctcccgagtagttgggattacaggcgcctgccaccacacccagctaactttttgtatttttagtagagacggggtttcaccatgttggccaggctggtctcgaacttgtgacctcgtgattagcccgcctcggcctcccaaagtgctgggattacaggcgtgagctaccgctcccagccaggaaacagcattcttgagataattcatataattcacccatttaaagtatataattcattctctttagtatgcccacagagttgtacagccatcaccagaatcagttttagaacccataaaggaactctgtactctttacccaaaacctccatgcctccagctgcaggcagccactaacctgccttctgtctctgtgactctacgtcttctggacattactgtggatgggctcatacagtcagtgagcttgtgactggtgccttctaccaagcagggttttcagtgtagcagcctctctgtttttcttttttttttaaattgtgacggaacttctgcctcccgggttcaagcgattctcctgcctcagcctcccgagtggctgggactacaggcccatgtcaccatgcctggctaattttttttttttttttttttagtagagatgggtttcaacatgttagccagggtggtctcgatctcctgacttcatgatccgcctgcctcggcctcccaaagtgctgggattacaggcgtgagccaccatgcccggctaacctttcatttactgtctgcatttcttccctgatgccttccagtccatgcacccgattgtagccattcatcctattatggtttaaggtgactgtcttagtcagcatgggttgccataacaaaataccatagcctgggtggcttcaacaacagaatttacttctcacacttctggaggttgggaagtccaagatccaggactttcgccttgccctcatgtggtgagggggtgaggaagctctgtggggcctcttatatatggatgctaatctcattcatgaggggtctgccctcatgacccagtcacctcccaaaggccccacctcctaataccatcaccctggtaattaagtttcagtgtataaatttgggggactatagacattgaaaccataacaagcacttttctaagatcagggagtgagtaagtagcagagctaggacctcaattccacatgtcagtcatcttgccttcactctgctccatgatggctgcctcctagagcattgggagtctcgatgttctatatgctctcatgtgttgtgtattggagatagttgaggctttatgaatacatctggatttgttgacttctagctttgctggtaaccagctgtgaccttgaataagttacttcatctctgagcctgtttcctcttttagaaacaggagtttaaaatgctgctttgggttgggcacggtggctcatgcctgtaattccagcactttgggaggctgagatgggaggatcactggagcttggagttcgagaccagcctgggcatcatagtgtgagatcctgtctcctcaagaaattaaaaaattagctgggtgatgtggcgtgtgcctgtggtcccatctactctggaggctgaggtgggaggattgcttgagcccaggaggttgaggctacaatgaaatatgattgcaccccatcctgggtgacgagtgagaccctgtctcaaaaaagaaaaaaaaaatgctgctttgtacccctttcatgtcatggcgtcatggccaacatagaatgccctggttgtttgctgttggagggcatgggcctgggggctccctgagggctccttccatcttcaactcattctctgtgcac

SEQ ID NO: 110491 - DNA, 1052 bp, Homo sapiens
gttacttacattctcatagttctctagtttcagtagtttcatttattattttgttatatcaatctatctgtctgctcatctattagaagcatccttgttttttttttttcttttttagacagagtcttgctctgtccccaggttggagtgcagtggtgcaaccatgcctccctgcagtctcagggctcaagtgatcctcccacctcagctcctgagtacctgggactaccggcatgtgccaccacacccagctaatttttacattttttgtagagacagggtctccctaagttgcctgggctggtctcaagctcctggcttaagtaatcctccctccttggcctcccaaagtgctgggattacaggtgtgagcaactgcacccggctacaagtatacttcttaattattgtagcttaatggtatttatgaggggatcagttcccctgttgttctttagaattttctggatattcttctttattgattttgggatgtgaacaatagaatcaacttctacttgtagattgatttagggagaacttatacctcagatgttaagtcaccctgtccagaatgtgggatgctttcctatttgttcagaactttttaaattacctcagaagcacatgaaatttaaaggattttaaaaaaaacttaaagattatttcacatagctcttgcacatttcttgataaatgaatcctcaggtattcctctgtttttgttactaatagttacttcttatgggttttttttcccctgaaaatcatttatcaaacgtatgtggcttattttctgaaggatgtttgataattttggaagatatgaaagtcttcatattttacaaggtttgaggtctctttaagctgcatggttctcatgtcagctcccaaagcagaagacggcatgttgaaaaatgccgtagagaagatacttcttttccacctgttttcaactcatatcatcttgaatttcagggcacctttccatgctcctagtgcttgctatctgtttattattttccttcctgaataccctgaactccagcatg

SEQ ID NO: 110492 - DNA, 1153 bp, Homo sapiens
agtctcgccttacctttcttgttatgcatgtctttggtcctgacccattctctgagtctgtaaaatagaattgctgtataatttaattacatgaaatcctttagaatcttaacacatcttacacctgatttaatattttattgtatccaaattgaaccaaccctatgtgaatttgacagtgatttctcccagggatcctagtgtataaggaataggacttagtattttctattttttgatataccacataccagatactgattatgatggacatttaacccttttttctcattatgaaagaaagttaggaattatttcttccagtagcgccagtgtaacctgaaagcctttgaaagagtagtttttgtatagctatctgaaaggaatttctttccaaaatatttttccagtgctgacaacaaacacgcagacacaccctgcaaggtgagtgtacggcgccgcacagtggaggcatctgctgcagccgtcgatgtttgtgtctttggttgtacattatgagatcgtgacagggccagtaaccgtgtgttctctccttcaccttcccaaggtcacgctggatcttcagaacagcacggaaaagtttggagggtttctccgctcagccttggatgttctttctcagatactagagctggccacactgcaggacattgggaaggtttgtgtcttgttttttctccttgggttgtggctggcacacttgatgtgcgtcttctgggctgagttcatctaggatggagcctggttctccagggtgcctccgggagactcctccctgccccacgtgcttgcgtcacaggacccaagtctgactctgccttagccatgaagtttagggggaagtttctatttgtattctatttttgtctgttatcatgtattagcttagacccagtttagtttggaaaatcagtgggtttcaaaatgtgtttgtagagtcctttatttcttaacttgaccttttcaagtggaaaggggcaaaacagacgggtaagggggcggggcgggaggtgtgacttgctcttttgtgcctgaggaagtaacagagctggggttgacagtcatattctctgacacagatagtctctgacttatctcacagaaagtcagcggcagagcctgagttaaaagt

SEQ ID NO: 110493 - DNA, 1050 bp, Homo sapiens
gtttcaatgctttctgtaaccatttggggtattaataagcatgtgagtgtgtgcatgtttgggttaatttcatatatgtttcttagaagggatatcattgatgtaaatattttaaaggcttgtcctccaaaaaaatcatgtaatttcttctaaattactgatcttttaaatgaccttcacctttctctcaaatctcacttaagactgggctgagtagtcagtttcctgtagcagaaaaaagctcagacttgagtagccttctgcgagtgaggagacttgatggctgtcaggcagctgtaaactctaaatagagtgtcattatctgaagagggcgatgctgccacactgagtggcctttcaagttgtttctcaatctgacacgttctgatcgtgtgaatgtgaaattggtttgagcaggagtatatctgagtgcagaggagattatttaaagatattctcattctctgcttcccttttattcccatttggcagatggtttgatgtcctccagaaagtgtctacccagttgaagacaaacctcacgagtgtcacaaagaaccgtgcagataaggtaaatggtgccgtttgtggcatgtgaactcaggcgtgtcagtgctagagaggaaactggagctgagactttccaggtattttgcttgaagcttttagttgaaggcttacttatggattctttctttctttttttcttttttatagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtttgtcacttttatctttcatccatcatacctgttcctaatttagtacaaattaccctaaaagacactgaaatctactttaaagaaatgtggtctgcatgtttccctcatcagttgctgctgcttatctttttcatgcacctagctggtgcagaaggcctggggcatagc

SEQ ID NO: 110494 - DNA, 1032 bp, Homo sapiens
tcaagcaattttcctgcctcagcctcccgagtagctgggactacaggtgcgtgccactgtgcccggctaattttttgtatttttagtagagacggggtttcactgtgttagccaggatggtcgcgatctcctgaccttgtgatccgcccgcctcggcctcccaaagtgttgggattacaggtggctctcgcaccaagccaagagtttgcatttttagcaaattcccaggtgaaactaatgcctgcttttctgggagcacactttgggactcagtgatagagaggtttattggtaggatagtaaaataggagttattttctttcacaaaattggcaattgggggaaatttaatcttccttttttcttcagctgtgacttatgtattatgtttattttaggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtatgctttctatctgagcctataactaacccatgccttttgggaagtcacgtgatgtttcacagtcagtaagtctggaataatacctggtcttgcttcacttctgagttgggtaaagaagtctgtatcagtgtaattttctaatccgtcctgcattatctatggctcttggttcatacctgtcttgaagttctgtcatgttctgtctcttgtcctcagtagagatgctacagcagtggctcgcctcaggcagggcagggcagtggggtggctgtcctgggggcaggcagtaggggcacgctgacgtcagggaagttgaaacccaagagaagccagtaaaagtgagtctcagattgtcaccatgtgctggcagttttacacgctgtcagtaataaaag

SEQ ID NO: 110495 - DNA, 1482 bp, Homo sapiens
gaggtgacggccttggtaaatcgagtttcctacctcctcaattatttgtgctcatacactgtatatttttagtgaggtttatatttgggatgtgttttctccttcttaccctttctggcctttctatggcattaatacctggtctcttcttgtgtacttgaaaatgaatctctcatcatatttttccttagtgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactgtacgtcttcatcctgccgactattgccagttgcagttttccctgccttaaaaatggagtattgaaatttttaactttaatttctgatttgcaaaatagtcatcttttgttcttttccttcttgctgttagccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacaggtattgggaagagaaaccctgatattgatttatattgaaaatttagcaggccaagcaaaacaggtggctggctttttcctccgtaagtatggtcttgacatggtcaccgatagaaacatggaaacatctgcaaacttgccgttactcgtgtgtccgatctgactgtttcttgtatttttttctagtctgcccttactaggatgaactgtacacatcagttcatcctttttaaatgagcatgaggttattttgggttgttaggtgttacaaacacactaatgtgtttttgtctattagagcagcatggcccagttgccaatggaagaactcaacagaatccaggaataccttcagagcagcgggctcgctcagaggtaatgctggaaacacaggtcgtccttgtgttaggacaacccaggatataaaggatatagatttgtacgggaataaattcacaggacaagaaatcgatgtgccttataggtgggtttactgcagaagtgccataatagaaccttcctacttttaaaacaaccagatctcactttctaaagagtaaaggatgaccggcaggatcacgtctgtgacgtgagtggaggcagtttgcactcctggtggctgtttgagaggtagcatttagaatgcctgtattcactgtcctgtgatgagtgggaaaataggttatcaggtttatcttagcaaaatcaaagcatgtcatctaattgctaaacaagagttggcaaatctgagagacattactcaatccttggcatgcaggacttacatctgcatcctgttgccat

SEQ ID NO: 110496 - DNA, 1050 bp, Homo sapiens
ctttttcaaactttagggtggttggtgtatcactgaggtcttggatgacactttagctttgattttgtttttatgaattaaaattgtcataccaaaatttttatttcaagcaaatccaagagcataaaaaattaaaatattacttaaaatactaagagagaacagatatatattttactaagcatatgttgaatgaaattgttcaaatatttataacaggcatagagtagaattttcttaaaaatatttttgatggtataccaatttgtattttctcagaaacatttgccttattcttttttctgttgtgtttttcttacctgattgaaagctcataatctgttgttattgtttgttaacctttaatgctctgatttcaggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggtaattaaaattaaaatttatcttatttttaaaaagcattccagggccagtatagtactttgcaccaagtaaatgtacaataaaggcagtggatctaatacattgaaagcgtttacagaggtagctaaagagcagcacgggtgtcctcggctcagaatttcttcctgtgtgtttgccactttgccattcattgacatggtcatggacatagggctctaagcccttgaggaaggctgggccagacctcaggggagatgcagccccaaaccacgtgcagtcctgtggacggatgtgtagatgtgccactgaggaacaatgtcttgagctttcatcagattctcagagaattgcttgactgcctttcgaagttgatgcatctgtgctcacgtttgcacccacccacgaggtccttctgtttcaggggatgctgcactgtatcagtccctgcccactctg

SEQ ID NO: 110497 - DNA, 1907 bp, Homo sapiens
ctccaaactgcccagtcatttgcaccttcctcctgagaaagagaaggacattgtgaaattcgtggtggcaacccttgaggtaagaggcagctcgggagctcagtgttgctgtggggagggggcatggggctgacactgaagagggtaaagcagttttatttgaaaagcaagatctctgaccagtccagtcacttttccatctcagcctggcagtaagtcttgtcaccgtcaagttattgtagccatccttcaccctcacctcgccactcctcatggtggcctgtgaggtcagccaggtccccttctcatctgcacctaccatgttaggtggatcctaattttagagacatgaaaaataatcatctggaagtactttatgtcttaagttggcctggacatgtcagccaaggaatacttacttggtttgtgttagtgcttgtaattcgcccccagaatgtgtacacgttctggatgcattaaagtctggcctgtatccttaaagggccatcgctgtgctgcctgccctcagcaaggacacactttgcagacccacagaggctccgcctccacctcacaccaaagaaagggaggagtccaaagggcatcagtgccattactcacaaaatgataaatacacccttattctgaaccacgtggagtcatatggtttgtgatccctgtccttcaggtttcagcttagtggggaagtgggaaagtcagcgtgtgatcacagcacagggtgattgctgctgattatattatgtgcctgctgtatgcaggatgaaatactttatatgcgtcatcttatttgactctcacaaccccctgtgagataggctctgttactcccatttgacaggtgaggaaagcaaggcttagagaatttcagtgacttgcccaggtcctctgagctaggaagtagccattctggcatttgaacccaaggcctgctatccctagaacccacgctctcaaattcaacctatgacagaggcaagccctggtgctgtgggagccccaaggaagagcctctggcctggtggccacgtagcccaggagagatttctacaggagcccacagcgctgaaggagagagaggcagcagagtaagggggctttgtggcagagaggggactggcactttggggaataggtgggtcaggactgaatgtaatggagccatgtcagagctgtccttctggaagggcaagggcacctggacgcgctgcccctcagtgctttggacggttccacaactgtgattcacacggcttccccaaacgaaggtacacgagtgggcattctgtgactcggtacttccctttaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccggtgagtccccgtccatgaacggtgggttcctatcatagttcctgtctgcttcaccatgtttttattttgtgctgcctgtttgccaggtactaagctaggaattggggatggagaggtagataaaatatgcatcaggaagggctgggccccatctcttactctccaatatattggagtctacactggaatttaactggaatttgcttttttagtcattttatttagattttgaagtttcagctttcatcaaaaatacctctaaactttatgtctctgtgatctttggtcttagctgttttatgtatttagtcttatatgatcataagattaataacattacattcagaagattatttgttttctgtcagagttaaaatgtttgtttttatactgcattgtaat

SEQ ID NO: 110498 - DNA, 1045 bp, Homo sapiens
agatggcgggcttattccgaagaagaggccagtgcctggcggtgctggaagcagttgcagaacagggagttgtaggctttcctgggaagagagcagcaggggtgctggagaagcaggccacacttgctgcatggggttgctctcggccccactcttggtgcacagcgagtcactgtgggttcattagcatctggttatgagacagtaactgctcctttggaggggctcgtggagaccatgcaggagggcacggtcttgaggtcatgccgtccagagcacacctgaggataggccaggacgggctgcacgctgtaggtaaaattcctccagcaagctcttcactggcattgaggagttccctgagtgcggtcatctggaaggcagctgtaacaggcactgcagtctctccctgggtgggtaccagagaggagcataggggagcataaccgatttaaagagagggctttcctgtggtgaggtaagagattagctggtcattatcatagagccccctctgcctttgtgcagatgggctgtgggaatcctggggttccgttgggtcctttgtcacctcactgaaggcatgtaagctgagctggccagaccgtgagctgatcctgccacttgaacagcatcaagcctgcctctggattcttctgtgcatggcacttgtctgagcacctcacgcacagagaactggacttcagagtttacagaaataagctgtatggttcattttcatgcctgcttgccaataaacatatctgagctgaacctcattgaacgcctgcctttattctagcacagcacctgctgtttgtgggcgaggggtgctgtctctaactcctgcctgcttctcccagcactccctgagtggggtgtgccagcagcctcaggatgaggacaggaagtgggagggcagagcagatttgggagggccacttgatggggaaggaagtcccaggaagcagttggagctgttttctgggggagaaggtgccagctctgggacagtgttggggtagtgaggagggagcccagtgga

SEQ ID NO: 110499 - DNA, 1031 bp, Homo sapiens
agtaaggccacaccctgtgctggttggcacatgggcagttatggccgcttgcaggcctttggtggggaataaaataaggcagcaagctggtgttctttttttctcttaccttatttttgaaagagtagctgaatggtgtcttgactgatattccagagcagggacaaagcctgctgaggtctgggggctgcgattaccaatggctggaatgcattttattacggtgcattccatgttaaggatcaatacgattgtgccctttctggaaaatatcttttagtttatcaatattcagaggagtgtaggttgaattaaaatgaaaaggcactttataaaggccatgagtagtacctggtttcatttttctaatgtcttgcagagattttatcaggcttcttgaagtgttcacgtacattacgctaacacgatattaataataactgtgctctggtacagcggagccagcagaatgggaagttgtggaatgcaggcccttgattctgatagaaggtgtggtttgaactcacagaaatgacagtttggagggtagacatatgtcacaagtcatcaagattgtctttaaattcatgcatagaagctaacagggtgtcataagcaaggcctgtaaaatgtatgagggaattcaaagataatttattaaaaagtaattcatgtttggagttttgtgcccaaaggagtccttgatttgaaaaatgggcttttgcccatcagattgtttcagggcccgtgtgtgcggaggccctgccttgtgccccgtgagctcagcctgacagaaatcctttggtagcacttaaggctcctcttcctcccattgaggcagggaagactctgggttctgcaggcagaggtggttgtgggtgtcttgctgctcttgttgacatgtgggctctccttccaggaagacacagagaggacccagatcaacgtcctggccgtgcaggccatcacctcactggtgctcagtgcaatgactgtgcctgtggccggcaacccagctgtaagctgcttgg

SEQ ID NO: 110500 - DNA, 1011 bp, Homo sapiens
cttctcaggatttaaaatttaattatatcagtaaagagattaattttaacgtaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcacctgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggccaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggt

SEQ ID NO: 110501 - DNA, 1068 bp, Homo sapiens
cttggagctgtcctccagaggggtcacgtgtaggagtgagaagaaggaagatcttgagagctgctgagggaccttggagagctcaggatggctcagacgaggacactcgcttgccgggcctgggcctcctgggaaggagggagctgctcagaatgccgcatgacaactgaaggcaacctggaaggttcaggggccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgtccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaaggaaaaaaatggaaaccatcagttgttgctgtgtgaggcttgctttgcttcatgagaacctagaccttgctgagctggagtcttaggaagcagtctcctaagtgcttctccagcaggggcagaaactgtcccaccagctaacatctggcattatggagggtcccccaggcagctgccagcagggacaggccccgtgttttctgtagccagggatgaggaagtggccccagggcatgggcctggctgggtgcttctgcaagggccttcccaaaccacagtacaggtggtcttcctgccctgcagatgggagctgtgggagctgctggagctgctggagccttcatggtcaagtgacatcataagcttatatgacatacacaagcctcaggacttggcccatggcactgaagcaggtcatcaggcccagcacagagactagagctgtgttctcacagggcccaccacccttccacctccttggccattgacacctgcgt

SEQ ID NO: 110502 - DNA, 1063 bp, Homo sapiens
gagtgcctctgagaacctcccagagtctgccccttgtgttcctcagatggacttttcgtttcctggagttttgtcatgaggcttaattaactcatgtctctctctcttttctttcagtctgcaactgtgtctgatggcggtaagtcacaatttctgatgtatatattttttatttttcataaagttttcaaattgtgaaagtgtatttgccatttgatgccctcaggaaggacgggttgtttgcctttccctgtctccttgtgggcgggttctaggtgagttaattctgggggcgctttctgtgacacccaggtggcctcggcgtgtgttttggaagctgtttgttaagagaactgccatggccctgaacaccagtgtgatagagcgctgtgtgtctgaggagtgcacccacccgcctgcctgtgtctgacaagttaaaacgtgtttttgctcttcccttgttgtataaccagcttttaaaccagcaagttaagatttcaaagtgctttctgaatttgagcaattcaggaaatttgggtgagacccagaattttctcaagaaaagtataatagacgaattgagagtgtgggatgaagaggaatcaaaaacttactttctgtgtttaaagaattttgtgcacagggattcttttcatggactgattgaaaaggaagtaggcaggaatgtcttatttcactgaagatttctctgatgtcatccttatcattttggttcaatgatttaaaaaaacctctccaaagtaaggagagttcctccgaaatattcctcttttcttctaacactcctgacagtccgcaggctctcgggtttcatcgtcacctcacgcttttgtccccacttctgtccctgagagctggaataggtgcacctggcatcgctgtgggccagggatgggctgaggcacaggctgtgctgcagaagctgcccaggggccggtgggtttgaggtgccactgtatttgtgcgttaaagagaaaccaaatgtcgttctctcactttctgtggtcctgcagctgctggcctcagtcctcggcctcggaaa

SEQ ID NO: 110503 - DNA, 1032 bp, Homo sapiens
tatttatgggactaaaaattttttaatttaagttacatgtggaaagaagagttaaaaactatacaaaaagcctacaagtacttttttttcctttgccactgcttgtttaataaagcacaaattgctgaagtggagtagcgtgttgggaggccggggttccatctgcagtgtttatgccacgtgcagtcacctagctgtgctcggcccgccttcaataattcaggctccgtggcggcagcagctgaggggctgctgtgaattatgcatgcgtcttcggcaaggcttcgtgcgacgtctcctgttggcttcccatccgtgagcctgcgtgcaggcagggcagagccgtctttgtcagccgtgtgctgggatcgcgggagaaactgcaataattggcctcctgggagtgtgagctcaggagcaatgtccctgtgtgggacgcaggcctttgctcggggccgcccgggctctgccggctgaccctggtatggactcagaggggtggtttgcagtgcatggttggaagtatttggttaagtggcatcacagtggctcttatcagctctacccaggtaaagtcccttgtccccatctgcgtaccttgtcgcgttgtcaggggcacactgacttatgtggtcttcaggtatgtttgccgcagcgggattgtgtcggggatgaggggcccataggggtgcctgtgcagtgacgtgtttcgtgatctgacttggagttatgacttaaagagtcagagtgtttgaggttacggtttggatgagataacaacgggcccgggccgtgtgttacagaactaactgcaaacttttcatcttacggtattaacatttgtaacgtaacctacatgtttgacccaccaatatatacatggcggcttttccaattagcagcaaatctaaacagactttaaactctttttcaccaggaaagcatttctttgactcagatgggtcagtcgaaagaaaaaatcccacaacaataccgtaaactggaccgtgttctctaaggtggtgttgggat

SEQ ID NO: 110504 - DNA, 1045 bp, Homo sapiens
gggcaccgtgggtcaggacgtaactcacgtggcatacgcggcgccccgcgcccagctgctttcgctctagcaagcctgtttgggaaacatcttgttgccatgatggtcttagtgctctgtgtgcacatgctcctgtgtaaggttagttgcttttcctgttcaaccctgtggctgtagtttgttgttgcttgggcgagtgtgcacgtgtgagcatatgagtgtgcgtgcaagggtgctgtgtgggcctgcacatgtgaacatgtgtgtgtgctcgtgcacacacatgtgcagccgctcaaggttggggtctgtgttttgttccctgctccatccctgtgtgtagaatgcactggcaggtggtaggtgtgctgtgcatagttgttgactgaatgggtgttggaggggacagagcttgctgcgtgtcccagggtctcctgtgggcgggcagagcagtcactgggccggggcggagggcaggggtgcaggtgctgtctgtgctggtcccgcagagttgacgggcgccgacctgaaggactgcgtcagcaacaacagcctgagcagcaatgccagcctccccagcgtgcagagctgccggcgcctgcgtgagaggagggtcgccagctgggccgtgtcctttgagcgcctgctgcaggaccccgtcggtgtccgctacttctctgtgagtagggaagggcccaggagcagcggagcggtctgtgctctgcagagactaccgagcaggatctgtgggccgccctagagacagcggcaccctgcgggccctgagcagccccgtggcaggggtctcccctccctggaccgccaccctctcaagagctcagaggagggtgggttgaatcctgcccctggttctgcccccagggagcgtccctggccctcccgctctctactggggtctctctgcagcccgcagcactggagcttcctatctgtgttaagaagccaggtgcctgttgccagctcttcaaagagatgttttgcttttggggaaacagctggaagcagcagtgcggttccctaaagt

SEQ ID NO: 110505 - DNA, 1073 bp, Homo sapiens
taggggagagggcgagtggggccagtgcaggggagggggctgtggggttggcataggggagagggcgagcggggccagtgcaggggagggggtgagtggggcttgtgcaggagagagggcaggcggggctggcccaggggagggggaggctttggagttagtacacaaaagagaattggtctgggccccctggtccctccttggtgccctgatctggcgcccttccctccaggcacaaaacaggaagccagggcagtaggcgcctgtgctctgcccggcaaaatggaggctgcaggctcggtcatttgggctggttctgcagttccttgcgtgcagggaatcgggcggtcgacagagctctttccaacgtgttgccttggtcatgacagtcctgccctggggaagctgggtccggccagcagccttcggagatgggctcgtcgcccggcccccacctcatcctgacgcgcaggagccggccctccttagagcccttgttgagaaccgtgcgtgaggaaggttactcagacccaggagggtgggtcctgtttgtagctgtccccagggacaggcagaggcgtggccttggggcctgcaggtgcaggtgccgtagggaggtgtgtcttggaaagagctttctggaaacccacctgcagatgttctaggtagagagctcactttgtgaggagccacttcaggtgacattgggctgcccctctgcctttcaggttgttggccctgatgatgtcacgcagggagcacgtggctcacttgtccccacccagggagacctgggccatgggtcccagtcagaagcaagcgctgaggccattagtcctggagctccaactcttgctcccctccccaactcctcacagagcagagacccttccccgagcccaccctttgctctagggaaagccttacgctgggccctgacacccacccaggcaggtggggcaggcacagcatgtgtaacccagcagggcggccagcagctttgccccggctgaccctctgtgcccagggcctgctgggcctcggggcttgtttgtgtacaggcaagtcctgtg

SEQ ID NO: 110506 - DNA, 1071 bp, Homo sapiens
ctctgggatgaggcatcgggaggagcggggactcccaggggactgccactccacagagggggataaccactgagtcaggctgggcctggtgcctgcgggcgagggtgggcggtggtggccacctcctccaccgagtcttctctctgccacagacccaagtcccccgggaccctcgactgtggaggagcgtgtggcccaggaagccctggaaaccctacagctggagaagcggctgagcctcctctcacatgcgggcaggccgggcagtggaggtagggccgggggctgacctgggctgtgggacctcggctaagcctccagcaggagagctcaggaggcatccatgcatgtgtgggggctgcaggctccctctgctcattcattcattccttctgtctcctgctcattcattcttcccccaactccccgccccgcccgctactcattcatccttccttccccaccaccctgctcattccttccttctcctcctgctcattcattccttccttcttcctcctactcattaattccttcctccccccattcctttcttcaccccctcattcattcctttcttcacccccattcattccttttctccctgctcattcattccttccttccccaccctgctcattcatttcttcctccgccccccccactcattccttcccccctcattcattcctgtcttcaccccctcattcattccttccttttctccctgctcattcattccttccttccccaccttgctcattcatttcttcctccgcccccccggctcattcttgccttacctccattcattccttccttttccccacactcattcattccttccttccccccaccccctgctcattcagtccttctttcaccccccccaccgccccgctcattcattccttcatttctctcctgctcattcattcctttcttctccctctgctcattcattccttccttttccccctgctcattctttccttcacccccccgctcattcgttccttccttctccccctgctcattcgttttttccttctctctctgctcattccttca

SEQ ID NO: 110507 - DNA, 1051 bp, Homo sapiens
atgggtgtggaattggaaagtcagatgtgcagggcttgcgccttttccttttggatcgcgcgtctcctgacatgaggctgagctcacagagctggcctcgaggcgcgctgtccccagctgatgagacgtttctgtccacaggtgaagaagcatctgcaggacctgtccggcaggatctccagagctcggcacaacgaactctgaaggcattggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaaccacccgcttgttggctggtcactaagtgtcctggtggctggggccggagccagtgctcttgaagggatcgcgtcatagccagcttcccctctgggccctgtgggtctttgcagccaacctccttttcccgtgagacggcccggcctgatttaaagccaagagcgcttgagttgagtttgaggggaagatgtggagcgtgtggttctgtggacagtcagagactgtggcctgggggcagcgtctttcaactctcacctctgcagctcagggacctcgggagacctcaccaaacctgcagggcctccgtgtccctaagtgtgctgtgtaaatgccccatctcatgggggagagacagccacggaggccttcctctgaccatagctgatggactggcggttgctcaggtccggctccgagaatgttcctgtgtctgagcctggaa

SEQ ID NO: 110508 - DNA, 1026 bp, Homo sapiens
ggcccgctgcgagccacggcggcaagtactcgcgggagaagaaccagcccaagccgtccccgaaacgcgagtccggagaggagttccgcatggagaagttgaaccagctgtgggagaaggcccagcgagtgagcgcggcccgcggtcggtggagcggggcctgggggcgggggccgtggttggggtcgttggagcggggcccaggggtcggaggcggaggggggcgcagccggggcacctgtgccctacgcgccctgtccttggcacagcctcccccaagtgtcaggtggggcgccccgaccccttctgcagcaggaaaggtacccgtgccggcgacgacgccgtgtgaagcaggtggcggccggcaccccgagggtcagtgtcgccctccccagcctgggcggcctgctgacccgagcgtagggacagaaccaggctagatcacaggtctcctgcctcccgagcctttgcctgttccctcaaccttatctccctatgtggggaaacaagaaaaacaaaatgttgggtagaaagacgtgtccagggacagaaggaatcccagtagcaagcccgtgcttgttcatttgagcgagaaatgaggaggtgaggagatgggatcggtttagagcacataaaacgcgaccttgggaatgctgaaagtcagtcttaacagggcgctcacctgacctctccttcatttgagagatgagggtacggaggccccgaggggaaagggcacccccaaggtggctcggccggtggggccccccgggacaacagcttcctaattggtgcgtgaccctgggccagctgctctcttcattaagatacggttgcttcatttgttaggtgttcctgaaaacacctgaaatgggtgttttcgaactatgccgaccatctgggcctcattatctcatctcaaatgcaggagtcagattagatctctgtctcaatagtccagttttaagcattcctgagtctttgagagggaaagtaagtgatttgcagaataagaaggaacttttg

SEQ ID NO: 110509 - DNA, 1001 bp, Homo sapiens
agctgcaggtagccacatctgccactaagccagggtgggcagggttctggagactggcaccgagccacgctccctgatccctgcttcccacagtcggggtgggaccatgtggggtctggcggaaaagctagggagggagcagaggtcacagaggctggcctactctgctgtcccgtttcggtacagtaggctcgggaaagttaggacacaaccccacctgcccgcctgcccgctggatttatggaacagacactccacaaatgacgctggagccgggtgggccgggctgcagtttaggaagtgagcaggatcaggtaggtgagtgggcaaagggagcttctgggaccagccttgaaagatgggtggaattctgcaaatgttacttgtttcttattgcaaaaagtaatacatcgttcttgccaacagaatgactggcaggattttcagtaaaggtccaagtcggaagtcatttagactgggtcccctagtctctgtcagaaccatggtactctgttggggtgtgaaagtagccacagatcatctgtagattaaggggtgtggctttgttccaataaatctttatttacaaacacaggctgtgggctggatttggcctgcaggctgtagtttgtgatccttgattcagacagtttagcaaggctgaaaagaacaccgacacccccttgttacccacagatgggtgggacttggccagaggccaagaggagggtgctcgcaggggagcatacagcatgaagaggccgggaggtgccccaggacaccaagtgtgggaaagtgggacatgcggggaagttcccagaaagcgtgatgtcaagttggaggcggagcgctgctggggcgtgaagagtctcgagtccaagtgagggagttaagaacttggtaggggttgttgttgggtcgggcacctggggtcagccaggtggtgacctgggatgcggtggggacaggcaatgaggtaagctctgctctttagtattatg

SEQ ID NO: 110510 - DNA, 1044 bp, Homo sapiens
cttcctcacctgaccctgtcacccatctccccttctcgtgttctcagccccttctttgactcttgaattttgagtttttacagatgtttgggagctcttactctgacatgaagttataattggtaatggagactcagacaatgttgtagattacagagtgaactatgctttttagtgttaaatgcaatagcttgagatacaatgttttacttggtacataaatgctggttttctttcagatttaaggacatacacttttttttttttttttttttaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataactttcttgtgagttttgttcatgcgaactttggaataacttctggtttttagcta

SEQ ID NO: 110511 - DNA, 1036 bp, Homo sapiens
aaagtactgcgattacaggtgtgagccactgcacctggctggaggggatgggtactttaaccaccaccaatagcagctgctctttccttcatcagatactttatggaggctgagatgtgtttggctgtcagtgccaaacacgtggaaggtgcatttctagctctccaacagctcattctaggctgcagcagacaagttaccaggccgcatggtatgtgctttgtaagtgtaggcgcagggtatcatgggagcatctaggagggatatctagtccaggtcagcctcaggactgagacctttttgaggttttaggagatgtgagagaacttctgtatttgtgtccttatattgggtatttttagtagtttagagaaatggcagagtaagaaatgatcacacataagatatttgggggcaactgcagtgaagtggagtgcccaggaccacataactgctgtgtggcaaagccgggacgcagacactgggaccagggctgtgggggttggaaagaaagtagaagtcatagatctgtcctcaacaaggtgtcatcttagagagaaaaaggcagaaatgcattctcaaaggctgaggattttgagtcgcattgttttcttgggaaggactcattaaggggagttggggggtattgaacagccatgaaatgagagggctgcacaaaagacagtgccggctgagttctgcttttggaaaatggctaaaatggctcgttcttctgacgcctgaggtgatttctttttcctctggctctagcctaagtttagaagcttgaggccttaaggttctttatattgttcaaagatgggagagcaggtccatattaaaaacaaaacaggccaggcgcggtggctcacgcctgtaatcccagcgctttgggaggccgaggcgggcggatcacgaggtcaggagatcgagaccatcctggctaacgcggtgaaaccccgtctctactaaaaatacaaaaaacaattagctgggcatggtggcgggcgcctgtagtcccagctacttgggaggc

SEQ ID NO: 110512 - DNA, 1026 bp, Homo sapiens
ccaggctctagcatcctgtccagcaggcctttctcctcctttcaagtcttgctggacgactcctgaaaagcaaaagtaggaaaaaaactgggggctgagagtggaaggctggacagagggtatgtctcctgctctggcacccggaagcctgcgagggcttcggaagcgcagcgtctcacggtcgcgcatcccggccctggacgcatccagcggcagcggtaatcctggtcctcctgggcttccgtaggtcggaataaacttgggaactcttccaccggcaaagctcagtgttttaaaattcaaatcacacttgccgacatgagagcggaacctttgaggccgactccaccctagctgctcgctaactaaacagcgaagagaacacagtctccaatccaaacgccaggaggtccagacccggagcggacgccggaagcgctgtgtctgacgtcacttccgtcgcatttcggggcggtaccaagatggactcctcgcgggcccggcagcagctccggcggcgattcctcctcctgccggacgccgaggcccagctggaccgcgagggtgacgccgggccgggtgaggcgcgcaccaagccgccccgaggttctcagaggcgaggcgtcggaaaacggccggcctccggcagccctggcccagtctggaaggactgagtttcggctttgcaagtcgaatatttaatgtcagggaagatccttagaatcgcggagtgctgtgcatcgtcatttcagctgcgcttcagaattctctggagagctgatttgacacctatttggaaatagcgattaaaattaaaaatacccaccagttttaagtcttaaggatttaccagaaacatgcgtgtaccgcagtgtacaatgatgtgcgcagtgtttcacttcaggattgcttgtaatagcgaattactggaaatatctgccttgcccgtcagcagaaagctgtttaagtaaatttgggtatatgtatacctgacacatcaggtcgactcgtatgtaccaatgggga

SEQ ID NO: 110513 - DNA, 1127 bp, Homo sapiens
cgcacctggcccagccttcttttttagagaacctcttagtgccttcatttatggaaaggaagaaactgaatgcactgcagagacttccttattgtgaagagcaagatgtttcatcccaatgtttgatgctggtgccagcccagtatgtaatgatttgcttagtaatcaggcagggagatagatacatgggaaagaaagaacaggagctttggatttctgacagacctggttcaaatccctgctgtgcagtttgcctgacgtttgatcttaggcacattatttagcctctgagcctcagtttccttatctaaaaaaaatgtggatagtaatattcattcatttatttaatacttaactgagtgtctgatctgtgccaggacctgaacaaaaaaatctaaagtatcccaggtggtggtgcatgagggaaaataaaacagggtgaggacgtagtgactaggtgttcctctggataaggggtgagggggtcacagcagcctctgaaggttacggttaaggtagatgagcagtgtgcttgaagcgccttccttctggtagaaggagaattcccttcaagtaattaaatcagccacctgttagtcaaaatggttgaatagagaccctaaatgtggactatatatgtagaaaatcttggtttgctatctttcagccacattgttgattacattgtttatttttgtgtaaatatcagtttcaaaaaacagtggggtcagaaccccactggtctttcattcttatcaaattatcgggagttgattcacttatgtagagagaatactttcggcaacaagtgggcatcaagatgaaaatttatctcggtagtacacctagcgtttgtctctttcagaaggtacaaattggccctttgaaaccgtataaccgatcattagattggcctttatgtggcatctattttttaaggttatttctgttttaactaagaatcaaagatttgaaattgcttcaactgcagggttttagaaagttttttccagtttcccttttgaagtgtgaacatattaaacattaaataaaataaggagtaaacagcccctggtaaaccctgagctctgcgaaacgcagcttgtcatcccttacctctgcctttg

SEQ ID NO: 110514 - DNA, 1087 bp, Homo sapiens
gatttaacaccctcaaagctcttcatcttgagagccaatctgccaggtttaaatcctggttctgttaaccgtgtatccttgggcaagttatgtaatctctgtgtctcagttacctcatataaattttgaacaataatagtccttccctcatagggttactgcggggattgaataagtgaataaatgtaaagcctctagaatagtgcctggcacgtggtaaggacacaataaatgttagccattctcattgttaatgttagttttacttatatgaatggtggaattttatgtagattgctaatcaactttgactctgttattttcatgtgaaattatggttgaaaagttaggggcatgagccatttattgaaatgagaagtttcagtttataattataattgtctttttttccttaggacaagacttaaaacctgtcttggatagagaatatttagccatttacctaaaaatggtattttttacatgcaatgcatgtggtgaatcagtgaagaaaatacaagtggaaaagcatgtgtctgtttgcagaaactgtgaatgcctttcttgcattgactgcggtaaagatttctggtaagcttcacagaattcatgtagatccatagtaaatccagatcagttttggaagccttggcgccacaaagcttggaaaaatagtggcaaatttgaagaatgaaattaagactaaaaactggtatgttccattgattaaaactggtgtgattctttcaaatgtgctttactaggccgggcgcagtggctcaggcctgtaatcccagcactttgggaggccaaggtgggtggctcatgaggtcaggagttgaagaccagcctggccaacatagtgaaaccctgtctctactaaaaatacaaaaattagtcaggcgtggtggtgggcgcctgtaatcccagctactcgggaggctgaggcaggagaatcgcttgaacccaggaggcagaggttgcggtgagccgagatttcaccactgcactccagcctgggcaacagagcaagttaaccccttcttgggggggagaaatgtgctttacgaaacaatttgctttttga

SEQ ID NO: 110515 - DNA, 2032 bp, Homo sapiens
agttttgctgttgtttgatgtcattgatgattttaaacaaaataagggggattaactactttttgttttatatttttggtgatgcatctgacttaaagttttgtaaatggttttataaagtcactttaaaaaggtgcatacttttaatttttatttcaactacatttttatatgacaagccatctgtctctaaagaaagtatagtaattttggtgcacccagaatttcaaattaattctaaaatggataagctatatttagttgtctttttagaattagattaagcttattttttgaaagcatcatataggttaatttagactaacctaatatactttgaatgattctacaagttctcttggaaggaatttgagtgtctaatttttaaaattctaatttgggagtcaggaagtaaactttttaataagaatcagctttaaccatttgatattctcaaaagaaaattcttccaatttaaacattgaattttcaaagttttgttatcttaattcatgcctctttctctttcccaaaagatttttttaaggtattctctctctctctctctctctctctctctctctctgtgtgtgtgtctctctctctctctatatatatatctccacacacacacattatgttatacaatacatatatattacttttcttcctataattaaacatgagtttaatagcacattacagatgaacaacaattaccttataggcatgagaagtaacatgcaacaggatgcttccacagcagctgcttttacggtgtttgtgtaattgtgtttgttgatgtgaccttctgttatcactatggattcacagtttgcattttacgaccttgtattattgggagatttctttgataattgtgaaggccctttatacattttagtgcatttgaatataaagtactgttattatcactagtagttcaaaattattccacgtgaaggcaatatcacagacttagttttgccctgaaaaaactttagatgattctgtttgcctaaatctcctacagcctaatgattactgcaattttttttttttttttttgagacagagtttcgctctgttgcccagactggagtgcagtggcacaatctcggctcactgcaacctctgcctcctgggttcaattgattctcctgcctgagcctcccgagtagctgggactacaggcatgcgccaccaatttttttgtatttttagtagagacagggtttcaccatgttggtcaggctcatcttgaactcctaacctcaagtgatctgcccacctcggcctcccaaagtgctgggattacaggcatgagccacaacgcttggcccgatggctgtaattttttattgtgaaacttacctgcttagcttttaaaggaatcaaaaattgtttattctgggagaacctctttgaatgacagatacagtcatggcaaagatgcttactggcacataaatattctaccgagaagggcagcaattctcaaagtatggtctggggaaccctttttgggggtctgtgaggccaacactattttcaaaattgtctaagatgttagttgttttttcctcctcttatgagtgtacagttagtctgcccaaagctacatgatgtgtgatgaagtcctcaccctggtggcctgtgaagtgtgtatttacctgttctaaaggtcactctgttttcatttccagtatggtagatatcaatagctatagcccatattaacaaaagctctttaggacctcaattttaaggtgaaggggtcctgaggccaaaaagtctgaggcctactggagtaggattgttaaccttggtcatttattagtcttagtaactggtgacctctctctcttttcaaattcttatatttcttatgggggctttaacttattatctgtcacccccaataatttcagacataaatgtagtttcatttattgcaatacagaattaatgtaattattaatttattattaatataaatataattattcagggtcaaggaagccattagaca

SEQ ID NO: 110516 - DNA, 1107 bp, Homo sapiens
caagccccaacgatatagtaggaagggaaaacattattgttactttttaaagaagatcttaatgaaaccatttgatttcagggaaatggagaaaatgagaggttcttagtgttcaaagtctattcattagcgttatatagattaaaggcagtaccatggagtgtgcttttaaattcagatcatgttctgtaggccacatttcagaacagctgtggtttttttgtagtagagtaccattcttagaatctgttctgtccccaagcgcagttacttagttattgaaattagaggtgataaagaagtccgcagaggagcacatctcccaaaatgaaatcttactttctctcgtgagaaccaaggcaggaagactgtggtgaggggctctttccttttcacactcatgcttcaggacgacccactgtgtttggggctctctgtgctcataccttgtgtggtgtgaaccagtgaccctgtgtctgttaggattggtggttgggtggcatcaggctgaagaataggtgagcgggatcgtgctgttcagcaggaaaactcaaccacaggaaaagaccacttccagaacgtgggtctgctctggatgcaaataaatacattgattttaacataagttttgtttggagaacagtttaagtttttagaggaaaatattacttttatcatctctgtgtagaaataaaggcaagagagaaatataaggaagtagacactccctattttcatactgttaggatgcagaatgtaatgccattttgaaagtacataggaggtcatttaaacaaaaaattattgaacaaatactagtaatgattttacaagttgttgttttgttttgttttaggtgagaaaccttttgaatgtaacatttgtgggaaacatttctctcaggtgggaatactcttatttattgttaataattggaaacctgcaacacagtgtttttttattggaaataagacatacttttgtacttgtgagagaagcctctaatgatgtctgtaacttaaagacttcagaataaattaggataaatcgttttcaagaaaacagatttctagttctttgagagaaaaatagcattttcatgtgtga

SEQ ID NO: 110517 - DNA, 1027 bp, Homo sapiens
gagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatattatatgtttcctctagcatttttattaatctaaagactataggggtataaaa

SEQ ID NO: 110518 - DNA, 1021 bp, Homo sapiens
ataggaagcaaggccataaggaggaggacaggcgagctgcagaggtctgagaagatgtgacacaagtgcctagggcagcacgtcgcctggatcaaggagaggggattgtaggatacggcgggggctcaggagagctgtagaaactagagaatggctgtttctcaccagcctggctgggctccctgtgtgtagtgctggaggttcaccaggtggaatggataaaggggttggtgggtgaaccatggccaaggagggtccacagggacagctaaggggatggatgcactgtaggtgctgggaggctgaagagctacacgagttgggatgagggaggagccagaggaggccatgagaggagaggacatggggaggaaggaggaagatctgcactcacgtgcggccattgtgttccaagttcactccatgtgtgcaatggggacaacagatgctcgctgagccagcctggcagaagcgtagtgcagctgatggatgggaaaacacgaaatgcacctgtaatggacttcagagctgatgccctactctgcaactgtgctgtttttctatgaaaatcctctcctcctcactggtctctcgttgagtatcttgtacttctgagttagagctgctcacgagtattcgagggtgctctccacacagtcctccgtgtagggtgctctccagtcttccgtgcaggcagtgctataagcagatcacctgtgacgtgccacatccccagtctcaccttgatattccagcgacagagccacgggcacatctccttcctgcagaggctgtcaagcccgctgggaaggggaagtaaatatttagaacgccctgtcaagggccaggcgccgggcaggtattttcaagtgagtgctcagatcagacaagccttgtgaaaatactggaagatgttcctctcatactgcaaaaaagaaactccagagaagatcctgagagggtgaacagctcacccatgaccttgccagtaagtggcagccaggagtcaggcagttctgac

SEQ ID NO: 110519 - DNA, 1050 bp, Homo sapiens
ccaacaccggcctcttaggatcacctgggtcctgttggccgacttggaggtgctgccttttcaatgacaaggcgtttgttatgtgtaaagaaaggcgttgaattggacggtctccagcttctgcccagcatggagcctgcaacattgtgtgggagtggggctcccatagggtaacaatggctcacccagctcaccgtgcccactgtttgccagccatggggtctcctgcacaccccatcatagacgcaggtgctgggccggcatccccctttcacaggaaaccaggcgttggggcgaatgccctttgcagggtcactgcgtgtggccgagcaggccaggaacccgggcttatctcacttttagtccctggcatgaatggctagttcgtccatcaagtattttcaaattggttgaacgatggagttgctggtggtcgtggttctccaagatgcttccgatcatggcatgttgttgtagaggaagcttaaaagatactgcaaggtcctggaggaaacgccgatgtctggctcagtaacatcatccaatgttccagaattcttctaagtatctcatggggagggggcagggacttaggaaagtctccaaactgtgacacttttatttcactttaattaggaaaaaagagatgctgggctccttggtgcctgcattcacgattggtgtcccgatagaggctgggatgttccagagccttcctggggcagggggcctggccagggctttgaagggcaaggagagagggcagggcagcctggcatggtgcggaaggaacggggtaatggcagagagaacaagtatgggggaggggagccagtcctgacccctgtgaagtcactctgctgttaggggccctataacaaagtaccacaaactggggggactcagagcaacagaaatttactcccccactactggaggccagaagtctgaaatcaaggcttcggcagaactgtgctcccttggaaacctgcaggggagactctgtccttgcccctcctagttcctggaggttgccaccatccttggctt

SEQ ID NO: 110520 - DNA, 1029 bp, Homo sapiens
aacactgccccgcatccagtgttcaggggctgccactggcaggagggcggcgctacaggagaagggaagctttggagccaggcccaccgtaccagctgagttcacgtgcggagtgttttctctctcaatctcaggtccctcacctataaaatgcggccaatgagtcacaccaccgtgttgctgaggactcaagtcaatgcacagtggctcaagtaaagaagccaggatgtgccccaggtcacagtgtggacagaaaagaaagccaaaagacaccactgaagtacagcccttttatcaacagcgtcttgatctcagtcccaccaggacgtcgggaagcacctgacacgctacagaacaaacagcccattcagaccagcagcgcgtgcatcaggaaggaggctctgcaggccagacaaactcccctccagcctcaccgccacgccccttcacgctgtcctctccatctgctgctcgtcatccctcagggaaacggaccaagggttcccctcttccctcccacctcggcacccagcagagtcctgcaagacctgatgcggccaacacctgtggagtggcggccccgctcagggctggcatacgagatggctcagaaacggccctgccctacaggtgccccgcccagggagaaggacagatggagtccccagatgcctcccagacaacgtggctgcccaaaggcaaggctggggaggcaccttggtgcccatggtggcgagcaccccagggggtgaagggcttcccaacggaagcagaatgcagaggccttgccgtgagcccacatgggccagggaaggctttctgagaggctcctgccgccccccatacccatctcatacagagccaccctcacctgtggggtgtgtgccttgaggggagcgtgactcagctgggcctgcacttggaggagcttggggaggttccccaacttctctgggcctcattccctcacctgtgaagtgaagctgatgacggacctgtcttgtggggcacgggaggactgaggtagct

SEQ ID NO: 110521 - DNA, 1042 bp, Homo sapiens
caagatcgtgccattgcactccagcctgggcaacaagagcgaaattccgtctcaaaaaaaaaaaaaaaaaaaaaaaaaagtgagtctggacctgaaaaaataaaaaatgaaagcttagaaagttctagacagaggcagcagcatgagcaaatgctcagaggccagaaagcctggagattgggtgggatatagtcagtaaagaagacccgtggggatcagtgaagcccatcagtgggaggagaggtgggagtaagcttggaagggtgggtagggccttgaatgccagagtagggagtctggacttgcctctgtggcaccagggtgcacgggtggcctgggcagaggactggcatggtgggtgctgtgcttcaggctgatccttagggcagcctatcaagaaggcttctgatggccacaaatgagcatgttgtagagtgtgagttctgctaagaaaactttcccattctagctcagagttaatttatgcttggttcagatatgaacaaggtttctgtttctaattttgatgtttttttccttaaaaaagaaatcaacaacagtaaaagcttgaaatggataccataatgaggacaagtaggagacagctcataaggtgggggtggggggtagatgaaagtacaaatgttcctacccaaagaatgtcatctcaggaaaatatcagatcatttctaaagatacttttagccaaccttttacaaacacatgtttttctataatgacacttctggtaaaaacagccatttttctaaaagcctgcatgcactaagttgtggatgacatgcagttttttttgtaaagatatatttctaataaataaccataactttcaggcatggcctgcctagtgagctttctctacattgttgctatcattacgttctcttcccctatttaaagatctggacttgttgccatctcatggggctgagactgactacaggaaatttactgagattgaggaaaaaaggaaaaagaagcagtatttgcctttgagtacttggaagctcactgataagccctg

SEQ ID NO: 110522 - DNA, 1042 bp, Homo sapiens
gcagacagcgtctgtcctgtagtgaaacatgcagagatgaaaaagatagtttctcacacactaaatatttatcgagcagatgaaggaatgatgcaagtcatcgaaaatgccatttggaaagaaaaagagaaaaaaacattataagcaacacttctaaaacgctttctggaatagactccagctctccatagacagtgggagtacaggtgtcttgtctcgtctcttcccctagctccatttgcactggctttaggatggcattttaccgtaggactcatcttcaaatgtattatgtaaattaatgaaaaagttggatttgacagataagataacatcattaggagcatctttttaggatttcatctttataaaacgaggggtggttgcctttcagaagcattcctgtcacaaagatagagaatataaaataaatcctgcttttttttaactttgtcaatatatgcaaaaatggaaatacttcttataaattctccaatagagaaaaataattataccctagttgaattttaaataatccttgatgctttgtctacttgcacttaacatccataggcaattttatgcttttaaatgcacttcatttgcattattttggaatatactaaaataattattccgatgcatagtaccaagaaaaccttatttttaagctctgagttaaaaatagttggttaacactagatcgcagtgtcaattttatttctaaaggtgtgtatgtgtatcaaatactgatttgataggctgtaaaaaatggaagctacagtgattttgtaaaactttacaaaacttgtataaagctctcaatttgtagcttctttctttagtatctgacaagttaggttgacgaggtggttgtaaatatctttcatacaaatcacttattaacttcccttttccttgaaaagaaatccagcaaagtaaatgcttagagtgttggtttgattcacaccactccttacgaaccatgtgaatctgtgaaactcagtgtcttcctctaatgctacaggtcagcaaataacag

SEQ ID NO: 110523 - DNA, 2193 bp, Homo sapiens
tcagtaatgccaaataattgtagtttggggaactagaagaatgggaatgaagatgtttaattagattgaagttagtaagttggggctggaaggagtgaggaggaagagttgagtgcataataaacatttgtttttttctatgggtgtaagagtcctagaagtcttttaaaatggaagttgcattgagtttaatgggaatcttaagcattataaggtgccactcaacttttgaaattaaatcatgagttctttgtgtcatcaacactaagattctaggtttttgttttttttaatttctgggtttctttaaagatgataggggcttaatattagaaaggaagctatacgttccaggttgttagaaagttagttgctaatatgagaaattagactgctaaatccacctacctagtgttaaccacccatgcccccctgttaaccagcctcattgtctgttacttgagactctctgcagtaagaaggttggatctagaaaagtcagtctcctcttttgtgcacatgttttctctccttctgtctctaaaaagacatatgctgaattctggaagccgcagtcccgtaagattagtattggttcttagcaataggttatttagctattgattatacttttcctaggttaagatggccttatttattttttctggtaagatttccagactgatggaataaagaacttgatatattcagctaacatttatcacttacagcttgcctcaaggaaggtggaaagtgaacccagaatactatattttaaagcctccttgggcctgcaattttgagtagaagttgagtgatgggaatgaagacattctgggcagagagaagcaggtgccagagtgcagggcagagaagaggaggcttgcttaaggaaaggctctgtggtctggcacgcaggtggttgcaggaagtgcaggaacagaagctggtagatggagctggctcctttagccagtgtttaacaaggtgagtggatgggactgactgaccaatttcatttgtagggtgaaaaagagagaagagtgtaaaatggccaaggtgttctaacttggaatctagaaaggatgaagactttctctttggggccgtcagaacaggagggactaggagtaagccagagggtgtgagtggctgcatgaggataccgttgggacatattgcttttgaggcgtcagtgggacacacagtggcagtatctaaaaagcatttggatacactcagcttgaacacaggagggaggcagcggctgggtggacaattcatgtagacagtaaataaagctatggattggaatgagtgagcttagcaagaacatgtaaagaaagagccaagggctgaacttacaagaagtttcagagattaacaaaggcagagagggaatgaatgaaggtgaagaaaaggagttataggttttagaaaagaacctagagacagtggtgttctggaacccgagggaggctagtgcttcaggaggggacaaggaaggaggaggcaggagcagggaggagagccatccgagtttggtgaggcctggtgaagagtgtccccctcagtaggaattgggggaaagtgacaggagttgcttactcaacaactgctgaaagaaaagaagaaagcgagaaaggaacagttcctttatgtattccctcaacaaactcgctgctgtggtcctgagcacagtggaatgtctgtggctgtgctagcctcttttgtgggtgattggtcactggggagcttcttttgcacagggataggactcagacagtccccactgtgacatcagcaggtcaacatgctccagaggtgtgttagttctgaacttttagctctgacttagtaattgctattgatgcatttttcaattaagagtgaaaggagttagactcggaatttagtcagtgggctccaaattaaacttgggtacatgatccttgtgaaaaatcactttaacttgtcagtagttggcaaacatacagcagtggtttttctggctgtgcctttggctgcatactaactgaacagcaagctgtgtccactgattgaatgaaaaaaaaataatgattttgtgttacagggacctttttacaatatgccagagggacctactggagtctctttaatcttgaacaatgcttgtttcttgcagaggcaaattatgcaaatcagtactta

SEQ ID NO: 110524 - DNA, 1167 bp, Homo sapiens
agaactcatgtagaatgaaaagatataatttgagtctcaaaatcaagatctttaatatactgctcaggacctaactattatttttctagtagttttcacacatttttttccggcaaatgttatgttacggagtgattattttgtgttactttgtacacttaaggagcaatccatttttagcagttgagccctcattttgtaaaactaagctgttggcaatttgctagtttctttaaattctagaaaccactaagttttaccttttcatttatttccaaacaaagaagatgttagaaagttctgtaacttatctcttgaaataatattttctggccgggtgtggtggctcatgcctataatcccagcactttgggaggctgaggcaggcagattgcttgagcccaggagtctgagaccagcctgggcaacatggcaagacctcgtctctaccaaaaaaaaaaaaaaaaaaaaaaaaaaaaaaaaaaaaaattattttgcatgtgtattgaagtgctttgagtttcttgccttgttcactccaaagacgatcataatgactttcctcattataggaaaaaggaaaaaagggatctgtatatttttgaggacagggaatgatgaagcaagaccctggactttgcttggaatttggacatttgtattattggtcaaggccagcatactctgcattttattcccattcacttagttgaaagatgactttggaggcaaggacatatatcttgttaccaaaccctctttctcagaactttgagataaaatgaacattcattcctttgcttttgtttttgctaaaagagaaaaaaaatcagtttgagtaaagcaaaaacatttctacttttggggtttgaatgataacaaagcagttgagattaaattattgacatctgacaagcagaatggatgttgaatgtatgttcttgctatgggccgcttgaagttgcttttgctattctctttgctgatgtgaagcagaaaatgaacaaggtaacagttttgatggtgagattagaggtagccaggctgactgtctcctggctcttagagacccttataagctcagggccaccccctccccttgtttagatattacttgctcttttgagtttcagattacaggagcaattggtctgcatgacctatctt

SEQ ID NO: 110525 - DNA, 1260 bp, Homo sapiens
ttttttttcactgataatgaatacagggaaaaactttttatgtaaaatttgactccaaacctgtgaaccttttcagtttcatttgaaaagatataaaaggaaaagttttatccttgagtagtcttttatgccatgaattttcaagaacagaaatattcttttacaaggacagtttttattgactcctagcttcttgctaacttagtaacactgcccatttccctaaattctttttctctgttttcccaattacattgttttaggtaatttttactgtttttcaggtaataagaaggttccactcaaattctttactaaaacaatgttagggtggttttggtacattttatactaatgtaattttcaccaaattaaaaaaaagtgctgtcatttgtttcccttttgcctatagtgctttcgaggtatctggcagatacttttaggtatattacacctaatagaggtctttgtgtgtacatcaaatgagtatgttctatgctgtttagacatattaactgcagattggcagcttcatctttccattaatgtgcaggttcttaatgcttaggagtatcctggagctttctgtttttctgagaaaatctaatacagattttcagttgccttttaaaatgctatacttctccaggaaaccttatctttaatatagcatctggttttctgtgaagttacaagtttgaatcagaatttccagctgtggcatctggttttatggagcctgaattgagaatcaaaaactgggttatgtatttaaataccagaagtaaatgttatctttctttttataaaacagtatggcattcgtatttaagtatttccaatttgccgagttattgttcatgatctgcttccagagaagcaagattaaataacagctgaacagctttaagtgaataggttacattttgttattctgttagtgtcctgtgatcccaaacactcggtgtctccacagcaaaagataagaatcataaaatgttagaacgcaaaacagtctgagaggtcatgtagtgtgactcccctcattttccagatgaggaaactgaggtcttattttccctcatatagattttccctcacaaaataatcactaacgagtgaaagaattgggtttaattgcattagaataatcatgttgtttactgtttttaaaatgcagtcattctgaccgacagtgagagagaggtggcagcaatggtcctggagtgtggcctgcctgcctaggaggctgggaggggt

SEQ ID NO: 110526 - DNA, 1050 bp, Homo sapiens
tgcctatatagtgttcagttcttctcagctgttttacagctaatgatttggttctattagggagaaggtaatacatgcttattttcgcagcatgttaattctattaactgttcagtaactgactcgggaatggaaggcacctattggtccctagtggtctgaaatgggaaatgcattccctgaaaatttcattaggactttccataaagcttaacatttgactagaaacaaaaatgttagtagctttagatagattgattaggttatttaaagtgttccttgagctacagatgaagttaataattttcttaatctcttattaaaaatagatgaactacatataaaaacttcagtcctagattagcacctgtatttcaagtcatttagggaatggtggaaaactctgtaaatgcttgtgtgttaagcatattgagtaaactgtcaagatttttctctttgtcatctttttgtcagctttatcatgcttaattttcaagaaaataatgtgtttgttactgtggtcacaccgtgattttgcattggcttatgtatgatattttattgtctctgtcctagaaaattatagcagtttttatgaggagtggtttgtgggttcacacaacccacttggagtgccatttactacaattctcttctaaaagaaccataaaacatcatgtaaattgtttaaaaagggaaagacctttttcgagaaaggctaagaagaaatctttccaggctttcttttgtttcttatagtcagttttatgattttaagctcccaatttatttagagcgttaatgtcataaaataaagtgcacgtgtgtataagtaaaccgttgtgagctagagctaggctagaactgggtgttgttgatgcagataatatcaaattcattattttataatcttttaagatatgttttctgtgactttggaaatgaaattaaagaaattaaggaagaaaggaaaagagagaggaaggaattaatttatagcttgtatatcttttttttaaaaacccttatgttttcttaagtagtgatgtg

SEQ ID NO: 110527 - DNA, 1120 bp, Homo sapiens
aacacatgtgtttgtacatttctgtctctctgcactcacatagctgctggccagttaatctgaaatccaaaattagtttatttgtacttaaataatttgattttctggaaactctgctagttccaatgcaacaatgcaagtatcttgacttcttgaaggttttccagattatttgctggattatttttttctactgatgattaattttacctctgactttgttatacttttctttgtttcttccacacttcacatattttttattgttcctaatactttatagcatacagcttttatttatttttaaaatttactttctcagaattattcctaaagttctggagtgctctgtgagttgctcctccacatttcggtcagtttctagtgtgttacttttaatcaggctagttttctcatgcatctaaaggaattggcaatattctcaactcctccccattatggtcagggatatgaacttactgtcttcttctttcattttcccaagtaaatgtcttgaaccactgattagatctgtgtgcccacaataacataagcaggcacgaagcttaaatctgatttaaaggagagggctgtatagtctattactccattacgtttttttaagtgtctagattaaaatagatcagtattcagggtgtgagtatattgctaagtctcttaacactcattgaaccagacgtcgtgtgtgttcatttttaaatgatggggtggattacttttatatttattatgaacacaaacactgatgctaacaactgacatgtgaaaggaaagcaggcaatagtgatgaaaaccatttaatgattagtgaggaaacaaatattgtttaatgaaaataaaaaccatgtctaaagggcctaatgctgacttttggaaatataaccatgttgcggtcttttgtgtaccctctgtcctgtacagtagatattgtttaaaattgcttgggaactggagcttgcaattgtgagcctggaatgtcctgcagataattaagttgtggtcaggctttggaaaaataaaaagttctcgaactatgattttataaacatgctacaataacatttctttatatttaacagtttcttatagaaagttgata

SEQ ID NO: 110528 - DNA, 1051 bp, Homo sapiens
aactgcagagatttcttgtagaataaggacactttgattctaaataaggtaataatgatcctgaattgctgggaactctattttcagattaggcatgcagatgagattttgttcttgataatacattcttttgtggaagctaaacttcgttttttatttacttatttttaggaattgattatcttgaatctttggctgaaattcagagttcttggagtggcccaaagccagatgatctggccctgctccctctctggcctcacctcctctccccctccttttgctcactctactccagctattctggcctctttcattttctcacatgcatcaggcacatttcccgcttagaacctttgcatccctctacctggaacacttttctcctagattccatatggcttgatctctcagttcctcaggtctctggttaaatgttgcctccgtgaggccttccttgaatgccctgcgtaaagtggcctcctttttctgtcccttcccctagcagatcatatatccatttatttgttgtttgtctactcgaatatatgttttctgaaaatgaagaactttgtgttgttagcactgaatctgtagcttctagaacagtgtggggatgcaggtgcttaataaatacttcttgaattaatgaataactgttaatctactgtctctctcagttttggggctaggtgatctctgtccaaggctcattgcagttctaaagctctgtgatactcacatgattcttgaatattacatgatgcacatttatacttagtccggtattaagagtaaacattcagtaaatagtagcttttattactaagattccgttcctccctcaacacatttacattctagtggaaaagcagacacaggtagcacaacaactcaggtatgagtaacaactgtaacttttttagcattgattccccaggtcctccttgatttccttttcagaggcagtgttgactttctgtgccagtgttgggacccaaaggttgagctgggaccacctggattataaattttacctaagggttgagta

SEQ ID NO: 110529 - DNA, 1036 bp, Homo sapiens
cagggaccccgggccccaaaccagaccccgtcccgtaagcattgtgtgaagggggtggctctaagggggacagaagagttggcctcagagaccctacagctttttgggggaaggaacagccttattttgaggaagggggacgcatattggggaacagatttctcctgcggcgacagggattgggggacaagaaaggagatcctcagaaatctctatctggaaagtgcatgggcggctttgtgaggtcatgagttcgccgtcactacagacttgcactcaggggaaacctcctgacagtccttcgcttcctgttgcagcactgaccacaccatatttgcctgttctatttacttgtctgcctcccacccctagttgagattaaaaactgtattcagccgaactctttcttccctttgtctctgcaataagtaggactcagttcctcttgagacgggtttagggtaatctttcgcaaacacagtgttacagtcacctcaactactttctgttccctgatcagagcaggtgtcccttcatctccctgggaacaggaaccttttccttaagggcagggacagtgttgttttcatctcagaatgcatgactcatagcattgcttagtaaatgtttgttgaatgagtgaatgaacaaatggctgtctttcccattaaacagaaaactccataaggggagagctgtttgtcttgttcccttttgtgttcgtgacaccaaggaggtatctaggttttgtggggcctacagcttatatagttctgtctgccctcttcaagaaataaaaatcaccaagaaagattcagagctttggaagattgaagagagggaccctaaagcttaagcctcattaatttcacagtaaatccttctctgcttggcatacacttggcactgtatagacactcagatatttttgaatgaatgtagtcatgcatgcattaatgacagttagcagaggatacttaaacattagaaaggggattggaccagatgaatacactcgccctattgatgaccgtct

SEQ ID NO: 110530 - DNA, 1263 bp, Homo sapiens
taggtggggaatgaggctgcaaggaaagccatggccaggatgaaaacattgcaccaggatgcagagctcacagcctcagcaaggatgcagaggaggccaggagggcatctgggagcccgagagcctgctgaaccatcatgactgtgtagatagcatttgtcctgagaaaaggggtaatgttttccttatcagagatactttttatcagagtatctgaccccaaaatccaagaagcgctgctgagggtgaatagagtctgaccagggtgagggggagggtggggaagagggaacatctgcgggtgtgggcaggaggccacagtgtcgaagagccttcctagtggccttggggcccagtatagtcaggaagtgggttgtggaccgcagtcagagggctggctgcatgttagggggtcagaggtctggttgttggcgtggtcagagggctgggtgtgggctggtcagaggaacaagagggagccagaaggaggccacctctgccaaacggaatgtccagtgacaggatgacagttacatgctctatgctacgctcctccatggaatattaggagccaatcatattactattattaataatattaaaaataaaaccaggtttcacagcctggttttcccagtgtgctgcctgcctgcgtgcacggacatgcaggtggcaagtattcaaggtgactctggagtaggaacgtgtgtggctgcggggaggccacttctgcctgcctaccacccctgtggaccttgtttttggtgcttccccttcagccagcttagtttgggaggccagtggggagagatggacaggccaagctgggacgaggcaagagggcttcaggtcaatgtcaccatgggcatgagcatggcctttctttgcccagcctcatggccaggcagcctggatgactctggagtcccaggccactaacccaatctctgagggcagggcatgcactattcttgtgtccccagcagctagcatccggccattacatcagttatgagtcttgggtttcaagcaatgggaactgaataattaatccaagcaagaatggggtgtattgagggccatgtcaaaatccaggaaagagccagtgttcaggcctcaggaagggcagggccagggaagcactctgggcatcctctcgggtgctgccttcagaagaccgcccttctctgctccaggagttagactcctgggagagagcctgcctggcccagtgtggaagaggctccatctccaccaccacct

SEQ ID NO: 110531 - DNA, 1019 bp, Homo sapiens
tgggatccttccagttctttcttctgactgcagagtggtatcctgtggcatgggtatagcacagtgtcttcaattgtccactggtttagggacacttctgttgtttccagagcctgcactgctcgcctggtgcctaatggcctcacagaatgtgaggaggaggagaaagtacattcattttgaatcaccctgctgcagggcttttgctgtggggatttgggtactgccccagtgacttgagagcagttggacgggatggatggaggctttagaagcgtcctggggagccaaggttgctgaccaaataggttttttttgacagctctgaaagttcgggaacatgttttccagactaagctactgaaatatttatcactccaggacagaatgtcctcagaatgtgataaattaaaaatgatggttcaagttgagaggcggcgagggtctgaactccctctgttgtttcctgtaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggtgagtgccgtggaggggctgcctcccggggcacgtccctgtccacaagggtccccatgagtcctcaaggtcatgggaggcccatgtattttgtccatactttttaattttgttaccaatttattttttaaatagaatcttaagaaaataagttcacccagagccataaatatttcatgcatgcccattaaagaaaacgtaaaaaaaaaaatgcataaaaagaggaagaagagaaagaaatatccatggttttatgacctagaaaaatgactgctagcatcctgttacatttcttcctccagaatgtgtttctctgctgggttttacaagtgtgtgtctgcaagtgtggg

SEQ ID NO: 110532 - DNA, 1099 bp, Homo sapiens
ctatcactccatgtatttatcatttctgtgtgttgggaacatttaagtcctcccttcttgttattttgaaatagaaaatactttgttattaactatagtcaccctaatctgctgttgaacactatgtcttatttcttctatctaactgtatgtttgtcctcattaaccagcctcttttgtctcccccacaaccttccccacctgtggtaactatccttccaccctctacctccatgagatccgttctttttgctcacgtatatgagtatgaacatgtgatgtttgtctttctgtggctgccttatttcacttaacactgacgtaactttaattgaaagcaaatccacgtgtgagtggaaacaggcaattcaaacccgtgttattcaagagtcaactgcttatctacttatctatttctgctttttgctttatctgaaacttgaagatttttgatatcaatatatgagagttcccttgttacttttcacagcggcatagcatttcactgtatatgtgagccttaagtgatttcatccgccctcaactactggatatttaggttgttttcaaccccttgatattttaaacaatcctagaccctctgcatgtatcctacacccctctgtagtgaagcaggcagagcaactattactatctccatttcacagatgagaatactgagtctcagaaagagtgagaggcttatccaaggtcacaaagctggtacatggtagaacagagcctaaagcacaggcctctccatgtccatccctgcattcggctagcagatccatttgatggatgcagaaatgaaaggacatttcagttcctctttggtgtgattcttgtgctgtttttgaacagcgtatacacaaatttctcacaaatagtctttaggaacacttaattataaatgaaaatgacataaccatatttcctcttcacccgttatttctggtcttattataatgatcttgctctctgtctgcatggcacatctaccatgtatctcttcacccatccactattcattcactgtttccagatttcatgatgtgtcgtgcatgcaccattcactagaaatgccttcattcagaag

SEQ ID NO: 110533 - DNA, 1019 bp, Homo sapiens
tctccgctgtcatggaagcattgcaagaacagaacagggacctcattcatagcgtccccttctcagagaggctgacaggtctgaggtcccgtggctagttaggaggtggacacgccttgggtctgctctctgactgcagagctgaggttctgcccagcaggctccctctgctccctttggtgggaggagcccaccagattgtgtgaagatcaaaggctctgaaactgagctccttccagaagaacatacctctctcctcccctctctggcctaaggcagagttttgcagttctgggagctgcagaaacttctcttgacctgcaaagccctcgggggagctgcatggacttgctggtgattgccttcttacccacgtcttccccaacccctctccagcaacagtccaaggtgagaaagtcacggtccaagagtaaaagcaagggagagcttctgaagaagtgcatcgaagacaaaattcacctctgtgaggaacaggcctctgaagacctggtggaaaaggtcagtacatctgcttcacccagctgtttctctctgcacatggcggggctgctctgatagctgacacatttgcaggcacacagagcccttggggctgtgccatccatctccacccaaccgctcactcactcaggtgctaaggtaagaaagagttggaagaccctccccctgggcctttcccctgtgcattctgtttggaaccctctccctccacttctcagtctggggatctcaccggatccttcaggcttcacctcgggtgctgcctccactggctgagtcacttgctgtatttgtgcctggctctatcctggggcgtgtgcacctgccatttcacctccatcacattctttttctctctcacactctcctccatgttcccacaaactcaccaggctctcccttcagccccatttttttttgtttgtttggttttggtttttttgaaatggagtcttactctgtcacccaggctggagtgcagtggtgtgatctcggct

SEQ ID NO: 110534 - DNA, 1029 bp, Homo sapiens
ctgccataataaatcaccacaaatttagtggcttaaaacaacagaatttttttctgttatataatagttctggaggccagacgtccaaaatctagttgtcagtaggatccttccatgtttggttcagcttctggtggctccgggtgttcctggggttgtaactgcgtcacttaaatctttgctctgtcttcctgtggccttttccctggtaaccctctcatctcctgtctcttataaggacatttgtcattgaatttaggtcccacctaaataatccaggatgatctcataagatcttaaattaatttcatgtggaaagacccttattctaaataaggtcctgaggttaggatctaggcatatcttttttggggggtgggagtgtcaccattcagtccactgcagcctccctcaccgacactgccctgtaatgcccagtctatgactgtgctgctcaacatcccacatccttgagccgagcccttaggaagaatgtattgaatgcactgttcggtgattcagctcctaaatgatcccattatctctcttttgattctttcctaaatctgttacaatttttttttttttgttttttgagatagagtctcactctgtcacccagatcgcagtgcagtggtgcagtcttggctcactgcaacctccacctcctgggctcaagtgattctcttgcctcagcctcccgagtagctgggattacaggcgcttgccaccacgcccggctaattttgatatttttagtagagacagggttttgccatgttggccacactgatctcgaactcctgacctcaggtgatccgcccaccttggcctcccaaagtgctgggattacaggcatgagccaccacgcatggccaatttttttttacctttaaacgtaatacatgctcaataagggaggcttcgacagtaccttaaggcagtggtcagcaaacaaggacccatgagcccaatcttacccagcttgtttttatgtggcctgcaagttgagaatgtttttttacattt

SEQ ID NO: 110535 - DNA, 1036 bp, Homo sapiens
gtggggtggctatcatttacaataatctattgcacatttcagaatagctagaagggaagaattctgatgtttctagcataaagaaaagacaaatatttaaggtgatggctatcccaattaacctgattagatctttgcacattaaatgaatgtattaaattatcacatgggcccagaaaatgtatacatctgttacttgtcaattaaaaaaaaagacgtcagctttaggggacgttcccttcctggccttttccggcttcttgaggctgctgcctacattcactgacttgggaccccttcttctatctccaaagctggtgtcatcactcctatgtcggcttccttcgccacagggcgttctccaactctgacccctcttctgcctgttttcctattttaaaaggccttgttcttgatctcaatcttaaggtcagctgatgagtagccttaattcccctttgccatgaaacctaacgtgtttgcagttctggggattaggctgtgaatgtctttgcgggggcactgtcctccctgccacataaggcttcgtttaagatgtgaaatccattctgtctgtctcagagtagagaagggattttgttttctgagcttgtacaacattgattgtttagttcatttgacatttagccatacacacactgctttgaggcagctcttgtgtttctttcttgctttgtaacctgcaaagcgctcgttgcatagacacatgttcaataagcactttttgagaaaatgaaagaagcaaatgaatgagctgttgtttaaaactaggctaagttgtgtcttaaggggacggaagctattttaatctaagatggtaaaattcgagcatcaaaaagaataaagaccgcagttgatcaaaacctaccaaatatataaaaatcttccatttcatagtgacactatgcagaggcaggggtcttcctaggttcagctacacatttggactcacaggactcttacagggcacacgtggcctcatctacccagaaggcttgaggggctgcagcaccgc

SEQ ID NO: 110536 - DNA, 1038 bp, Homo sapiens
ttgtcggtcaccatgcggttagacaggtggataccatgacacactttatttttctgtttcctgtatcttctcagcagaggaatattagagagcattaggaatagacccacagcgggttggggcttggagaatcaagtgcgtttgagtgagagaagaacacgtgcagtgcagtcagagcccaggattccatctacctctgtgaaggaggcagacgctgggagagtggaggtgacctgccttggtcacaggcttggagtcagtgcccaaccccaagcgtttctccacaagggcatgctgccatgactttctctggatgttagcgaagctggtgtttggatttcacacggcctccagtagagagggagggatcctatccccaaagccccttcctcctgatggtgagaccttcacaagctctgacctgtgcagcagttagggctgattgtagctccaggcttggagggttggaaatcgcaccaaatgttatcccacgtgtcagaccccaaactgttgctgaaagtgttttcttttttccttttctagaacagaacacagctgaaagtgcttttttccataacagcagaagaaaacgtaacggtaagagacatgacatgccctgagcaccctcaggacacacctgtgctgtgtgggtcctgcctgtccttggagccatggggagcggccagctgctggccttggtcccccagttatgcgttgagactgggactctgtgcagtctctcgggtcccccgtgtgccctgaggctatctgactggtttccctggatgaccctccacctggacaaggcaggtaggccgtgggctggacaggctgaggctccacagcccgtctgtgctactgtccagtcacgctcctacctatccccagtgtttgccactaggtcaagctgctggtgacattgtgttttcccagatcttcccaaagcctgcagtctgtggggcgggtctctctgcttctgctcttcaccataatacttctccatttctgttcttcagtttaatcatttgcagctcacat

SEQ ID NO: 110537 - DNA, 1042 bp, Homo sapiens
tttgcacaagctcttccttctgggaagccagtgtcagaaatcctggtgcacattggcctctgtcagccacagtggtgttgagggtggtccctgccagaagggagggacggtgcctactgggaagggcctgaagccatctaggaccatggtgggtgtagagtacctcaccctcaagggcaacccctgcctttgcaggaatctgggaatgagcacctgtattcaggtgcccttggcatcttgagcacgtcccctgggccctggccctgcccacgcccatcccagctgttgatgggaccagccttcttccgtctctctgggcctgtcttgcatagcccttctgcacactgtacaggaaagagctctggccatgtgtgtccctgccttggccactccctcttgtggggcctgggacaagtcacagccctcagggtctctgcttcctcttctgagcaatggtgtaagggctgttcccagagcacagttcccgaaggcacaggttagttcttcctattgtaattatatgatgccttcatgtaattacttgataccatctatccatccattcattcaatattatctatgtatgtatgtatgtatgtatgtatgtatctatctatctatctatgtatctatctatctatgtatctatctatctatctatgtatctatctatgtatctatctatgtatctatctatgtgtctatctatctatgtatctatctatctatctatgtatctatctatctatgtatctatctatatttattgcacctttgctaagtcccatgctgtgtgcagggggctgggagaccaatgcctaattgcacacagtgattgctgtgaggaggaggatggggagccgtgagagagggtggaggaaggaggtcatttagtctggaaggtcagtcaagacttgaaggatgggcaggtttagccagggaaggagtcaggagagaacatcccaagtggaggaatcgtcatgggtgtggcccgcatgtaggaggagcttggcatattccaagtctctggccccctgatgct

SEQ ID NO: 110538 - DNA, 1030 bp, Homo sapiens
tctactaaaaatacaaaaaattagccaggcctggtggtgcttgcctataatcccagatacttgggagactgaggcaggaaaatcacttgaacctgggagatggaggttgcagtgggccgagattgtgctccagcctaggcaacagagtgagtctccatctcaaaaaaaaaaaaaaaaaaaaagatgcggggaaggcctcttagccgactttccctaacatcgcatttcattggctctagacatccctgacctaagaagataggattcccatgactagtttaaaccagccatgcactctctgcctgcttcctgaccaatccaggttggtgagtaggtggaagatctgaaccagggcatggggaggcagggactggatgggccgtgggtggctcccacgtgtgacttctctgctgtccctgtccttcctttcttccctcagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtacgggaccccccctcagggaagccccagaagagactggcaatgtgtgcttttagtttggggcagaataggatgtcagatactgtgaattttatttttgggaatataattatttcagtgttttaatgtatttatcccgtgctttgtctcaaaaagcctttttcaaaaggcacttaaagaaacatatgcataagcacacatccagtgcagtgggagtgttttaagtcggtcactcaggacaaggataggatactgagatggagtcagggccagggcttatctagggcagcagtccccagccttttcagcaccagggactggtttcatggaagactatttttccacagaccagggtgagagggaaatggtttcagacgattcaagtgcattatatctattgtgcatttcatttctattattattacattggaatatacagtgaaata

SEQ ID NO: 110539 - DNA, 1142 bp, Homo sapiens
agggaggcttcccatggctggtcctggactgagccctgaatgaaggtgggtccagtggagtgcatggcagagtacatggcctccaggagcagcgtggaactgatgctaacagatcccatccagcagcgattggcgctctctttcaggtgcccagatagatgacaacaatcccaggcgcaccggccaccgcatcgtggcgccccctggtggccgctccaacatcaccagcctcggttgaacgtggatgcgcggaggagctagcctgaaggattctgggaatcatgtccatcccttttcctgtcagtgtttttgaaacccacagttttagttggtgctgatggagggagggggaagtcgaaggatgctctttcccttttctgtttaggaagaagtggtactagtgtggtgtgtttgcttggaaattccttgccccacagttgtgttcatgctgaatccacctcggagcatggtgttttcattcccccttcctagtgaaccacaggttttagcattgtcttgttctgtcccttccacttctaactccactggctccatgattctctgagtggtggttcctttgcaccctgtagatgttctaggatagttgatgcatgttactaaattacgtatgcaagtctgtgagtgcgtctgaggggacatcgccaaggactgactgagacacgatgccgagacctcaagccctgaggggcagtcccaaaacccttacagtgaagatgtttactcattgcccccacctctggtccacactagaaagaagctcgccccacctccacctgtgagatccgtgaattctcggaatggcaggggaagccttgcactaggttgcagagaagcatcctccacatcctgtgtcagaaaccctggtctccgtggcacttgtaactcaccgtgctgtcttctggtctgtgtgtgttcttcaagccagctctaggcttcaggccgagccaggttcacactcagaaagaggtctccccatccccattcggggctgacgatggggggctgatggctgcccctgcgtggcctgagtcctggtccctctgaggcagttgacggggcagtcagatttttaaagttttgtacaaagttttcctttgtaatcactcccatttttacttaac

SEQ ID NO: 110540 - DNA, 1137 bp, Homo sapiens
gtgatgggttgataatgatgatgatgatagtggcggtcatggtgatgatggtgatggggtgataatgatggtgatgatggtggtggtagtggtgataatggtaatgatgatgatgatggtgatggtaatgatggtcatggtgatgggttgataatgatggtgatgattgtggtggtgataatgatggtggctgtcatagtgataatggtgatggtgtgataattatggtgatgatgatgatggtggtgatggtaatgatggtgatgatggtggtagtggtaatgatgtggctaccattggaacacttgagtctgaagcatcatgatgcatatttctctgtcccagttgaccatgttgttcctgaacctgggtccagcctactgacctctttcgagaagtggcacgaagcagctgacaccaaatcctgctgtgattactccctccacgtggacatcacaagctggtacgatggcgttcgggaggagctggaggtgctggtgcaggacaaaggtcagttaaagcctcggaacggggttttggggaatcccttgttctttggtagatccaaagattatgtggagtgaaaaatccccctgtctgcatctgttctgagcctgattatgagctgcactctgccacgtgacagtgaggaaacaggccagtccctttacagagtccatccttttctccttgaaaacctctgggggtgtccttgttctcagaagcagatccagtctctgcagcctgctgtgcccaggcccttgctgatctaacttcacttttcttttccatcacccggatcactagcctggctgccatccctgaaactggctatgctgtgaggcccttgctcatgtggatcccctgccaggaatgaatgccctttctcctctgcctgcccagtgctactcaccttcaagacccaactcaaccattaccttctcccattgcttcattccttgaatagccaatgccggttacttaggcctcctttggggcactttttccattgttcctggattatgggacatggtttgtctgtctggctcttctgccaaaccctgagctctgtgagggaggggaccacgtctatatgtccctgcttcccaccttggctcccctctgtttgggttcaca

SEQ ID NO: 110541 - DNA, 1047 bp, Homo sapiens
ttcagtaactttggcttgttgctcatgtccatctgctccgcttgaccatggatacttggaagactgggaaattgtctgattctcctcaggagcccttcaggaacactggggattcacagtggggatgccacactgtgtgagtgagtgaatgggagcaagattgtggacttccttgctgagtgaggtttcagccacagctgcatttagtcttccttaacaaggcactgtctgtggatttaacatgaaggtagttactatgcagaatgagatgaaggtggcatgaggagttttggagctcaaagcgaaaagaaggtgtgggggcccctgaagtggtgctttgacaatggggagagggcagatctggtttagtaatgggcttcgctgcatttcacatggaatgggaagcttttgcaaaaggtactttttacacacaagtgggatcgtcacattgcacatcttgtgctctgcccagggccttgagtaaataatgacctggtgttggaacttggagtcaattccatgggaagactcattggatctgatgcagaattacatacagcaaaaaggtggctatttgaggaaattttgaacctgcccccaaattatgttgccatgtatttttaaatcataccatatccatagacccttagggcttaaggtctaataaaatctcagcaaatgtttgatttctataacctcaacgttgaatcgaacttttaaattatgtaaaattttatgttgtacaattaaggaggaaggaaaaagtgtctgtctactgcttctcccctgcccccaccattctcccctcagtgcagaaattcccagtatgttctctgcatacctccaatgacagggagatcaccactttacatggcaacctgctttactcttgtacagctctgttgttggaaggctcttctttatgtagagtgggattctgccttgtgccttacttttgttctcaagagtctccccaagtttcttcttccacactgctattcctagaggcactggaagatgtttctccattacttaggaccttctctt

SEQ ID NO: 110542 - DNA, 1126 bp, Homo sapiens
atttagacatgaaggccggtgcaactagctatgacccttgtcccttcctgtcgaggctgtgaggcttgaatcccttgagactaggagcaggagatgtagaagatcagaatgaactaaaccttatcaagacacagcatttccctctgggctatcgtttctggttacacgacatttcagtagtgttgagggcaactaacgaatggagacattctccattcgtgttttggtccaggcttggtgcttttgaaaacaccctgcaggctgggccatccccgtcatgcatccctgttcttccctagtgttttccaaaaaaactccaaggaatgtgattttagatggaacttagggtcccgcaaagcgtagcgcaataaagttggaaaactctgaaggacttcttggggtcttagcgtgctaaagggtgagttgaggctccgagaggaatgtaagcaagtggtgtgccaagttcagtgaatcactggaccttttttcaagggacatcttgcagaactggcatttcccaaaacacacttcggaacaccttggggtccacccttcctttgtctaagcaccaactcaggaaggcctgaggggcccctaagaatgctgaatctgcagaagaggcccctgcatgctggttctgccaccatacagaagctaccttcacacttggagtgtttgaaagcctgccatgggcactgtgctcccagtgggatttcagttgcatgggtagacaggagttctgacgcagcccctggattctcatgaacagtcaggaagtgaaatgctctgagagggtgacagggccatgtgtccatgctggggccaggacagcagatgccagatgcaagcctgtgtccctttgtcactgagctgagtgaggcggggcaggcccacaacgggatttccagaatcgagtggtgcgtttctatctggaaactggccacgcaggggtctcctgggagctcggctgctgagtagagaaggggtgagcctgcaggcaccagcaagctctgctccatgtggagcccacctgggggccccgcagctctgccagggaacagattccagccttctagttccccaagggcaactgttggggtgggtagagctgaaggtgatcatgttt

SEQ ID NO: 110543 - DNA, 1075 bp, Homo sapiens
tgctttgcgtgggagcatgcgttccagtccgtctgcgtctgcacgtgcacatgcatgcctttccgttctcttcatgacggaagtcccacatgctcactgtagaaaacccagagacgcaggaggaaatcaaaacccggtggaggaaacagtctgtcacttttgtgtatttccttccagtggtttccctgcgtccattgtttttaaacttagttgaaatgatacttgacatccagttttccatcaggctttagaaacatcctccataccatttaacatggttcataaacgtgtttaaatggctgtgcatctctccatcacacagttatactgttagttacttcagcccctcttagctgttatatatttctttctaccatcatgcagtggtaaactgcacattttttacacataaatttctatctacgtcttaaaatatgcccataagatatattttagaagcagaatgactgggccaaatagtaagaatgtcttgaaggactacggcattgtcaaaacagtgtccagaaaagcggcaccagataccctcctacctgcagccttacacgttgttgatttatgcttgacatggcatgttaccgctgaaaagaactttgcccatttgatggtgaaaaccgtatcacgtcattgttttaatttttatttcagtgctagtgatactgagttttttatgtgtattatctattttcttctccttccttgtgaattgtaattgcatttattttgagggttttccattggatttgttcacccatccatccattcattcatttgacaaatatgtattcattgtcattgtctttcttactgacttctctgagtgctttacatattaaaaatactaactttttgacctgtttgttacaaaacacattcctgatttgtttgccttttacactggtttatggtgtgttagaaatatacaactgtttgtggctaaagaccttttcctttcaaagcatatgggttcaactttaaaatgctatttttgcagtgatgaggtcttaatgatcttagttgggattctttccagaattgctggaagggcatttaaaat

SEQ ID NO: 110544 - DNA, 1003 bp, Homo sapiens
cagccgcatcagcaaaaaggacctgcagcacctacctcattcgtttgcttgctgcaaaccctgccctctcctgccccttgcctccgtggccagtcgtctgtttccctccagccactcagtcaggtggcctgtgaccaggggaccccagtgctcccacccatcctgttaatccgcaggtatctttgctctagatttacagactggaaatggaagagaaccagctgaagaatgaaatgcaagacgccaaggatcagaacgagctgttagaattcagagtgctagaactcgaagtaagagactctatctgttgtaaactctcaaacggagcagacattctctttgaacccaaactgaaattcatgtaaagctctcagatgttttcaagcatgtgtaaaggggacatgttatagtttctttctttctttctttctttttttttttaaatctgtatgttcagaataatttcactgccttaatgtgttctggagagcgtgctcacccaagtctatggacatgtaccagagctaatatatttattgcctatggcttgttttgcacttaataaaataatttgtttttgcaatattttgccttttttatttgtgtttcatttccataactacttctttcctgcatgcgtagtcaccgggtacgcattctgcacacccagacggaagcactgttgcaattaataacacacctttttaagtgatcttgcatgcagtaaatctcaccttttgaaatagcagagtctgacctgagccagcaattgactctagaatgtgtttaatgccagtttgggcccattttctatttgccaaggtaaacacaaggtaagtaaagacagggtagaaggatgtatttgcataggcgtttaagaaaactagttacgttgttcaaactcttttatccagtaaatacagacccaggcattgcagcaatattggactaaagaaattactatttgcaactcaaactgcacctcaaaactactggagggaga

SEQ ID NO: 110545 - DNA, 1071 bp, Homo sapiens
tactctccagctcctgactttctgtcagaaagaccctagcaaacctccctggactccctgcaggagggtgcctccagtccactcccacaccccagcttgcagaagatgcagtcagggcagagccttgcagaagatgcagtcagggcaaagcagagggtgtccacctttgtcttcccggagcgtttgtgtccctgagggccatgactctgccttactgggcctatccaacagtccccttatgggatctcctccagggacaagattggtgctgattatctcatttcccagggagcctgctggttcagcgtgggctcacgttagccccaaaggagaggttggaggagaaggatcctgagtggttcctcggactgtgccctggggactggggtagggggcttgctcaggacctgggcctctggccatgtggcagtaaattgtgttgcaggctattggaacttgcacagaagctgtatcatcacagagttctaagcatatgcataatggctaaaaatcagtacagtttacgcacacaccttggttgaaagaaggacccatcattttggataaggttgggaaattgtagccccaagcagtatgggagtcagaccctagctactagctggatgggattggccaagtcatctaaacgctcagaacctcagtttgattcttaaaatgaacattatatccatgggatctaaggaagcttctggttctttgcttggtgcatagcaggttatcaggaagtcagagtgtctccttcttcctttaccttatagctcaataactttcctttggagggcctgtgaaatgcagattcccaggccatgcctacaccctgcctcccccactaatttataatagtgaggtgggatctcaatgccctttgcagtaatcatcctttaagggagggctggggactgcgctgggaaccatcaaagcacattggaaggagaggccctttcttgggccagtgcttcagtgctgtgtcccctcctccccaaatgactctgggtctgctgttgccaggggttggaggatgcctgaggtctggcgggccatttttgtcag

SEQ ID NO: 110546 - DNA, 1016 bp, Homo sapiens
cagcaaattaaactccagagagtagaaggaaggaaattttaaagagcaagaagcagtgaaataaaatcaataaagaaaatcaacaaattcaagagttaattaaaactgataaattgacaaacatttagcaatattgataaagcaaaacagagacaataaattactaatatcaaaaatgtaaagggggaaataccacagctcctacagtcaataaaaccacagcaaacagcatataccaataaacttgaaacctcgataaaatgaacatattccttgaataagcacaatgtaccaaaactgacatgaaacaaatagaaaatctaagtagtcctaaagctcctaaataaattaaatctgtaatgaataattttcctatgaagaaaggcccaggcctagatggcttcacaagtaaattctttcaagtgtttaagaaagaagtaaaactaattctagccaaagtcttccagaaaatagagaattaggaacacattttaactaacttatgaagccagtgtaactctgattccaaaagcaataacattacaggataagaaaacttttggattaccttttatgaacatagatacaagagtacgagcaagatattaacatatcaaatccagcaatacataggaaggctaataagtcataacccagctgggtttattctgaaaatataaagattggcttcatattctaaaatcactgaatataattcaacataataatatgataaaaaagaaaaacgtggtcagtcatcttaatagatgcagaaaaatctgttggtaaaattcaacttcatgatataaactctccgaaaaccaggaaaagaatggaatttctctaatatgataaatggttctatcaaaaatcttttacaagtaacatacataatgatgaaatattgaacatttcccacccaagttcaaggtcaaaacaagatgttgactattaccacttctagtcaacattgcattggccaggatgtcaaatataaaataaaataaaataaataa

SEQ ID NO: 110547 - DNA, 1034 bp, Homo sapiens
tcttggtcctttcaggctgctataacaaaacaccttagactggatagcttataaacaatagaaatttatttctcacagttctagaggctgggaagtccaagatcaaggtaccggcagattcagtgtctggtgaggccctgcctccccattgacagcagtcttcttgctgtgttttcacatggtggaaggggtgagctagctccctagggtttcttttacaaaggcactaatctcatttatgagggctcgccctcgtgacctaatcacttgccaaacgcctcaccttctaatgctatcatactggtgactagaaacatatgaattctgggggtacataaacattcagatcatagcactgtctataggagacacactttagattcaaggatacaaatagattgaaagtgaaaggatgagaaaaaatatatcaggtaaatagcaaccataagaaagctaaggggctgtactgatattagacaaaatgagtttaaaacaaaaaaagttactagagataaaaagtaacattttataatgacaagaagttcaatacatcagaaatatataacaattataaacatatttgcacctaacaacagagcaccaaaatatatgaagcaaaaactgacagaagtgggctgggcatggtggctcatgcctgaaatcctagcattttgagaggctgaggtgggcagattgcttgagcccaggagtttgagaccagcctggataacatgatgaaactctgtctctacaaaaaaaatacaaaattagccaggcatggtgttgtgtgtctgtagtcccagctacttaggaggctgaggtgagaggatcacctgagcctggggaggttgaggctgcagtgagccgtgattgcaccactgcactccagcttgggtgacagagtgagagactgtctcaaacaaacaaacaaaaaacctgacagaagtgaagggagaaatagataattcaacaacaatagttgaatatgtcaacacccactttcaataacagatagaacaactctacaggaggtc

SEQ ID NO: 110548 - DNA, 1085 bp, Homo sapiens
ggtggattgggctgtgggacaagtggcagagggaacaatttctaatgcttaagccagcagcaattgccactgcaggctatggctatctgtttaactcctcgagggtgggaccttgtgtctcttcaggctctgagccagactgccagggttcccattcaggccctgcctcacttagctgtgactgggcaagtgcctccctgctgggctttctaactaaatgggggcttcccttggggagtctgaggatgactgcagtgtgtcccagttctgctgggtcactcctctccccatagtggcgacgggatcaacctgcagggcttctgaagttggacttgcctgtagtttatcccttgtcattgtgtgatcttgggtaagaagattaacctctctgagcctccatttcctgtataaaagggggcagtggcatctctttggctaggttggtgtggggatcagaggtgtggtctctgagcaaaggtagccgatttatgaggggtgatgatggtgaagaagctatgagaatatttattcatttagccttgtcacagagcaaactcccacgcccacatttggggtccttctttagctaacgatgaaactaatgatcagagcagtggccaccattgtggtgggctgagaggtatgagggaccaggctaggtcagtggaactgtgttgaggaccagctcccaccctactgacagtgtgacgttgggcaagtcgcttagcccctgtactcacttcttttgtctggataaggggaatgagggccacgtaaggaaatatcagcacttaacctcccgcttctgcctcgggttatctcatctttgctgcacgggcaccacacagggtgaggtctacgtgaacaccgcagagggagccaagtctcaggacactgggggactcagaagtggggctccctgactccgggcctcagatgttgccccacggagcacactgacccttgtaacggaaaatgaccttccaacagggatggcatgagaataaatcagaaagccttcttggtgcttttgttttttttttttttttgacagagtttctttcttgttgcccaggctggagtgc

SEQ ID NO: 110549 - DNA, 1041 bp, Homo sapiens
agcccagatagaggccgcttacgaggctggcgcttcttttcgccttagaagcatcccgctcccacacaccccagctcgccggtctcctgaaggctgggccagcctcggctctccgccagcctctgcccggctctctgagctccagcgatactgtatctaaccgccagccctcctccgccgcccgccccatctgcgcacactcgcaggcacactgtccttggcctttgccagtgctgtgctctctccgcgaacgccctaacttcagctggccagctccttgtagtcagggagatccccttgcccctcctgagctttcctggaacgtggcgctgtcccaggatgctgttaccatctgatggcctctgccttccagagcagaggaggaggtggggaggagggcaggggcagcctcagcccctctcccagggctccacccacagtgaatgttgggcatagcagggccatcccccctaagtcagagtaacccgctggtgtggagggcgaggccatgggaggagctggcccttcctgtagcaccctgggctggtgggtggtggctccactagctgggatgggcaaggaggagggacacattcggggatagagtgggggaattagaatcctttcctagcagggcatttccaccctcctggagacctgcagctctgcagagactgatgttgtagcgcacagtggaggcttgtggcttgttgcaagatttttgttgctgttgaggtgtgtaccggtctgtaatgctgaacatctctgctctggagtctggggtaattcttatctgtagtctttttgcagtaagcagctcccaaaggctcacagtgtggacccaatgcatgagatgactggcattttcctccttcacaaaccacccatgactcccaccgcccccacgacctcaccagttcctcacatcctggcttccccagcccatctctcccctctccctgccacaatgtctcagccacgcctgctgcctctgtgttgcgtagacatgtcttcacacttgggtttttcccccacatgctt

SEQ ID NO: 110550 - DNA, 1230 bp, Homo sapiens
ccatcagctgcctcaactgcatggcccagctctcacccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcctttccccagtgtggccccagcccgacaggcatgcaccagtgccgcctgtgcccacgtgtgcagactgtggctgcagagaccttgcgaccatgtgtagattgcgtggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctgtccagcaggtagtgggtgaatgtgtgaaggtcttgcctgaatccatcaggacttgggaaacagagaaccctgtgggggcggctgtgggggaggtccctgccagtgtttagaagagcctgactgtgttcagtgccttggagcagaaagccagggtcctgagtggctgaaataaaagcctctggtggaacctgcagcgctttccttcctttctttaccgaaaagaagtctttcttgtacgtgcgtgagaatcagcagagcctgcactcctgttgaatgaaatgcaagtgcaatttgagttataaaagagcaaggttgatgtttcacagttgatggcttcctgccacagcgagaccctggcttcatctccagctggaggggcccctggggcatctgccgtaactgtggggtggcctgggcatgggctgcctgtgcagagagacctgtgctgaaggtgaccatggagtgtcagcccagccatcttca

SEQ ID NO: 110551 - DNA, 2064 bp, Homo sapiens
ctgggcttgcaccctccttgagccaatgcactgaactgcctttgaaaggaaattgcatgttctgaccattttaggatacctttactttaaggaccacacagtcccagaggacacatccctcgggaactctgcccctctgacaatgagggccacagagaaggtggtgtttccatggtagatgctcctgttctggtgataccaaacctgcccacccctctgagtcgtctttgctcatggacttgcagcagagccacgtagtttggcattttgattcagaaagtggggagcagagacccagccaaatccaaactttttttttggttttgttttgttttgttttttacaagatataacataacccaggaaacagacccagctgaggttattctcagtggattacagtatacttttgtgtgtgtaaaagcacaaagtgcatgtgtactcacttctggccatataacatttacacagggaaatggatcattgatttttttttaatcaacgtgaatgaagaatgtttgtttatatatcactataaaatccagttgacctggacagtattatatgtacatatctattctaattaaatttaacaatcaaaggattggattacttttttcccccttgtaaagaggttcgagaatgtggtcaattgtatagatagcgtgttaaagccaaaacccagctctgagggccttacccattacttggatatttgctacgatccatctccctttgtgagtcaaatgttaagagaagaaacttgtatttgcagctagaggttactgtcacatcatagatttaacatttaccatcttcaaagtacaaatcttacatgtccttcaaaaggaggtcttaatacagttcctagttccttacttctgttttaaactttgggtaccaaaccaaaaagaagaaaaaagaaaggaaaagatcttctttgaagaaaagtatgtctctggatccctggaaaataatgatgtccaaagcaaattgtgaagatcaaatgtgtgttaagaaaaggtgtcgaggggagggacaaaaccagaaacggtggaaggaccagtgtaatagtcacagacttgcatcctggctctgcttacatttcctggtactctcgaatgtacgggcgttcacatagtcattgtgaagttgttggggtttttttggttttgtttttaatttagctcttctctgaggacgaagctgttggtggtggtggtggtgggggtggtggtgtgggatacatggtggtcaagttgtcagccctgatcagtttggactctgtaactcataggtgcattctttttttctttggtgtctcacaaattacccaattgttgaataaaactataaatatgttaataccagctttttccaataaaataacaaatgttacatcaaaaacgaggtccagaatgctgtttgtttttagtgagtccaacctcatggaggtggagcccatcaggaggcaatacagtgggtggggatgcccatgggctttgcactgggaagctgggttcacgtcaagggtttgctccctctagctcctaatgcagctcttaactttccctagctctgaattcatcactgaggaaatggagctaataagacgacctatcttgtaggtttgtggtgggagaggaaggacaagattaacttggatagtgcaaaacacagtgcttggcacatgacactccgtaatgatagttgtcttgttttgtctggcagcaggtgtgcatagcccatcatgatctccacacacactcacactctccatgagaatatgatacagatgaggaaactgattcagagaggttaaagaattagctcgcaatcacacaggtagcacataactcctcatccagtgctcccccacagacgtgcctgagggtcccagagaatggaagcctgcgggggagagaaaccacagggtacctggattcttcaggaagccagagaggccccgccccacctgccacaatggctgagctaaacaggagagtgtgtgggtaagtgtcccacgcacgcctgggtttccctgcaccctgcctggagccaggc

SEQ ID NO: 110552 - DNA, 1433 bp, Homo sapiens
atgtggccatgtctgggcacaaaggctgctgggaaatgtagtccacatgtagacagctgtttcccagtgacagcactgcattgcaggaggaggtgaggaggcctggcagacaattggctggctctgccacagtatctttttgtttcattttagagttgaggaaattggggtataggagggttcagccacttattcacagacccacagcaggtaagcatccatgcctctcttgcagggctggtgggcggcgggcatttgccatctgtcactgcctatttcagaccacggaggatcaggatggacgcccacccctgtgttccagcctccggttgggatcacatgctcacggcatgctatgtcctgatgccaccacctggccttcacctcttccctgcctcctcatcctctgcaggtgccagtgctgaagcccatggatctgatggtggaggtgagccctcggaggatctttgccaatggccacacctaccacatcaactccatctccgtcaacagtgactgcgagacctacatgtcggcggatgacctgcgcatcaacctctggcacctggccatcaccgacaggagcttcagtatccttcactgtggcctggccagtgcctcccacgggcagagtagcttccgttgggtggtgggtttggtttgattggcagacagctggtttggggatggctgcattgtttaacttcttcagtgaggcacctctggctcctagtatgcgtgtgaggcccagatacaaaatcatgtcacgtctgtttctgaaaaccgcaaagtcgtggttgctgagcattgcacccatcgcctcctccagcatggccatgatcccctcatcctagggcctcacaaggggccaggaaggagacagagttcagggttcagctgctctggacgagggactgctggccttgctcagcgtccactgaaggcgcctcggggccctccccactgggacccaaggcaggctgtgttagcataggaggaccagcactggggccccggccagggcttcgggtgacaaccagggtgtcagaagcccagctgggttggggtcctgagggccccctgctcggtgttctcctgtgtcagggcaagctaggggaagcagcagcattgacgattcccgccgactgctgggaagagagctggtgatgacatgagcaccagcctgcaggcagggcgaggcttggcctgccggggggctggtgggcgggcaggcaggttgctgtgatgtcactattctgcatacaaccaatgataataataattataataacacacagtgagactctgtgtgccaggctctgtgactaacatcaacaagcattcattttaactcatttcaccttcacaacaaccctatgaggtaggtactattctaagtctcctttacagatgaggaaactgagtcacagagc

SEQ ID NO: 110553 - DNA, 1941 bp, Homo sapiens
ccatgctctgtcctagaccctggatgaatggtcaggatgtggcacaggcagctgctgccccagcttgtgccttcagtgaaaccttcctctgcctgggtgacctgcgttgtcctggccagactggggagcgggaggactccactcttgcccagctgtcacagccctcagactgagctaggtggtttttgctcaggcctgggcccttgtcctcacccctgtcctcacccccacccccgggggcttgttgtccagcagaactctgggtaagacagcagtggcctggacaacctgcccaggaccacgtttctggaacactgaaagagcctcgggacaaaagcccatttactgagaacacttgctaagtattctggagttgcttctggtttactctgcactgctcacctccgagggccagatccacacccctgtgacagatgcggaaactcagagaagccacccagctagtgaacagcagacctggctgcccgacgccaggacagtggccagcaacgtcacacaccacccggcctcagagagggcgtctccccccgcaaacacggactgtgcctggaattagatgcagaagacatccaggaaaccaaggaggagggaggaggggatggagcaggagaggcaggggaggggaggggaggaggagaagagaaggtggagaaggggaggtaggagggaggggaggaagccgggggtgaagagaggacctgcggaatcatctttcccccgattcactcctgagcatggcccacgaactgaggatccttgagtctgactttatcttggtggctcacataaccctcctcacggtgaccctgtgggtgtagtgcagtgcggctactcccctcattttacagaggaggagcccagagtgcagagggttaaaatagttgacaaggggcacatcctagctgccaatcagttcctcaaacacagcactcggccagcacctgtgggcttcaccagatgcacctgtggggtgtcccaccaggcactgcgaagctcagccttctttttgccaagctgcagaaagagatcggattggttgatgcgattttcttcattttgaatttttctcctttagtgttttcttccttctagtcccactgacctttgtcatagcgagtgctcatgggaagtgaagtgaattagaggcaaaaatattggagaacttctaagcttttcaaaagcaagacagggatagaaatatagatacttaaaaaaattaccaggaaatcttgaaattgttctgggttgaatgtctccgtttctccctggttggggtttcgtgttgtcgtatgagttgaactctctcctgggaacgtggtccctggcgcacacagtggactcaccacctgactatgctgggagctccacggtcaagggtctttattagaaggagctctgctgcctaaaccaggccaagcactgctgaggaaagccggggacagattccaatccaggtctgacattgccagacattctgtcccaatgttaaagtctgctcccaaattcatttattcctcaagtcaggcctgagttggacacgtggaatccaggagcaagtcagggcccaagacacgagggtggccagagcctcaagccttggcgtcaggcaggcctcggcagaggggtgctcgccggagagtgacctcacggctctgggaagtcacttcccctctgagtctctgtttgctggtctgtgaaatggggagagtcgtggtgctcaagcagaggaggcctggagggtagaatgcgatggtgcggggaggacttagtggggtgtccagcttgtagcaggcgctggggaacattcgcattagcaagttagccggctcgggtgtgagtgtttcatgggaccgcacgggagcggggcttgtccctggcacactgcaagtcatgggccggttaagctgcagagagtttcat

SEQ ID NO: 110554 - DNA, 1078 bp, Homo sapiens
cagccccctgtccactccccaggctccattctctctacccactgcctctgcatcctccgcccttggagtttctcagggtgccccgcagatcacctgtggcccaagtgctcagggacttgtttaaaattcagattcccaggccccgcccaggcttgcaggcagccagggccaaggaatccaaatactaatcaagcccactgtaattgccctgcatctgaggtctgaaatcactcgcctgctctggattatctgtgctccagggtggcctcagtttacaccatcctacctccccattgaaaccttactgctcacgatggcccaggttcccacccatcctgggagagaaagatgattggctcagttctctgggaggcctggtgattggctgcctctaggagggtgtggctacctcttgatccaatcagtggagggcagcatggggatgtgatcatgcagtgaagaacctgtaccgggggtagttaggcgccagggaaggggaggaggagaaaccagttctactgttagtatcagctcatctaacatttggcccctggtgggggtttttgcatccttttgggggtctaggtctcttctgccattttgttggcactttaatttcttgttaacaaacccaagagcacatacaacttaatttttaaattcccaataatttccagcatcctctaagttagtgctgagcgatagaaatgtaacggaagctgtacgtgtagttttaaaacttctgatagccaggttatgcacgtaaaaagaaacaggtgaaattaattgtaataatttgtatatccaaaatagtataaactgtaatcaatctaaagtaattgagacattttacattctgtttttcatattaaatctttaaaattcggtgtgtgttttatgcttaccatacatcccagctcagactagccacatttcaagggttcattagccacccatggctggtggtccctgtactggatagcgcagcactaaatgatggctttactttgtatccttggggaagtatgtatttttgaatccattttcctcacttttgaatagtttaagaacttcccag

SEQ ID NO: 110555 - DNA, 1051 bp, Homo sapiens
ttagcaagagttttctacgcagtgaagtgaagacgtagggcaggtggagtggagggttggcacctaaaggtcctgaaaaggaatggtgttgcaagaggcagcaaatagcatggggtgggctaagctccagctggttgagtttgggtcagaagtgtggacttggttggtaaggactcctgagagtgtcatgtccaggcacttggacttgatgctgaaaatacagccattcaacagagaagtatgtatgtctgagtgtgatgtggttagatctttagtttaggaagacctctctgttcatggtggggagagtggatgagatgggggtggactggaggcagaagagcagaggagaagagcagactttctaggagacgaagcgggaggggctgctcccagggcctggctgtgagtggtactgaccagagccatccatcagcccagatcatgtctccctaatttagaagaaaatgagaggaaagagccttttcatctctgcctcttctgggatggaaatgagctattttgaatcacgctaaagttagatttctagttttccttttaatccgtgtctcatttagagcattagaaactggaaaagcacccccgtatgaatgtagtgtcataaatcagtgcacgtcacaaactgcagaaggagtcatttctacaagagtgtgcagccttgcatttatgataaatctaatgctttatctttttgggcttcagactagagtaattagtcatttctgctgatactggcaaaccattgcatgtgcagtgttaatggagagcaaatgtatttgaactgcttttgcaattgcttgtgagcattgctgtgtatctcttctacctgtttctagaggggaaacatcctatatatttcattcttgcctattctaggaataggtgtggtaatagtatcaggtaacacttactgggtttcttccacatctctggcactgttcagagattcaataagaaaggatcctttgtccaaatggaagctgccgtgtgtgtgttgaggtccttgggtcaatctgatcatgctctgtct

SEQ ID NO: 110556 - DNA, 1081 bp, Homo sapiens
gcgtggctcctcccctgcagctggaggggccaggaagggctttaagccatggagtgagggaccagagttgggtttagaagggtcactgtggtgtcggtgtggaggggcttgaagggaggagtttggagggaggggctgtagcaatgttgagattccctaatcactttagtgttttcatgcatgagggccctgaggtgcttttttccagagcctgcactgaggttccctgttggcggcttccctcaggctgctggaacccccttttcctgtgcacctgcagagctggaggttactggaaactcatgtcctctgccagagtcagccctcacccagtcactgacaggtgcagtggtataaataccccagctccctccctcctgatcaggacactttgagatgggacctacactgtccccagagctcccatgggactgagctcaagtcgcactccttgagatttttcctgttatcacaccccacttggcctccttcatgtcctggccccacttccctacacccttcctggctttcccagcaacacttcctaatcacttccagaaaaatgttggcctcagggtctgcttctggagaacccagcctagcagagggcagcaaaggtgttgaggcactaggagaaacatggtgagatacagactcaggcggcgtccatcagctatgccaggaggctctgagacgtgccagtcagggagggaggtgctgaggccacagcaaaccgggggccagaagtaagcaccacagacagcaccaaggctgccagggtccatcatcttgggtctcccaattggttgggtccagagaccagcctgctggcgtttacggagccagcatgttacatctctctgtgtccccactgctgaaagcctctggtcagtgccatggtgctgagggagcttgggcctcccttagaggttgctaagagcccccaacacctgccctgtgagttgttggccccaggggactctgagtttccctgtttctggttttcctgctcatgggattgggagtctgacctgagcttgctgagacagataactgatcattcagatacaaaactctaaag

SEQ ID NO: 110557 - DNA, 1057 bp, Homo sapiens
agctgtgatggggggaatgggtgccccccttgggcgacttgtgggacccagaactcatcacgcagagcgtcccactgctgtgcagccactagctgctcggtgctggggctgtggtatgagcatggactctggagtcagaattcctgccttcaaagccccactcctcaccttgctagctgtgtggcctggggtgagttgcgtaacctctccatgcctcagttccttcatctatgaaatggggagactgaaactgtaccccacaccctaggggtgttggaacttaagtgagttaattcatataaaacacggagtgagtgcctggtacgcaggaagtgctcagttcctcttggtgcctgtgattattcccataatcatcactggtgtcaccttgtcgcctctcccagcccttggggccatgctatttgtggtaggaaatggggcctgaaaccatcaaactaaactggactgaatgatcagtccaccgaccaccacagtcacggcttggtggccccacggactgaagcacgtggccaagggcagttttcccttctctgtgtgggttccactgggtccaagtacattgttcctaagcccaggcctctggccactcacccacctcctgctgagagcgggcagagctgatgcccctctctgggcagaatcagcccacggctgggaggggaggccaggcctgctgctgggggtgcagatagtggggagctgcaggccagccactggaaacctggcctgtgtgctgagacagcacattggacacagtctggtggccttcccatagatcaggccacagagtcctcatcctgggtccacccaaggcactggccatttccagatcaaagagcaggtggattccagggtgagacggtcctctctgctggctgccttcccccacccacggacaccgtttggctttgatggggctgtgtcctaggcttgacccaggtggtcaggagccttccactatgcagtgggatatgctgcaggagtagggcggagaaggaagggaatggccggtggtgaacagctgccatgccccagg

SEQ ID NO: 110558 - DNA, 1065 bp, Homo sapiens
ccatgcctgcttggtgaggattccatcaagcagggagacagtgggccgttggcggggagtctgagcaggtgtaccagtatttccagtcagctgatggctgatggacatgttcttggaggcagggaactcggaggcctgcagacgtgccccaggatgacaagattcatcagttcctacaagccctgcctgggcctcatgcttttcagtgtgtcctgggctttcccgtgtgaaatcttacctgatttttatgccaccttgagaagagtgatattcatctccgttgtacagatgaggaaactgaggctcagggaggcaacgtgatctttgcaaggatccgtctgttccccccgtggcctggctgcccctcctggcagtgcaggtggagttaaaaccatacaggagttaaaatgagcctcgatgggggtgggaagctacgactggaaaacgtccgatgctctcccaagtcaaattgtgcttggtgtctgtgggtgtgtcggtgtgggggagggaagctcagcccttttgaaaagtggggggtggtttgacgacgctgcaggggcagctccgagttctagagtctcagaacgtggttctaggcggttcatgtggatcaagtgctgttctgagcactttaatatccagcgtgaccataaggataagtgccactgttactggctttttcacagatgaggaaactgaggcacagagggattaggtaaagtgactggagtcactcagccaggatgtgaatcacagcccacacccatgtgcaccaggaagccttggctttcagggtccttggagggtgtgccgggcagtcgcctaagctgggaaaccttgggcttgtctccaggccatgtggccatgtgagataggagtcctcctgtgttatgttctgcgacactgtgggcagagggctgaggaccccagccctcccttagaacatcatgttggtgtgagacatttagagccaggcctccctgcttagaaagcacctcttgggtcacttgcattagtgaagttatacatttgaaactccatttatttatttatttatttagagac

SEQ ID NO: 110559 - DNA, 1790 bp, Homo sapiens
catatcgtcagactctgcgagctaagttgtgtgtatgttaaggtgctctttttgagaagatcttaattttatttctctattttatttcattacagaaacgtttgaacgtgtagacagtagaataaaggggggggggggaaataacatccttcatttcactactccagaaacactgctcacattttgttgcatttccttctaactaccccctgcagattgtactatgttttgtgtcttttaaaatattaaatgcactgtcaacattttcccagatcatcctgcactctgagttaacaatttttattggctgcataatacttcacgatgtaggtattattattcattcaataactatttatggattcattgatccgattagtgttgattgtctataacaggtgtgtgggtggggtagggggattcaggaagaaggaatagggcgcagctccccccccccaggatttctggaatgagggagacataacagatggctgtgatccggtgtgaggggcagggatgcagtgggcccgttgcagcctgggagcaggtggtcagagatgcaaggctgtgggcagcagtggttggtggtccacagcagtaggcagcagggggagggggcgacattcatggcaggagggacattatgggcacagcacggcgtggtgtgttcagggttggtggagcgttcacttacagtcttgcagatcctggcaggtgtggtggtgatctgtccaggcaggggagggagagggaactgagagtcatcaaaagtctctgggagtttggaaaggagagtagggggctcagagggagtgtgagcacttccagcagaggtgagaaagcccccagtcagttgcccagggtgggcagtggaagggaagtggaggtgaacgttgtggggtggagagggttttcaggcaggctgggagctgcccagtgtgctggaggaaggctgggtctccttgaatggtgtttggtcaatgcaagaccacaggagtgtgactagaaggctgggggtgcagatggtggcaggtggaggacagagagagcttctcccactgctgaacaacgactgccccaactttatgggatgagcattcttatgaatgcccattgtcctgtattccagattattcttgtgtctgtccaggtagggatgcaatttcttgatgtagggctataggtgtttttaagggcttgcataaagatttgaatatgatgttgtctagtagagtaaaaatcaaattgggcaaaacatttttgtttgggtgatttttggaagagtaagtccacgaatgcaacgcagctctggagtcatctgtagattacagcaagcccatcagtctctatgtctcttgcttacaacaaaggattgatttcagctccagcactaggtgacttgtgctgtgttcattatcccttgataggtgtctgacaggagatggggcttgggctgtgccagggaggagccgtgtggtgcaccacctatctctgcaggcataactattttgtcttcatggcaaaataatagcgatgatggtgatgaggagggaagctaccatttcttgactgctcctgtgtaatgacatgttggtgatcacattagggctttatgtccactctgggaggtggtgagaatgacatcgcgtttgcacatcaggacgctgagcctcagagaggttgagtcccaggacgaaggccacacagtgagtgccacaggtaccattaccacctaacaaatgactctggagctcagtgatgtgatgagaaccattttattctgtctcctg

SEQ ID NO: 110560 - DNA, 1093 bp, Homo sapiens
cttctcatctgtcagctcccatgtcctctccattctccggggaagagggtatggggaaggtgcactccctccttaaacactttggcccagacatggcacttgtgacttccctcacattccattggccagagctagtcacatggccccacctaatgcaaggggctctaggaaatgtagtccctggctgggcagcccagtggctactctgcagtgggaagaacctgcatcttggtggatgtcttgccatctttgccacatgaccccacaaaacaaacctttacattctcagtccaaaaaaccctactaagaatcctgtgctggagacaccctcactcaacccctgaccctcccctctccctgcttcagtgtccacacgtgcacggtgctgtgagatgcagagtccagagtcatgcggtggctaggaggtcagggacgccttcctgggagaggcgatgtctgagctgagtctgcaaagccaaataggtgatgcccaggtggatcaggtaggagagggattccgggcttcggctgcagcaggggtaaaggctggtgtcttgggagagggcatcctgtgtagagaggggtctgtgggccactgagatttagaggatgtgtgtggggtggggtggagtgggagaggagctggagcgggatgggaagtgggaggcaggactgtttgtgaaaggcttcaaatgccgagataaggagtttggattgtatcctattgacattgtggaaccagatggagatggggcatttccctttgtttgaaagtattttgatttctattggctgtcttactacaaaaaacatatgtagtcatagcaaaaagttcagaaaatttagaaagagaaaaggaggaaaagaaaatcctaccactgaaaatattttggtatatgtgtttttgcctatgggtatacatactatctaggtatatatatattcctacatttttttattcactgaaagatggtttttgagcatctactgtgtgcgtatcctattttgtaatctttaaaattttctcttaatgatatgggagctttctagcttagaaaataacacagcccattttcttagcttgctgggactt

SEQ ID NO: 110561 - DNA, 1057 bp, Homo sapiens
ccagagggcgggatgcaggtattgcgaagaggcacacgctccgagaggaaccaccagagcgtgggctttgggcgaggaggggtctcctctggttgggggagatctggcaggcttgggggagatggggctgaaaggatggacagggagggaaggccagaaagctggagacggggatggagagctaaaccgcaaagagcaggcgccctgccccgctgagggccccgcgcctccagctcctccttcccgagcttcccggggtcggcgtccagccggcaaccaatgggccccgcccccgcccgcagccaatgggccgcgtccccgcccgcgcggccgccccgcccctcgcggacccggaagtgggcctggcaccttcccggcctgccgcagggatggggcagctgtgctggctgccgctgctggcaccgctcctgttgctgcgaccgccaggggtccagtccgccggccccatccgggccttcgtggtgccccacagccacatggacgtgggctgggtctacactgtgcaggtaggtgccgaccacgccccgcgcgcccctgaggctgcagcttccctctccccgcgggatctgagtgtgggtttgcgtcccggggcccgatgccggcgcagaaggaggctcagtgggttcaggaccccacgctgccattgactggttgcgtcgctaacttcgggccagtcacttcctgcctctgaacccccatttccccttctggagggtggtgcagattggagggacccctgcattcccggctggggaggggcttgggggttgacagtggtaacccattttccagggaagcctggagcaggagagggtggggctggcttcagagcaggtggatgtcaggtgcccgctgggaaggggccgggctggtcccctgcggggctgaatattggaggccagctcagcgtcctccgccccccaggacaggggtgaaggtggacctgtggtcacctcctggttctgctcaggaccttgggcgaggggctttggtccctaagcctcagtttccccatctgtaaagggtaggggaagca

SEQ ID NO: 110562 - DNA, 1018 bp, Homo sapiens
gcttgcctccgatcaggatccttcagcaccccaccccacctgccccagtgcagcctgtctctcccaccctgcccaaggcccatccagggttttctgggcagttcctagtctggctatgggaggaggcctgagttgggagccgtaagccctgggctcgctgcctgcccggcctgcctccttgggtgaccctggcagaggctgcctctgcagccccagcttctcagctcttccagggctggagcttagcagacttctgggtcatgccgtctcaagctcaccatcttcccttgtctcccagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtaacaccacatttagccacagtggcaggattggaacctcccatgctgcgcacctcccctcccttgtcctagccaatccttccagccctggggcactagaggccccactttacagaggggaaactgaggttccctttggttacaaggccagtgcatggtgaacccaggccaaggctgagaccacagcctgatccatccagctggtggcctcattaagctttgtagcagtttagcaaaagggataaaggacaaggtggagtggcatttgtgtccgacagccctgcctgcatccatatctcggctcagctgtgtgatgtcaggcacatgattcccacacccacccaagacctaattccctcctgtacaatgagaacaacgagcttgcccaggaggacggtggggcaattggatgtgctggtgtgcacagcctgcttggtgcagtggctgctgaatagccagttcatgagtttccgtctccacccatcccctactgtactgatgggaaaacagacccaagacagcctgtaac

SEQ ID NO: 110563 - DNA, 2899 bp, Homo sapiens
ttttggtagagacggggtctcgccatgtcggccaggctggtctcgaattcctgacctcaagccatccacccacctcgcctcccaacgtgctgagattacaggcgtgagccaccgcgcctgggaagtgcgggaggcctttttaaaaaatgtaaactcgcgtgctcaagaagccctatcggagggaaacacccagaagaggccaccctccaaacacagggtaaaacaggggtgacgcacagaggtaacgggaaagcaggaacgagcgagagcgtgcggtcccgtacctgcgcgtgcctgcgtgcgcgtccgtgcggccgcgacgccgccgccggtgcctctctttctagacgtgcgcgcgcccgcagctcgcccccctgaccgtaaagaggcccggctgtgtcgtgaaaggggccgcaacgcgcagagcgctggttgacggccgggactccattttgttcgccgttactctgcgcgtaagtcgcttgtccgtggcttctctgagaagaaaagttgaaaaagggtaaaagttttcaggaatattcgggctctctattgctaagcatagcgagtgtcggttttctctctccaacagacatcgctattgcggttccgaggcagtgggaagagatgcggcccctggacatcgtcgagctggcggaaccggaggaagtggaggtgctggagcccgaggaggatttcgagcagtttctgctcccggtcatcaacgagatgcgcgaggacatcgcgtcgctgacgcgcgagcacgggcgggcgtacctgcggaaccggagcaagctgtgggagatggacaatatgctcatccagatcaaaacgcaggtggaggcctcggaggagagcgccctcaaccacctccagaacccgggcgacgcggccgagggccgggcggccaagaggtgcgagaaggccgaggagaaggccaaggagattgcgaagatggcagagatgctggtggagctggtccggcggatagagaagagcgagtcgtcgtgagcgcggtcggcggtaagtcgggcacccgcgccaggccgaggagcggccccagcttggccgctcttcgagagcgatgatttcatcgagatgcaccggaatcgggggtggggcgggagaataaaggcgtgctcgggtcagggccgatctgggccccgtcttcgtgttttgttttttgacggtggcggcgtgggataatcagagtggccgggtttgggcgtgatgcgtgttcagtggaagggtcataaatctcagagtcgccaaggaaacagaaacggacaaggtcccgggccgtccagcaagcgggggtggaaatagaggattttcggggaagacgttggacaagtcaacgttgctagagactggagtgagtcaggtggtggccagaagaggtggcgtcctgcacagtggcgttcgtgagggtttgggggtcgttgtgcctgggattaacctctcgatgatgaatttcttcccattgtgctttaggtttccagccaatggattctggtcaactggtggagattggctgacaccctggagaagccgaaaccagagagccttttgttttctcttttttcctgtctatgctctgtctcacttaacactacgttttctgctatggtctgtggttgatgacctcaatatgagtttcgattgttaacgtgtttttgtttgggaagtaattttgtttgaaaatgctctcacatacaggaattagggcctagattgtaagctcttgcagcagtcacatttgttcccgggctttggtggttatttctaaatttttgaggtgctttgctatttcttgtgtgacctgatagctccctggaactttgggtctgtgtgtgacacatgagactcacagttggagttctccagctctggaggtgctgaaggagctgcattaattctggaagacgactccatgcagcaactactgaagaaaggaccagacttcaacggggagtgtggatgggccgacctggctgggactcgtgaatctggagaagagctggagaatggatagtattgtctgtatttggagactttaatttctgtgtgagaccaaaggaggagagatgtgttttgttcaaaatttaaatttgttgtggtacactatcttatgtaacctgtctggtgagtttgtttggacaacctaactcagctttatttgacatggaacctaaaatagaagataagatcttgatattctgtacaagttgatgtaataccctgatgcgttttagaggacttggcataaaatgaaagattggcaaaggcccttgaggggcttggggatgacagtatggaactgtctgcattggaccctaaactggactagaagaggcatcttcaaggttcatacgttgtccagctgtaagttcatttgagtagcagacctaacaaatatttgaggtcagaaccctaccatgttaaaacaaacaaaaacttaccatgttaataaaagtattcatttgcttgaaaagacgaaagacctaaaaggttattgagaaatgttagtcctttaagaatgaaatctgctgtctcccagatggttctcactgtcaaatggagggtgaacatcttaacggtttctgaggctcttagtctctaatcaaagggaagctttctctctctgctgttgggaaccgggtgaggaagaaacacacttggttcttagtgtgggaagaaaccacatgtaatcctgtggtccaggcctctgccttcagagagccaaagcaccttcagtctttccaattggaacattgttttctaggccttgcactgggaatatagcgattacagttgcagggtgagggatgacatagaggagatgtgataccccaccctccttccagattgaagcctttctgcctcagctgctagaagt

SEQ ID NO: 110564 - DNA, 1671 bp, Homo sapiens
gccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattaaacctcctatagcgtggattgtagaccaaaggaaatggtacaatttctgagaatatatgttgattttttgtgactaattccaaagttgtatttgaaagtatgacctcacagtcttcatttgtccatagcaaacatatgtgtgtgtgtgtgtatatatatatgtgggttgccaatgtttggtttataatttaaatgttaatagaaattttgagttttattggaaatgatttccttctgaaaagagctttacgtatttccttgtgtgtgtttgaaatagacgtactgctcatgtgcttttttagtagtgggataaagaaaaggggcttgagtatacctcctttagagagctaatgtgaaaagctgtagcttctatttcagagcatggtatatttcttttcttttttttttttttttttttttttgagacggagtcatgctctgtcgcccaggctggagtgcagtggcgcaatctcggcccactgcaagctccgcctcccgcgttcacgccattctcctgcctcagcctcctgagtagctgggactacaggcgcctgccaccatgcccggctaattttttttgtattttgtatttttttttagtagagacgggttttc

SEQ ID NO: 110565 - DNA, 1043 bp, Homo sapiens
tcgggtgtgagcccgtgggagggaacttggtcatcaggaaggatgcgaggaccctctggctgtggggtgtggggtccgcggtggctgcagagactggtccccccacaccagggggcgctgcaggagcgggaaaggcctgaaaacagctggtccagcccctgtcctcgggaaactaaagccttatatcctgccacggtcactgggcactggaaattcagagccccaagatcctgtccatgctcgaggggctcccagtgtgcagacagagtggggacggcagctgcagcccaaggcacagtggctatatttgcatgggggtaggaggggaggaaattaggtgagggaggcagacagggtgctaatttggacgtgccctgtctggtgggggcagaagacaaggcctgtttatgtccacctggctcttatctctccccgaaaggagcacgatcatttatttatgtacagtttgtctgtctccccaacgaggaggaagattgtggtgtttttccattttgtccactctgaatccgtgacacctggtaccaggcacctagcacagagaaggcactgaaaacgtacccactgagggaatgacagggacattgaggatgagcaggtgctggcaaggagagcagggagggtttcagggcccacaggctgctcccccgtcagcccagctcccgcctcccttggccagggcctgtggatgcgtcttcctccaaccttcccccttcctccctgctccatccttacgctctagatgcggctcataaacaagatatcatcggacttgactctccttgtctgacctgacaagcatttgtttcatagtaggcgcactcagtccgctgaaccttcatggatcaactccggcatctgagtgctgttcccgagtcacacctgccctgtgctccttttcttcccagttcaccctggctgctgggatccaaggcctctggggtcccaagcaaagggagacatttaccagcgcacaccccccaccaactccgtcaaaaacatcgcccagggccccagtgtccgcc

SEQ ID NO: 110566 - DNA, 1036 bp, Homo sapiens
cgcggcaaaccctgtcgcgagggcgccccgagttgctgcggggcctgatccggctcctttccaacaatacgcgtctgcagccggcatttctagagctctctgcttcttcccgctggagaaaccagtgtgtgtcgtgttggaatgcttcgtcttgccctagaattcagcttgcgtcttgtggtgcgcaggtgacaggacctgccgaactcttggtacagacccctaaatcatggcagaactgtcttgatttcttttttgccacctttccgtttttgtcctctataggcaagctataaagatttaacccagttaaaaacaggagggagattcagcggagaggaggcatgcgagattctttggaaaaaattatataaatgtagttcttgctaataattacctgggttggatactttgacttactgttcaagttcctaagaagggattttacatttctgggtcttgttttaaaaactgttagaaagctcgtgagggggtagggacaagcagttttggtaataggcgatgctgtggataaaactgtgcggtaaaatgcccaagctagattcttcctatgcaaaataagacccgttccagaacactttgaccatttcgtggacttagaatttaaaggcgggtgagggcggggggggaggaggagcggattctatcactctgcatcctcaaggtcaaatattcttccatcagttattttggattgaaccattcttaaataggtctcaggatctctatgtcgcttccttatgacagaacctatttccgagagtgtgcctttgcatatctatagaagctcctttcacttaatatatcttataactcagattcaattgctgtacttgctaaataatgcatttttaatcattcaaaaagtggtttacagcttccttgggtataatggtttttatgtaagcccgttacatcagtgaaatgccagtttttaaacattgaagggaagggagaatattattcttatttatttccataggaagtagaattcaaagtgcaggtgcttttttgt

SEQ ID NO: 110567 - DNA, 1050 bp, Homo sapiens
ttgcacctgtaccctataagttttgctttttctttctgagacagggtctcactctgtcacctaggctggagtgctttggcatgatcttggctcactgcagcctctgcctcccgagctccagtgatcctcccatctcagcctcctgagtagctgggactccaagcgcaagccaccatgcctggctgatttttgtatttttttggtagagatggggtctcaccatgttgcccaggctggtcttgaactcctgagttcaaacagtccgtccgcctcggccacccaaagtgccgggattattggtgtgagccactgtgcctggcctaatttttttttttttttttttttttttaagatataaacctttgtgttaggctactgtaatttgggagttgtttctgttgcataatctaccctattttaaccttttccctcagtttgttattgaccccttatcctaattattctcagttctctctttgttttgttaataggctttagttgttcttgttattccatacagtctgactttgtcattgaaccttccatgattacattgaaatgtaatgaaatttgaccttttgaaatttgagacctatcaaacataaagtagatgttttccagttctctcaaacagttctttctgggcacattgtgttatttcagagtagctgtgattagtagcctttcttccaggtagtgtcttggacaacctcctggaacgtggggaggggcatatgaactccattgaaagagctaatgagtctttattaagctcaacatagtcatttgctagaggggagagggtcaaaaccagtgtcgtctagtagaacttttgtgattatggaaatgtactatatttgcacaccggctccatgaggctgttgagcacttgaactgtagctggtgtgactgaggaactgacttttagtttaaaatagccacatgtgactagtggctaccatattgggcagtgcagtaagggtcttagaacgccatgggggtgacataatgccaggtgaaaaaggcagaatatgaaagtatatgtatgtt

SEQ ID NO: 110568 - DNA, 1051 bp, Homo sapiens
aagatcctatctcaaaaattaaaaaaaaaaaaaaaaaaaagcggggaggggtttgcctaaatcagtaaggtgctataatgaactaagaaaattgaaggacttaattcaagttgaagtattttcctctttttgtaaaatgatgaaatggaggctcagaagttaaataacttgtccagcttcacacagcacagcaggtctcgtaagtccagatcatgttccctttatgttacatcaccctgctaaagagcggggttacctttttctaagcctcgattggtcatattatttaattattataacagtttgatatcctctattttttgttgaaaactttaaccttctttttttttcagcattctaaagagtatataatctgtgccctagatcatgtttgaagatatttatccattggatacttctctcctactctgtatcattttctagagagcaaatgtgcatgagagctggagacaggccaatttttttagaccattccgtgttcaaggataggaatcacagctctcatacaggggccttggcagaaacagctttttatttagaggagttttttttcactttgtattgcttctctggctattgaaggcatgagtttgtgacccctggcacatattctcagtcttctcagttggtgctcttttgcttatttgcttaacattaatttaattctaaattttaaaaaggtttttaaaacttccagtcattaaagtatggaattgatcctttgctttccagtgaaacgattaccatgatcaccagtagtcattctatcagtatctagttgggtttcctaccactaatcttccaactctgctttaaagctaaagactaagatctgaaaaactgtaaaagagctccatgtgcagggctgggctgaaaataggagtgtttgaaagcctgtgcttcagttattgctacatgactaagtaccccaaaacttagtggcttgaaacaactatttacccacaattctgtgagttagctagggctcagctgggaggttcttctgctgttcttgcttggggtctgtgat

SEQ ID NO: 110569 - DNA, 2962 bp, Homo sapiens
aggatttgacctcagagaatgtggcttcagagctcatactcttgactgattgctaccgagctttttaaccgcatatattttcaacgctcacaataactttgggaggtaagtcataggatcaccattttgcagttgaggaaatagtctgaagcagtaaataatgagcttaaagtcgcaagcaatagtgacttagctgagattcaaattcagataatgcttactgaagagactgcattctttcttctactatttgtcctttttgacttcttaattaaaatgcaaactttgaagataaaaactgtcatcttacatattttctcagtaatcttacagtgcgtatcacagtgctgagcaaaatggtgcttgatgcatgggactaatcttaagcatattttactgtattataaattattgtaaagttaatgattcttggatgatgtgaatgttgacactactaaaatgaaatattccattcttctggttggtaatgttgttttactgtatctaaaaaatctgcatactcgtgttttgaagtctttactctgtttttcaggtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttat

SEQ ID NO: 110570 - DNA, 1032 bp, Homo sapiens
aagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagaggtatgtgtctgcgtgttggtatttgacaaaaggatttgatcagagtttaacccaagaacagacatgccagtcaatgaaagatagggttaaattattgggaaattagcttaaatgtcttaaaacttaaattgttctaattttacatgtaaggacttaaaatggatttgatatttatgaatttgaactagacagtagagtttttctggagagaaaaagcttttaaaaatcacaggatgtaagattcctatgtgttgtcttaagatgcatgttattggccgggtgcagtggctcacgcctgtaatcccagcactttgggaggccgaagtgggtagatcatttgaggtcaggagttcaagaccagc

SEQ ID NO: 110571 - DNA, 1049 bp, Homo sapiens
cccagagtaaaactaaaaccaagcacctttctctttacccaaactaggagtattctgtgagaatttacagctgtgaagcctttgtttccttcacccagcttccaccttctaaagaatttctcaattttacatctgttgctaaaaacatttctggttaggctttttggattaagtttatgtcttcttttcactgtttcattcattcatcaagtatttcttatgtacctgctcggccaggtactattcttggtgctgggaataagtaacaaagctcttggtgctggtggagtcacatcccaccttggggagctgacaataaacatgttaagttatatagtgtgttacaatataaatgctgttggaaaggaggatcgctggacgaggggcattgggtttgggagtgatggcaggagtttgctgtgttatgggcggtgtgagagcaggcttcctcgccaaggtgcaatttaaggaaatacttagaggtaagagagtgagctgagaggatgcctggcaggaaagggagggcagcactgaggccgctgctgtgcctgcctgtccatgacagcgaccttctgatccgctttcagcttcctccattgtctcttcattcttttcattcccagccacagcagaagttgaattaatacattcgatgatgtattagatgaatatagcatgatccagcctaaaagttataaatgagtggagagatgtcataacaagatgcatattccttgaatatgtttagtataaaacgggacaaataagtccctgccataggaattgacattcaaatggaggatgcagaaaaaagactcccaaatttatggtagaaactggtgtgcccttcacagtggtttcagcaagagagagaagaaatgatgtatgagatagtcagagactgttggcctggcggaaacttttcttcacgtcagcagacactgagtatctgctttgtgcggggccccatacttgggaatgcaaagatgaggaagacgtggtcccgcccctcaggaagcttacagtcgggttctgctgggatctaaact

SEQ ID NO: 110572 - DNA, 1122 bp, Homo sapiens
tgccaccttgtggaaaagaaccaattccttgcagtggcataggatgattttgagacacagagttcatgtttctttagtaaagggcaaccttagcacccttagtccagttttctgtcattagttagtaaagaatccagtttcacctcttagctctaggttcctggttatctgtacagtctcttagtggatactggtgtttgtacataatatttttgtttttacagtgaagtggtatatagagaaactctcagtgcataaatactggtaattatttcttttgaatgacctttagctcacactgtgagttaagtccctgcatatttgccctgtagcatcatgaagcatccttctttagcttatgtgggttggggcatttagtctcagaaggatagccaagaaaacaggtagtcacttacctactcagcagaagtggctggggactcctaatgcttctaatattggatatgattcatcacaagcagttgctgctctgagccaggggctgacctgggagctcacagcatctctggaaaggaagagtagcattgtcccctttacagtaaggcgaggaaacaggctcagaaaagaggcagcttgttcaggtaaccatataagaaagccccagctttgtgcagtctgccccctgctggccttgctgcgcattcatatgtgcatcccttcagcacttgggttaggcactgttctagacttgggaatgcataggcaaacagatcgtgtccctgtcctccccctgctcaggtaccttctcaacagggacttgaggaaatagggcacagaccatgtgacagctggggctgcctgcagggagaggtgccaggcagcagtggcttgtgcagggacaggaatgcattgggtatgcccccaacatgactggcaaagaagggatggcatgggagtgtggtggggatgaggccagccaggcagctgggagccagaccacagagggccttgtagactctgtgcaccaggagtgccgtcccaaacagcagtctccacagctcacgcccctggattttcagtgctttcaagactcgagtaatgtaagcgtctggatgattttagcattaaagacagagagtcctgcagggaagcagtacagac

SEQ ID NO: 110573 - DNA, 1055 bp, Homo sapiens
atgtaggagggaaaatggtgatgttctcatcttagagatgaggatactagggctcaaagaggttaaataatttgtgcaaagttacatcacaagtaaatagcatgacctggaattgactgaagtctgtctaatcccagagcctggggtattctcatgaacctcaactagtaacttggagttcttggagccgtcagagagaacagctgtggagagtcttccatgtggccagtgcagctgcaggaagcagcccagcagggcccagatggtcttacccttggcacagcctcgctactctgtgccaaggtagaagggcgcagcagtcacttgctccagccttgtcctttggggtgttgtgcaaggggcaggcatgtcatctcgtcaaactaccttgtggcaactctgtggcaggggatggggggtgtgatctggttttgaggaagtagatgctcaagggtgttaaaggacttaatgcaccatgaatgtcaatgccagagtccaaaaccctggccaagttcctccttttactctgcactgtgcctctgccccagctatgtttctcatggaggtaaggggagtaagaggctgttctggatgaagaccagcagttctcagtgcattagaattgcctgggagcaaatctgcttttcagaaagtgcccagcccctgcccaggacagttcatttggaatctctggcaggagtctaagcctctctaaagcccccagatgatgagaatatgcagccagggttgagaactactgggctcgttggatttgtttgatatcttctcatcccagtttttttcccattttgtggggccatttgcctgatggaatcgctagcaccatttctttttcctattcatagatgtgatacatggttcagtatgttgttgaggaagaacacacaaggacgtgaccctgtgtcgtttctccattgcgttcccttctgtctgagcttcctttgttcctctgtcctatgaacgtgctatgatgcaccatctgtctcctccatccatttgttgtggagagcatgggccctgtgggtctctctgtc

SEQ ID NO: 110574 - DNA, 1062 bp, Homo sapiens
gacacccagtaatgaagagcgcctgttagattttaatagggtaagtggactgtcctcctcctcgtcattaacttacaaacagccaccacctccagttgtcactgtagtcaaaaacctgggagtcatgtgagtggaccccacctctcccaggaaccagccaggcctgtgggtgcagacttcctgttctctggcctttgttctgagtctgcattctcccccgcttccaaacccccttgactgttgactgccagtgcttcctgaagaatccccagctctctccccagtcttggctctacactactgcccgagggcattgcattacaaatgcagagctgaccctgttgctccttgggtgggcacacttttcatcttttttttttttgtttacctaataagtgggagacctagccttgtcctctttgaaagtgcaccctgaggcagccttgccagtgtgcttgttgccgctgtcccggcttctgcagaacgatcccgccctttccgtgtcctcctgcactctgtgcacgactcttcttgctgtagccagagcatgtacttgcgttccgtttctgcatgtctgcctcttccacaagcctgtgggcaccacgaaggcgggagcggggcctccgcctggtttagtctcgtcttagaccttccccggttaagaggcaggcaggcaaatgaacctaaggaaaattctttttatttggtgtgaattgtcagtgtattagggttctccagagggacagaactaatggaataggtatatatatacacaaaggggagtttattaagtattaactcacacgatcacaaggtcccacaataggccatctgcaagctgaggaggaaggagagccagtcccagtcccagtcccaaaactgaagaacttggagtccgatgttcgagggcaggaagcatccagcatgggagaagatgtaggctgggaggctaggccagtctagtcttttcacatttttctgcctgctttatattctagccacgctggcagctgactagatggtgcccacccagatgaagggtgggtctgcctttcccagccc

SEQ ID NO: 110575 - DNA, 1741 bp, Homo sapiens
tcactgcaaactcccttcccaacacacaggtctgtagtgtcgcctcaccatctgtactgtgtcactgcaaactcccttcccaacacagaggtctgcagtgtcccctcaccatctgtactgtgtcactgcaaactcccttcccaacacagaggtctgcagtgtcccctcaccatctgtactgtgtcactgcaaactcccttcccaacacacaggtctgtagtgtcgcctcaccatctgtactgtgtcactgcaaactcccttcccaacacacccgtctgcagtgcccccctcaccatcggtactgtgtcactgcaactggcacatgttggtttgctcgttcatctccccagcgagcctggcatgcgccttccactgctggagtccctgtgcccagtaaagttcctggtgcatagcaggtactcaaagactttgaaaatgaaataattctttatcctaccctaacatggctaacattttgtccaagtgactgaacatgtggaattaggattttggatccttcatggatcagagaagagaggcggttttgctctgaaacagtaaaactctgcatgtttgtaactccacaggaaaacactgatgatttattatttcttctttgtatatagatagagtatctcacccttttggggaaaaaaaagtctttttgatgtgttgaaaattgttttaatcttaggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttacagattgttactttctggtgacctatgttgaattgaaacccccaaa

SEQ ID NO: 110576 - DNA, 1372 bp, Homo sapiens
ctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacattttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagatt

SEQ ID NO: 110577 - DNA, 1029 bp, Homo sapiens
aggtggccagtgttaccaaatcagcagcctgagcctctgcggggccctgtgcactcataacttaacgtttcttgggccaagcagagggcactggtgagggtgacgccagtgagtaactctcatttctactgccagcccctgctggcatagtgcagtgctggcatgccgggtgttccagccgtgtccccgtgcccctggatggctgtgctctcgtgtgcctgtcctggccctgcctctgctgtggaggtgtgtgctctgctgcactgcagccccatgcattcccaacgtgctgggcctggccatgcactccgtccccatggggccttgtcacctgagtgctggagttcctgtgtctccctgaagccctgggggggccgcgccttcagcttctgcctctcgtttgtgctctcatgcttttgttcaacaagtgcctatttcctaggccctgttctaggctggtcatgtggggtaatacggtgagagaaacgatgttgggtcatgacttagggtgggcttgtggcctgggggtggtgggagtggacaccttcgtcacacaagcaaatgtgaactcccgaacggtggcgtgctgggaggaagggcacaggggctgtggagagtacgtgtagaattgagatctgtggctgggtgcagtgggtcactcctgtaatctcaacactttgggaggctgaggtgggtggagcacctgaggtccggagttcgagaccagtctggccaacatggcaaaaccccgtctctactaaaaatacaaaaattagccaggtatggtggtgcacgcctgtattcccagctacttgggaggaggaggcagaggttgcggtgagccgagatcgcgccaccgcactccagcctgggcgacagaatgagactccatctcaaaaaaacaaacaaacaaaaaaagaatcgtgatctgctccatagctgctctttggagggctctggggccggggcttggcaggtgggaacatttctgcagttgaccctggctgccccgtgtgtgtgtctctagca

SEQ ID NO: 110578 - DNA, 1047 bp, Homo sapiens
agtaccgtgagttttcatttacatgtgaggaaactgaggcaaggggtggttaagtggtttgtccaaggatacagggaaataggaacaagttcatgcttctgagggttgttgggattaaatggggaggaaatgtacatacatgggacgcactgggcacatcgcagcatgttaatgtctagtctatgtttttatgttgcctgactgtaatttactcctgctttggccatcttagaattagctctagtgacctgagatggaacattgtaactatgccttttctgtgcaaacagtttgttaatattgctggtgactttgccctggcattatggatatacagatggcacctgctatggacctgcattgctgctggtgtgtatgagcttgtatgttgctgtgatcctgagagggagtgctgggtggtggtctcttgatgtcactgtttgctggtgtgtggtcctcggtaaggcaggtgctcagtctctctggggcttagtgtccttgtttgcagaatgagctgaggggtacgtactttacattagagttgcggcgatgaaaggaccattctaatcaaggtgttgggctgcagttgtcagggagtaaggaagcaagaagattcgaaggtgggcagactagtgctggaggccactgggtcagtccctctactgtgtgatgaggatctggagagagatgtgaacaaagcagcaaagcccgttgacagctcagaaagaagtaacagggctgagatgccagctggccttcgaaagtgctgtccacccgcctgagggtggaggtggtgagggatcagcttgtgcaaagtcatgggggcaggagagagcccagccttcctgggaaggtgccgtagcatgaggcgctcaggaggggcaggggtaggaggggagaccacagagatggtagacgcccagatggggcaggactttgaggacgacatttagtctcaagactcaaagcctgtcacagccagactgcataagatgaaagtctgcacaggagcggatgggctgccttgatgagaatgagttaaactgt

SEQ ID NO: 110579 - DNA, 1080 bp, Homo sapiens
acagaaatttgtttcccacagttctggaggttgggaggcgtaagatcaaggtgccagcacgttcagtgtctggtgagctgttgaacatgtttttttataagggcactaatcccactggggagggctccaccctcatgacctagtcacctcccaaaggcttcatttcctaatactgtcaacctgagggttaggatttcaacatgtgaattgggtgggggcacaaaccctggggttgtagcagtggggatggtgtgctgggttggaagctgtgtgaaagccatcaaggcgtgtgggagaatggatagagagggaaggaagcgttgctggggggcagcaagggccctgccaggtgatcagggaccagtcagcgtgctgcgcgtctttctccagccatgttttttgcacaggtacacgtgcagggcaggcttgtctttgagctaagtgtgtacagggaagggagagagaggcagggctcagggacgtgtgagggtgattacattggggcatggattctccgggcggtggaaggagggtggattagagaagcaggatggagaccctgaagcctggagggtagtggggggtcgtcaccgtgtgggcggggaggctccagtcacacagccggctgggagtggaacctgcagggtcagtttccaccacgtctgacgtaggctccccccggggccgttgcattgctgattgagccgcatctggtgagcctggtccaggagtgttggagaaaggaagtggaggtcttcattccactcctcccgggtgctgggtggggagagggaggcagcagtgccgtcccgggcgttgtggtggtgggcgctactttgctgggctggccttgccgagacacagcttcttcccatggtgtaagagcctccccatttgtgaacagcaccccatcctcagggagagcttgtctgggggaggaccgtggggatcagccctgactgttggctgtgcagatccctcttctgggggctgcctggtggccccagtgctaggagctgcatgagacagtggtgccatgctcggccaccctgcccttgggtggacataacctcacatgct

SEQ ID NO: 110580 - DNA, 1097 bp, Homo sapiens
gaagagtatccgtcccggctgcaggagtggagatctggttgtgcagtagtgcagcagcggcgccatcccccaggctctgtgggctggcctgagtgctgcatgggaaagcaccgtggacaccatggggaagagatgctagtgaaaccctctccggctcagccggtggcctcttcctcatcagcagtggacggcatcctggctctgccacccactccctctgcatctggggcaagtcgctttgcagacacagctttcccacgtgtgaaatgcagagttgcgtcaggcggtctcggcatcttccagcaggaagaaccttctggaatcagcagtagtccctgctgtcctcctgcaggcctggagacccctcctggaatggttttcctgcctgcctcttcctgctgcataaatgagaagaatccacaggagccccccccaggaagaatggccccctttgctgtgtgtcgactcccagctctgtggctggggcacctctcatgcgcaatgccacccgaccaggtcccccccagaagcatgcgcacccctcgagggactgcctctcacttattgtacgctggtgctcattagaactcagcaagtgcttgccagatggttgaattcagacgtcatcccttttcttagagattatctgcccgaggacccggtcctggggatgtagtggtcagcatacctgcgtcagtcttggggatgtaacggtcaacacacccacttctcccaaatcaaagcacccaacggcaagatagtcgactgagaccacactgcagagactgataagggatgctcagtgccaggctgtgagtcctgtggcagagttcctgaggagaggggtgggggtggggtggtggtgtggaggtggcatgggaaagctgggagaggctccactttacacaggggggtcagggagggctttggtgggaaagcagcatttgagcaaagatgtgagtggtgtgcgggtgaagcgtgttcttccgaaggacacagtggagacgaaggccctgaggccggcggggactggccttgcttttcaggcgtcacgacctacaccaggctccttgagaaatgggcaccagcggcctgtg

SEQ ID NO: 110581 - DNA, 1023 bp, Homo sapiens
aagtagcaggtgtgctggagtgtggcggagtggagggattgtgcaggacagaccacccctggccagaggctcctgagcagctctggctcactgtggccacatcttctattccaagagaagctggaaacccaggtttttctgtttaaaaatgttgaacaaatcaaactgaagaacacggcgtagacagaaaacacaggctcccaacacgccatccccgctgatggctcctgcgcacgcgcctacacagacctgccattgagcgcctagagtgtgtgggatgactgacacgcccggtcccccttcactctcgcctggccctaggaggaaggtggcatgatctctaattgcagatgaaaggaggcccagggaccggggttgcttgcccggggctgcttctctgtggaagggcaaggctggcatagccactgcttggtctcctcaaagcctcttgtgcctcacttctcagccaatgcaggtgatacgaggttacctcccaccttgtggctttctagatgcagacctgtgcctgagctgcctgtgcggggaaggagcactgggtctgtggccgggctcaggtgtgggggccttctcaccaagagagccgcggttcctcaccgctccatttgctagaagcgaacaaaggtggccccgggagtgggatggacagccagtaagctgcttccggctacttggttgtctttgcctttttaccattgatttggtatctcctccaccacaccccacagctttgcctttcttaggaaaagtctgggagtggagcaggagcatggttgcaccgtgctgggagccacatcgcttgctgtgtgctcctcttgagggtggcgccggccagctgttcttcatttgtactgggaggaaagtggagaaacttgtagcctgcactgggaaactagactccatgggtccaccggtacttgcctggggaggcctggaagggcctgagtttgagtcccagatgggtgaccttgagaactgacctaatgtctaggctattttccttgg

SEQ ID NO: 110582 - DNA, 1048 bp, Homo sapiens
aaaagaaaaaagaaatattacatgagtataataccgcaatagtttctacatctagtgagtttacactgaagatgtttgagatcgagcagtgatatatgtgtgtgtgtgtgtgtgtttatgcttggagtttctttgtgtttattctcctacttgtccttgctttccactgattgttattgatgagaggcaaaatgttagattttgatttcagactctggaaaatatctaatgataatctagaattagctggtgccataagatattttgttctctaagaaaccctgcaatctgttaaatactctgaagctgcactctgagtcaagatgtgattaggtcagtgtgcttctgaaaaacttttttccgtgttttgttcttgtaaaacttcaaaggctcgtaattgtcctacattcgtgcccttgaggaatgtaattatttttggcatcttttgacagatgctggtttttcagcagcagacagagaagccagtctggagcttattaaactggacatttctagaacatttcctaatctctgcattttccagcaagtaagtggtggtgacttgttgctttcaagtatgttttgtctaaaattcatagatgctgaactgtgtatatttgttgtcaagtttgaaaggtacttgggtttttgggggtgttaggaggtagggtggatgttactattaaatacatttagactttttaaaataagtgtaactgatcatttccaacaaatatttactatgtccatacttgtgctccaaaagacaattctgtcttcctcttgagatacatgtctcggggcccctgtaggtctggtctgagagggtccccatgggtggctgtgtctgctggcgctttcttggacactcctctgctctcaggactgtgtgtagcagtctgcgctcagcaaggccatgttggtgtgatgggcttcggctcagatgagcccagtgcagtgagcccgtgtgagaaagggaaatccctggcagcctgggtgggtggccaagccggggtgacaggtttctgagcaggtagaccaggagagc

SEQ ID NO: 110583 - DNA, 1031 bp, Homo sapiens
caccatgcctggctaatttttgcattttagggagagacgggttttcaccatgttggccaggctggtctcgaactcctgacctcgtgatcagcccacctcggcctcccaaagtgctgggaatacaggcgtgagccactgcgcccagccgcatcattgttttcatttaagaaatgacagaaatgacatttagcaccaaagtgagatggaaggatcgaaattacaacggtagaaaacctttgaagttaaacacatttagctttaagagaagttcagtgtaatgctcttgttttcttgtttagccttggcctggataaaactttgttacagtcacactagtccttagactggcatttggtgccactgcagaccgtcacccccaccctaggcctggatgctggcatttttaccctctcattgctatttttccttttgtccctctgtgatttggaactgtcttttcttttacttagctcttttcacatgctagaatatgatggtctgggccatggcattcttttgtaagccacctgtggtcacctgtggagtgacttcttatctctcaccatgtgtgatttttattccttgtgttaaatgtaggtacctggtagacatagacagtaagtgtttgggactgaacctgtccttttgttgtatcttctcacatgctaacttcagcgtgaggcatctctgcactttcttctgtgctccattggggaaataattccaacaattgactttttggaagcagttataagagcaagtggaaatgttagaggggtggaagagctgggagaatgtttaaacaaaatggtagccaccaggacttagaagagtgtatttcctaaacttgccattcagaaaaccaacagaaacaaggagagtgataagcctgggaggagaggcagaaaggatagtcaggatgtggggcacagtgggagacggcctgagtgacactgagtagtcacctgctttgaagagcccccgcatacctggctctcctggtgggctttgaaagggaacacagttataca

SEQ ID NO: 110584 - DNA, 1081 bp, Homo sapiens
gatacttctgtggcttcgcggatgtgtgtgcgcatgcatggtttgatattaagcttattgagatagataacacaagtctacggcaccgggacactggacataggaaagagcagtatttcagatgctctgggcctaagagggctggtttagggttttccatttgcggggtgggagcaggggtgggaactgaaggagagcaggccgggtggctggggtggcagagtggtggttctgagtgagggcagttcagcgttgggtggccggaggagtggggcggctctagggacacttctagtgtgagggtggtaggtttgtctttgctaaaaatgaacacactacggtgaccctgtggccactgtgattttaacgtgcctttctctcctctctcaggtccagggcatgtccttcatagcagcagtgttgatcttgaacttagatactgcagatgcctttattgccttttctaaccttctgaataaaccctgtcaaatggcgttttttagagtggaccatggccttgtgagtatcctctgtgttcgggccctgggtactgtgtctttaaatgtcaagagttgcttactcgtctgtgttttcggtggaaaaaaagaatacattttctctctgtgaagagatgtttagagtaagcagcactgtaaggtggaggatgattttgagcagcgtattgcatggaagctgaaaaagacacggttagtagccgtatgtctgggtttcttaatacgttctctcagaaaaacattacctgtatttttgaaaatgtattcttttaatgaaggaagaagtgtggctcctgcttaaacttaacacacacttggtgtcaaagtcacagcttgatggcagtgcccacgtttgggcctgttgggtagaacatgtcgtaatcgagcggtgttgctgctcattgtcaccctgctttgtgaagtgtgcccacacccgggagaaaggagacacgctggagaccatactcctttattttttaaaaggcagccatttgtttagtggaccgctctagtctttatgacactgcgtaagtgggaggcggtgacagtggggggtggtgacagtg

SEQ ID NO: 110585 - DNA, 1053 bp, Homo sapiens
aaaataattagctgggcgtggtggcaggcgcctgtagtcccagctagtcgggagactgaggcaggagaatggcgtgaacctgggaggcagagcttgcagtgagccgagattgcgccactgcactccagcctgggcgacagagcgagaccccatctcaaaaaaaaaaaaaaaaaaagttgttggtaaatttggtagctattactgggactgtaaattggcacagtccttttggaagacaacttggtattaagtatcaatagctgtaaatagcattggtgtgcagttctgctcataagaatcacttctaagaaagtcataaatgtggacaaagcattatgcacaaagatagtcattacacacttatttacaattgtaaatgtgagaatagctgaaatgaggttaggagaatgcagaatggtaaattaaaatttggtaagtgatcagtagtgatgcttacaaagagctgcattgtgagaaagtgttcaagatgttaattcagtgtatgtaagataaaacgtaaactatagtgactgttgtatttaacaataaaaggaaatatgccacagaattactagtgtttatagttttttgaatgatggattaatagtgtttatgtgtttcctaagttatctacagtgagtgtttacaggtatgactttcataatcaggtaaaaacttacctttccaagaaaagtaatggtcagaaacagaaaataaatcttgaggaagcgttcttactcttgaaataactcattggcacagtatatactggccttacgttgcttgtgatattaattcctgaaaataattcctgcatgtaaatttaattttatctttttataaataaatacatgattcccatctaagtttctgctgattttgaagataagaccccagctttctctttggaaatgtggtagaaattgtgcctaggaatcatagcttgtattttgaaggagaaaccatagagtcataatgttgagtggggtcttcatgacagcagcagattttctccctggcagccccgttgaacttaggactgtgtgactctgc

SEQ ID NO: 110586 - DNA, 1111 bp, Homo sapiens
cctggactgttctcactccactgacctttgctatgaaggacgagggttttggaggttgaatcttgtagctgaagccacaaggcgctggtgacaggacagtgaacatggggccgtgagtggcgctggcggggatgctgggctggcctgcctggctatactgggtagaagtgtttagggcctgctttaaaggggacctttattcagcaaatggtgattttcttcacagctgtgaacacaaagctcctgcacaggctgccccaccgtgtgcatttgactgcgagccctgcccctcagattcctggctggggcccgcggtgctggaggacgggaggggatccaggcaggacctgagcctttagcttctcccttatctgttttagggcttctgattagtttcttaggattctaggccaaaagtcaatagtgtctttcaaacttttcccacctttacttgcaaaaggaaatgtgttttaaattgtgacccaatgtgtgcagaaacttaacacgtacgtatgctgggaacggtggtttcatgacccagtacctaaccctgaccatgtgaagcattctgaaatattgtactttgttctatttattccaaaaaatgctggtgataatctgctttcgttgccttcgtgatccactggctgttgtctgggtcatgcctggcagtgtgaaaagtacaggcctggagaatagtgttgtctgcttctgtcccagcctgaagatggttgtaatccatgtaggggcaaagacaaaaggcaccagcgttttttgactcgagtgcttctcacacatgctgtctttgaacccttggaacaacctctccaagcccagtgtaacacttgtgttttatagaggaaaaaaacaggctcagggcggggtgcactagctcacgcctgtaatcccagcactttgggaggcccaggcgggcagatcacatgaggtcaggagttcgagaccaacctggccaatgtggcgaaaccccgtctctactaaaatacaaaaattggctgggcatggtggcgcgtacctgtaatcccagctacttaggaggctgaggcacgagaatcatttgaacccaggaggcagaggttgcagtgagccgaga

SEQ ID NO: 110587 - DNA, 1093 bp, Homo sapiens
cacctttcccagagacacgtccacacccatcacagctgggcctgcctccacattatgggtctgcactgtgcctggcggggtataaagcatgctaagttccagggctcagcagctaactgcctgagcaagagagccttcctcctgctcgcggcaggggctgaggggcctgtgggtgtggccagctcagcgtcctgggtgggctgtgtgggtagcccattaaaatggctacactttgggtcagaaaaatctcctgtcctgccacactgcctgcccaccaaacctgctccccaccgccccagctccacccactctctgagggtcccctctgtcagctgctgccccagtggtaaagcttcaagagtcacctctgtgtccccagtgcctggccccatgcctggctcagtgtcctaggtcaaagaatgcgtctgtgcctgagggtcaccttcctcggtcccttttccagtgcaccctgtacgctgcctaaccagtggctcatgaggagtcagggctgagggttcgctgtccttccaacaccgccttcctggccgttctttaattgtggcttgccactcctcccgatgaggcatgtggatcagagcaggggcccttcagctgtctccgtcttcctacagagttttcagtgtttcgactgtcaagcatctacattttgtaggactgactttaggtcatttcacttctgaaaatatttcccattgccggccagtggcagaattatctagaggtgtgagtgagctttataataaataatcttgagctaacaaaagaatcggggactacattccatgttatggttagcgtttctgaaattatgtttaatgatccttggagatgctgtcattgcctggagtttccatctttttttgttgttgttgttgttgagatggagtctcgcactttcacccaggcttgagtgcagtggtggatctcggctcactgcaagctccgcctcccggattcacgccattctcctgcttcagcctcctgagtagctgggactgcaggcgcccgccaccacccccagctaatttttgtatttttagtagagatggggtttcactgtgttagccatgat

SEQ ID NO: 110588 - DNA, 1039 bp, Homo sapiens
tatgtctacaaataacttaaaaattagccggtgtggtggtgtgtgcctgtagtctcagctactcaggaggctgagctaggagggtcacctgagcccaggaggtctaggttgcagtgagccgtgattgtgcaactgcactctggcctgggcgacacagtgagaccctgtcttaacaaaaagaaaagagaagaattatgttattttgcattagttgaagttgtacttgaaattacttttttttttttttacttttaaaaacatacttttatttattacttttaaaaaaataccatttttgatctacaacgcaataatatgcagtggtcggaggcaaaacgtaaacatcttttgggagagaaaaacccttgaattctgtcttccgaccatgggaggagtactgagccgtctctgggaaggccaaggggcccttcccgtcctgcttctgtgagcctgagggcagcaggggaaggtggaccttgaaccaggagggccgtgtggacagtagcccccttgttccgaccggttctgatcccatggcagggcttctttggggccaggacagagcctggtgtcccccttcagtggcctgttcacggctggctttcaaatctaaatgtggtttaaaataaagcccacatttggaagctcctgataatgatgtgggagcacctctgagcagtccctgctggaggagagaatgggagaagaggagcctcagttcaagactgtggggcggggtctctgcccttgaggcacttccagcctggagcaggggacagaagtggcttaggacggtgcagagctcttggagtggagtccaggggctggagaggccatggggagccctgactggggcagagggcctgggagctgcttgctgagaggcctgccagagcctgcaaggcccaaaagatgcaggatggtatgcgaggcagagggaagtgtccaggagtgtcaggagcgtcccttcactgactcagtgtaaaggaaggtgaagaatgccagggcctcatgaaggagggtgcgtgcagtgcagcgt

SEQ ID NO: 110589 - DNA, 1030 bp, Homo sapiens
cacaggcatacccacacacacacagatcacccccatgcacacacattgcacacccagtcacccacaatcacacacatacacaatcaccccacacagttacccacacgcacagatcaccccccacacacacattgcccacccccccacacatagatcaccacttacacatcaccccacacacacccacacatacatgcacacatcacacacctacacattgcatacccacacacacacctacagatcaccccccacatacacctatcacagccccacacacacgtcaccccacacatcacacccacacgtacacattacacacccacacacctcacatgcacatacacacccacgtacaggtgcaggtcagtccctgcgcatccacatactgcacacccacatacacaggaaaggattaaacccagatcagccattttgatccttgcatattttagggactaggtaaaaactattggttaaaactgggtcagattatttgaccgtaggacattgttattaatgggatggtgataggagttagtctgatgatgggggtggggggcttgggcatcagtgacgtgctgtcagttttttgtttgttttttttttgagacggagtctccaccctgttgcccaggctggagtgcagtggcgcaatcttggctcactgcaacctctgcctcccgggttcaagcgattctcttgcctcagcctcccgagtagctgggattacaggcgcccgcctccatgcccagctaatttttgtatttttagtagagacggggtttcaccacgttgaccaggctggtctcaaattcctgacctcgcgatccacctacctcagcctcccaaagtgctgggattataggcgtgagccaccacacctggtccaggcatcagtaacttttatacagttcaggtctcatgggacttgtggtccatgcacatttctctcaaatcctgtgcttaaggttaagacactggtgagctttctttttctttttccttctttttttttttgagacagagt

SEQ ID NO: 110590 - DNA, 1006 bp, Homo sapiens
gagttctctgcttggcgtggagcctgttagtgttgctgcaattgctaagcagccacaatggcgtggaatatcttttaaaagaagggtgttggcctggcatggtggctcaagcactttgggaggccaaggcgggcgtatcatgaggtcaggagttcgagaccattctggccaatacggtgaaaccctgtctgtactaaaaatacaaaaattagccaggcgtggtggcacacctctgtattcccagctactcaggaggctgaggcagaagaatctcttgaacccgggggtcagagattacagtgagccgagatggcgccactccactccagcctgggtgacagagcgagactccatctcaaaaagaagaaaaagaaggatgttgaccaagaactgtgagaacagaggagggagcaggctctgggtgagctcaggaaggcaggcaagaggaaccagtgccttgaggccttctcaggtggcaggcttcctggtggaggaggaacagggtggcaggagtgcagcgggatgggcacagggcttattagcatcctagcgttcaggcctgggcttcctgggtggccactgcaggaccccagtgaggcccccagctgtgctttgacgtggattctgtggccggctggaaggagtgcagctagctcaccaggccagagagggcacgggcaggtgtccatgttggaaagaccacgaaggacgtaggagtggaagaccctggagggttggaggcagtggaagtggggagccgggggaccctgttaggaggctactgctgtctctgcttcgctgctgtcaggatctgtgtgcgtggtcacttaacctcagctgtcttccctgtgacttctaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggc

SEQ ID NO: 110591 - DNA, 1001 bp, Homo sapiens
gaacaaaccacttcttacagccgtagtcccggctgatgtttacgtttacttcttgccttgaccactttgggagcctccttgttcgttattccccctccaccccattcccctattccacacaccataaccggagcgagctttggaagcacaaagcgcctcacaccggcctcagtggcttttacttcaattaaggcagctttagaagtgttgagcaatgagatctcatctgttacctcccttgatcgttttatatttcttctacctagagtgctctccctgtaaatcatggcccaggattgagctttccacttaaatatcagtgcctcagagggcccttcccttcaccatcccagcacttacctctacgttagctgctaaggaggcgcagagccttggtggcatatctgtgcgtatctcaggacattttcccgacagcccttggcagttggctttggacggaccagtttgacttcagagcctgtactcttaacttcactgtctgcactgccttccctgcggcactgtggaaaatacacagaacacaagacctggggaacaaaaacatctatgtggttttggaagaaaccaggctagaagtggagaggcctcttctaaaacaatactttccgaacgaatgtgcacacagagcacctggggagctggtgaaaatgcagattctgactcagctggtagaggaggcagagccaggacaggaagagaatggggctgggacttggtgcacagcgagcctggccaggctgcggtcagggcgttctcccgttgcaccagcgcgaggttacggtgaggcctgagagcctgcattgcaaccaggactcagggggtgcactggcccgtgaccacccacccccccggagtggtgaggcaccagtatttggtcgtgctgccatctccctggcagaacctcgttgcgttatcccccgggactttatttttcttcctctgaggctgttctgcagctctgagatgggtggtgctcttct

SEQ ID NO: 110592 - DNA, 1056 bp, Homo sapiens
acgatgacaaagggcagaagttagttccaccatcagggtgccagatttgggttccgcacagattctcttcacgtttttacaaaggctgacctagagtacttcctacagcaccgttacccaccctccccaaaggcattcagtcacacactgtcttatgagctgggctcaggggagagatgacaatgttgaagcaacaacacatgctgattctgtacatgagaaagtgaagacccagagaggcacaagctggcacaaggtcttggggtgagctggtggcagagctgaggccagaacccctggctgaggtttggactttgttctcattccccacctgcgaccagaggagcccacctggtactgccataaaccctgcactcaggggctgtctgaatgtcccaggagacagcagggcaggccaaggaatgcctgaactcgcctcattcagactagaaaacgggcttgtgccagggtgtgagaccaggccaagtccacggcactgcaggaggggacccagttctaccatgttgccacccgctggaaaagcaagggccaggacacctctgtgacgcttgtcctggccgcacacccatcctggccttcatgcgccgggggggctggcgtggccctttcctaggcagtgactgcagaagatgggcctgtggctcttcaagggagcaggccttcatttttagcaccttccacggttaagcagctggctgggagtctgccactggctgaaagcattcatcattcctacaagagggtaacccataaatacaaggtttaatgggaggaaactgtataactccctcaatcttttccttctgccgagaggcctcttcctcaaagtcaaccgctaaagccacttcagaaagtaactgcccaaagtgcgcactcattccctggccaccgcctctcagccacccagcccccacctgcctctgcccgcctgggtgtggaaccagcactgcagcgctgcctgcagcactgccagaggcccagctgaaaccagagggaccgccaccccatccaggctgatgactatgagctggcgtc

SEQ ID NO: 110593 - DNA, 1047 bp, Homo sapiens
ctgatggtggaactaacttctgccctttgtcatcgtaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttga

SEQ ID NO: 110594 - DNA, 1058 bp, Homo sapiens
acacacatttgcttcccccatgatccaatataagattgttactattgcttctttcagaggaccatgaaaagaatttctatcttaaaaaaaggaactcaatttgtttaaaaaagagcaacagtggggaagcggctcccctcccccaagtcattttggctggcacactgtctgagcatcaccctggctttcaaagcgtctcagcttcaagacgcgtccctggagatccagccgctttctgtgaggaaattcaaaatccttttctttaggactttgtccaggtagctaggaaggcggcttttggaggggattccttgccgcttctggaggtggtctttaattataatagtcttcacagtcacgtagcgggctggactcaagtttaaagagctgcagagcaccttctcgcgatctgacaggagctcgaagcctggaaggttctcaatggcggcgaactcgctgtctttgccgtcctcctttccccgtttggagccggctaggtttttgttctccttcctcttctcccgtttatgccgcgctgcctcgtactctgccgactcttccatcttggtgatcccgtttcgccggtaccgctgcagttctcggatcttggcccggagcattttttctttgtgcatgttttcaaaaaggtcatcaaactccttgcatgacatgaactggtacagcggcctcagcttcaggcgcagctccttctcctccttggtgatcttgcgcttcagcgccttttccttctccttcttgtccttccccaggaaggctggcaccagattgtagtcacgggcgatgttcttccgccgctgtctctctttcagcttccgcacgtacatgtccacgtgggcgcgcttcagctcgatctccacgtcgtcgtcatcatagttgacagagagcccgctgatgagcgtctcggcatcctggtcatactcgatctcgtaatcatcccgcagcggcatgtagcccagctgctgctgctcagccacagagatgtccagcgggggcagcggggtggtgaggctgggtgagagggggcctccgctgggaca

SEQ ID NO: 110595 - DNA, 1051 bp, Homo sapiens
cctggaggcctcgtgaaaacagctcgctgcaccctgccgcacaccattttgattcaggaggccaggtggggcctgcgcgtctgcattctaacaaacaagttgctgctgctgggccaggagccccaccttgagaaccactggggctaagacaactgtaaaaacttagcaccatctccatcactgttcagtggtagacagcataagctttctgtcatccgcatttattctgcaggggacaatgtggaggtggccctcatgataccactgctcagtactttattgtcaaaagagaagttctgggcttagctaaaagagcgcttctctgtcagcatgcagtatagtttacaactaaagccatatacaatatatttgaaatgttttatttaatgctgaaaattttaccctaagggacagtaggatgtgtaaaaagaaaggaaaaggcacagtaattaagtcatccttagaaatgatgaggttttctttctttcaaataacttcactttaatgtaacttcaagcccaaacattctgggaggtaaacagtctcttggtacctacggggcccgagaggcaagtcaacctccttgaagaacggagcgctggagtctgagcacgccaaagactctctttaaagcagggtcttggaccagagaaccctgagcagctggaagacaaaagacttcctcaagtttcaggaggaaggtaccgtggacatccttgaaagaggaccccagagaaaaacttgtaggcagggctgggaagaagccatttctgagtctgattcaagacagtgacagagagcagctcgaggctcagggcaccacccgggctccctcgtgctccaccagaaccaccgccagccaactggtcagacggctcttgcctggctagtctgaggcctcagctggcgcgggcctggcgacactcttacagatgcctactagccaggcgggcatgctcatattttcagtggaaaggtacttgcaactgaagaaaatcctgaggaagctgacgccagaattcagaactcttagccttgaactttgtacaat

SEQ ID NO: 110596 - DNA, 1065 bp, Homo sapiens
ctgaggcgattgatttgacaagttactaaatagcctccacatcaggtcagcagtgctcagtttggaattgccctgtgcggttggtatggagtgcaaatgatcttctttaacttcatccaggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttg

SEQ ID NO: 110597 - DNA, 1038 bp, Homo sapiens
gctactaaaaatacaaaaattagccgggtgtggtgacgagcaactggggaggttgaggtgggagtatcccttgaacccacgagacggaggttgcactgcacttcagtttgggtgacagagcaagactctctctctcaaaaaaaaagaaatacatatagatatagatagatgtatagatagatagatatatagagagagaccaatcctgtctctaaaaaaatatatatatgtttatcttagatctaataaaggcacattgtatatgacttacagcttttatatttactaatatagcttctatatgtcacgtacagtgtgcctttattagatctaacagaaatgttttctccccaagtaatagtaaatagtttgaagctattttaagtttctaaagtcatacatctgactttaataagcacaaaaactaagtcttcgtttctcacgtgtggacttccctgtaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggtgaggactgtgaggctcctgtgggggcgggctcggctgaactgtttctctcctgggccacataaaggttccaggtttcattggtgacagactaaagccagagttaagccgttgtccatggcctgcagtgggcccaggtggcaagttactgccaaagcaaagactaaaacccaaatcctgtgcaactctggttctggcaagagactaatctttacacgctgttatttgtcattgaatgaaaacttaaaatcatctttacaaatgaggaatgctcagtatggttgtttaggctgggacttaggagaggaagcagaaaattgcaagtacaagagttgggagcaggagtgtggttttatgtgatgctctcataggcaggtaggagttttatgaactagtaacatggattattactcc

SEQ ID NO: 110598 - DNA, 1104 bp, Homo sapiens
taagggtaaccgtttgccttccaagttcaagcccatttctcttcctcctctgcttttaggcacttttcccaattgactacctcattgaccagttaagtaattcaatttgcactctgtaaaaataaagcactcaataaaaaccctatgtttttctcaattattcccatcaataccacttaaccccagccaagtttattttctgatttttcatttgaccatcaaataggccttctgggcatccactttgagtcctgcagcagctatgacgtcaggcggctgctgtgtacctggctgtgggttaggctccttgggtggaccaaggacacacacccaggggttttctggctttgaggaccccaaactggcacaggggctcttagctctctctgtgccctagactcctgcccatcccaatcctggagaagctgatgaaactttctcagaatgaggattttataattagcataaaacaaagtatagatccagaggaaaccaatttcatggcaatgaagttatcaaaatacagttttagtatttcttcagtaacacttccgtaagaactagcagcaggtgtgatgatttccatagttttgaagttgtgctgagtgtaagccatactttgagatcgataacaactgtgatctggtcttggagatagctgtgatttctgttggtgacactcaggtactgatgatacatttgtgacttgttgcctacttcataatggaggaaatgcctaatttcagctggggctggttgaaaacaaagaggccattgtttctgcatccaagttcatgggttcctgaagaaacagcaggcagagagaatcaggagcatgtagaaataatgccctgaggccggacgcggtggctcacgcccggaatcccagcactttgggaggcagaggcgggtggatcacgtgaggtcaggaagtttgagaccagtctgggcaacatggtgaaaccccgtctctactaaaaatacaaagaaattagctgggcatggtggcagacgcctataatcccagctacccgggaggctgaggcaggagaattgcttgaacctgggatgtggaggttgcagtgagctgagatcacgccactg

SEQ ID NO: 110599 - DNA, 1075 bp, Homo sapiens
gctctgctgcctcctggcttcatgtggccctgcaagctgcagacctcgtgaaacttcatctttctcttccctaggagggaaaggacactgaactggccttgttgtagatgggagcacatcacatgtggaggtcttgccccggtgccggacagccagcatatgctcagatgccccctcctcagctggctctgtcaccctgtccttcagcgcccgagagcacgccccgcccccgtctgtgaggacttgctgctgtgccgctcaccttgggccttgcttgtcttcatatctttgtatcccagggctcggactccatcccagcttctggatggcctggcccattctggggtcttgagatacttgtggcctctggggtgggaggacttgggaggctgtgtagagagtcaggccaggcacctctctctttaggaagctaccagcatccccttccggaaacggtccctgccgggaccccagcgtgaggctggcttctgtggccggctccatggtgctgaagcctatccccttcgtagactgtttttggtgggtgggctcgtccccttctcgactgcatgtttggagcagtcaggcacagagttcctgaagtgcaggtgctgatctttgaattttgagatcacttccaatctgtttttttttttttaatcttttcactcacctccctgctgtggggtcgggtttttggcatgatcagagaagggacgaagaccaggcagaacctaccgaccaaccatgagtttttgttgacatcatggattgctgacatctacagggctttggcccaaatttgtgtttgccccagagagcattttgggaggtgttcttggagcgactcacgtatttagcagtgagctatggctctgggccagatcctctgccgggggaaggggtgaagtccatggttgggaccgagcatggtccatgtcctggtgaggttacagccctctgggacgggagcagatggtgacttgggggccccagggcaagagcccatgtcggggaggctatgaaggatgcatgtgtgatgggggcctctgactggggtggcatcagggagggt

SEQ ID NO: 110600 - DNA, 1138 bp, Homo sapiens
tggattcagacattataatcaccacaccaggtgcgtgtcctagctgtgtgactttggtcaagttacttaacctctctggacctccaattcctcatctgtaataaagaagatgatgacctttccgtgccagtgtcctgtgagaattgaagacagaatctgtgaagtgcctggcctgccaaaagccttctggaacagtagtgatgatcactgtcatcgtgtgtgaccctgggctgtgtgcctgtcttgtctcattctcagttttctcatctgtgaaaggacagaatttgactagtctattttttaaggtccttgttctttattcgattttattcctctttccgggtgtacactacttttttagtaattataatatttgaagcccaatgctttaatcagactttggcaaaaataactgatcaccttaagaagacaaatgttccagagattggagaattccattcgtggcctgagaaaggctggcttctgtgttaggccagggtatgaggatagctcagggggtgggaaccctgagagcttgtgtctggcactgtagggatggggacttgatgagccattggattaggccagcagggttttagccagaagtatcatgggccccttgatttttactgtaagtcagtttggcactggtatgtgggattatgcagtttgtatcagtcaggataggtagatagtgctgcagtaacaaacagccccaaatctcagtggcttaaaagaatcatattctattatctcatggttatatgggttaactggatcccctgaatagttcttgcttgcttgtgttcagatggtggctgggactggagtcctttgaggctcaaccgggctgggtgtccaagctggtttcttcactgacattttaagtacctgggctggaatggctggaagagcttgggactggctggtgtcactctctctcctgcagcctcttcatgtggcttgggcttcctcacagcatggtggtcccaagagtgactgttccaagagtggaagtggaaaaaaaagtggaagccacctatgtcttaaggctgaaaccagaagctggcacagtgtcccttcagctgtcttctgtgggccgagaagttgcagagcaagcccaggttcaaggggaggg

SEQ ID NO: 110601 - DNA, 1021 bp, Homo sapiens
ctggtgtggtttcaagtcagccagcttattccagagacatttcgttgtgagtattaataaaaacaacatgcatttttgtatgtttccatagagactttccaagatttatgtccctgagacatatcgttggatcctgtggaataactacgttcccagcgtcccgtgatattctgcaggtctccccggctgagaggcagatgttgaggccatttgtgtatgaacaagaaaaggacagactcaaccggccttggggtctttcatgtattcggggagtgcgaggtgtcagggtacaaagaggcgaggccgaggaacagctgggcaggcagcgcttttgcggctgcagttggggctgcttgaaagtggactgtgtctgccaagaacagtgggttccctttcactttgttacttaataggagaaacccaggctttcgctgaaggcgagaagaacggggccttttaatatggactcgttgccggaaccgccacgacaccagggcaggctggccagtgggcgcagggccagccaccagaggcaacgaggaattctggtgaggacgctggagtgggcattaggagggtagaattcttgtccctgtctgccaccaaagactgggtgacttgggctaagacagagctctgtgggtcccagtatccttgtctgtaaaatgggtgcattgggataatagcctttgatttgcaggtgactgaagcccaattcaaagtagcatgagaagaaaagaggactatatatgactttgcatcatggaaagtttcaagggtagtggccagcttcaggtgtggcttgttccaggggctcaaacaatgccttctgagctctgcctcttttcttgctctctggtctctgctaagggatttgctctggaggtagtaaggagtcatcataaaattttattagggaattgaacaaattttttaaattaaaacaaatatacatacgaatattcaaaacgtggagagagggttggggggaccaggactgattttcaccttgtccagttgt

SEQ ID NO: 110602 - DNA, 1082 bp, Homo sapiens
aggcaggaagaaggggatggggaggtgagaagtcctccagagacaaggttttttaaaaagcgatcccagaacccccaccatgtgactttgcttatgtcttgttggtcgcagctggatcacatggccacctctacagctcctttggagtccaggaagcaggtgtctcagctgagcacattgcatccgggacagaattgggtttgggtggcaaggagaaaggggaaagcagggactgggcatcccacattctgggggcaggacctaatgatgacagcggccagtacttatgacacacacccctctggctgagcctcctctaaacgtatggtgccagtcatatcacttgcaaggtggaaaagggtctgggaaggcctcgagtcactcaactccctgacccctgcagtaccaccctcagcagtgagcccctcacccctggcctgagtcatgttgcagagctgagatactacctggcatctggggggcctcagcacttgtggaggctggggagtcgccaaggaggcccgaggcaggagagtgggagggcagggtcttccagagagagggtgagcaggggctctgggggaggaaactgcaggaactgaggggccagtgtggctgggagggagggcatgctggggccaggtgtgggcaggatgggcccgggtggggcagggcagagctcaggggccggcagtgcatgggtttagagcaaaccgcaagactctgggggctggccaggagggtggtccgtgcttctcacccccttctctttttttggaatgttcctatgatggttgaactttttcattgaacatgtgttacttttataacacaaaagaaataatagagtgatttgacttttgaaaataaaggctctacatacttccccaaatgtctttgcaccagacagcgactctttattagctccaccttcacaagccctgagtgaccgtgcaattcatcacccaaaccaggatgcttctgagaggggctgggggtgcgggagggattggcattgtgccggtctgacaggcgtcagccaggactgttgcaggcatggagggcccttcctcacctaaacc

SEQ ID NO: 110603 - DNA, 1053 bp, Homo sapiens
gaagcggctgagggtgggtgctgacaactgttctgtaagcactgagggagaacagggcttcaatggggtccacaggggcagactgagaagctgtgagtggtgtgtttgttcatgagtgtgtgtgcccatgagtttgtgcatgagtgtgtgtgtgcatggtgtgtgtatgagtgtgcatgcacaggcctggtgtgtgcatgagtgtgtgtgcttggtgtgtgtatgagtgagtgtatgtgcatgggtttgtgtatatgtctgtgcatgagtgtgtgtgcatgagtgtgcatgcatggggtggtatgtgtacacagtgtgtgtctgagtgtgtgtgcgcaggcctgtgtgtgtgcacagagtgggaggtaggctcctgcccactgtctttttctagaggccatctttggctccctatggaccctctgtttgtgctgctggcatagtcaggatgcctggaaccctgttccaagtcagaggtgttgggagcctccagctgctttcatccctctccctctcaggggcactttcttgactccaccccaggccgagtccctgcgtgaaactcctttagggatcagtgttttccactccaggatggaggtcagtgcccggtggggcctcaaggcagtaggagcacccccaccaccgcctccaaccccctgccccttctgctgctccagcctggctggctaccttgggctttgttgagcagcttctcctctggtcacctttccagggggcagctggggacttttctggcctgtgtgtttggggtgggggtagatgggctccgtatttggggtggacacctgctcttcttccgatgccaggttgacccttacatgaaacccatccccttcctgggtttctagagcggtgtcagactggcctgttacactgagcactggtgggtttggtaacttgaatgaagggcgtgaccagttggagttgatattgcagacatgccagcaacctcagggcagttcctaaaggtgcccactggccacccacagctccttgcccaccccacacatctcttcttcactccccctc

SEQ ID NO: 110604 - DNA, 1086 bp, Homo sapiens
agtgggtgcccaggcctgagagtgggagcagagggggcggtgaggatgaaggaggagcctcgtggtggccatgccccctctgtcctgggccctggcatgcagctgctgtctctggacacaatgtgctccctctatctgcctcctggcccagcccagctgcacttgctgagcctgctctcactttcccggggcctcatgcactggggcctaaggtgtaccgcgtcccgctgcacgggaaggccagagttggcctcatctccgctctaccaggggcctggcagggctggcaaagtagatggtgcccagggggttcactgggtgaatactgttgattgactcacacagaacagaagtcggaaatgcaggaggaggggcgcagacaccctgagaggccgggacagcccaacccccttgtccagccgctcaagagtctcagcccctaagccgtccctgggctgcacacactccgtggactacaagcttggcaaagagatttccttctcgggagagtttgtgctttggattcaaatgggggaggacctattctgactttcaaatgaggtgctgagaggaggggctgaaattccagtgccctctgcagagatgattggggcctcaagagcactgaccagctgcggctcctcagcccctgcctgcctagagcctgcctccccacccccatccagactgtttcagtttctgctgaaatctactagggccttgaggacggccctgcccgttttttatctttttctgtattccagtagctctagttcccagttctgccctcaatgggtgttatcacacataggaaatgcctttatgaactgtgcattattacataagtatcactcagcaatggggtcaaatattatttatgtattaataaccgccagttttgcaaatggccttaggtagcttacttgtgtacttacacttcactaagataacaaatagttgagggaattagcacaaagagcacataatgatagcaaaagaacaaaactgaatgtaagatgaggagcatcctagcagccaaagtgaaaaggagaactggattggttacagtagtcctgcgacccagag

SEQ ID NO: 110605 - DNA, 1047 bp, Homo sapiens
tttcctttcaaaccgagggcggttttgtcacttccccagtcgatgctgctggtggcagcgtggggtgctggttgagcccacagaagctggcggcagctcctggatttgactctggctctgctgagcgccctggcctggaaggagtctctcaacctctccgtgagatgggagggcagaaggcagtggggatgtgggtggcgcacaggaccttgggctgcagacgaggctgtcatcctgctgctgagtgcacgcaccaagctcatctgcatcatctccccaggtccccaggcccccttgggtggggcgggtgttggccccatctgcagatgaggaggtgcagggcactggggagtaggtggggggcttttcatcttggctctttccctctggacaaaggcacttcaggtgtggctccaacacctgccagccaggcagcgcgcttcacctccatgagcctcagtgtctgcgtctgttaagtgggggtgattgctttgaggtttaaattaaatgttggcaaaaacctacctcccgtggtgcccagcacatcacagacccctaggaaataatgaatgaatgaatgaatgaagcaggcaagaaggaacagctggaaaagctaactggttatctttattcctgaaaggagaaatttggggaaaactgttggtctcacacagctgcagggcactcggggctttcactgggcaccctaagggcctaaatggggctgggggcagctccgtggaactcaatggttttaactctatggatctggactgtactttgctgcgaggtaatgagttcactataccttggggacatgcacggcgctctggaaggccccttggcagggcttttccaggcctggcccttctcagatgagggaatcaagtgactatgaaatttccctgcagcctgagctctgggaccttccctccccccacgcccaccctccggtcttcttgctcttcaggcacagagacacccgttaccatcctctaagcatctgttgagcaccagacataggcagtgataacccagcgggatcca

SEQ ID NO: 110606 - DNA, 1108 bp, Homo sapiens
cttccataattgttataattcctctggcccagaggcctgtttcaaagctgttgctcctgggcctccaaggctctgtggacggcagtactgtggaaggcacgtggtcgtgctggggccgtgaagccatacccgcaccagggagctgttggtctttacagtaaaccccaggatacccagcaaccccctgacacacttctggcagggcagagcctgccaggggaactgcacctcttggccaagacgggctcttccattctgcctggaaattcacacagatgtggtatcacctgccatttcgccgtggcctggatgtgaactgtggcccgtgagggtggggacaggagggctgctttcctaatagagaaaaccagcccatggagcgctgccctttttctcacccctccgtgtgcacagctactcttgggtaggaaccaaggctttctctttgagaaatggccatctgtgggacaggaggcaccagtatgagtgacaagacagcttgatccaaggatgtgcacaggaaggaggactcctgactgcagtgcaacagctggtgtaggaaagttgtatgagtcagccacagctgcgtaacaaagtaccacgggcagttctggaggccggaagcctgagatcgaggtgcctgcaaggttggctgggttcatctgcagctgggtgggggcaactgtcccaggctgctctgcaacttctgggggctgctggccatccttggcgtgcatggcctgtagatgccccaccctggtctctgcctgcatcttcacacggtgttctcccggatagcgtctctgtggccatttttgtcaggacacccagtcatattgggctcaccaaatgacctcattttaccttgatcccttctgtaaaggccctatctccaaataagggcacattcgtaggtcctgggggttaggacttcaacataggaattttggggagcacagttcaacccataagagggagaaagcgaagaaccagctcagacgtgttcatatttgcaaatcctgggtttgggaagtcctgggaggagtgtctcctaaaagggagggtctccaggaagatgtcaagggagaaggccccaacccaggctctg

SEQ ID NO: 110607 - DNA, 1058 bp, Homo sapiens
aatgatcattctgacactccctgtgtgccggccctggtgaggctcaggagatggaggtgtctgaggctgacgcagttcctcccctcctggggtgcacagggtggtcagggaaggcttctaggaggtggtggccttgagaatgagcaggagggaggcagtggagaagtgagaaaggggagagcatagcgatccaagtatgcaaatgcctgcggggtgggtgacagagtcaaggccggagctcatggccaagggggtgtgtttggagtgcagtccgcggtagtgagagtggagggaaccagactgctgagggatgggaggagccccggcttcctgatgaggctgaaggacagtgagcaggggtgcgggcctccctcctggggatgccttgccagggtagcccctcaaatgtgagcgacgaaatgaagcttctgcaggcctggggtggggctgcctgtgggtctgcatttccaggagctcccgggaagctgcatggccagtccccactgtgagggggaggcccacggctgtgcagcttagccagggagacctcagtgacactgcgggctttcaggggccttggacactgaccttaagttctccctttttcaatggggtattgattttggagttggcaatcaacactaagttcttgcagtcttttagtagtagtatttggtgctttatgtgtattgattgacaactgaattgggcctgagtctgtctgtctttttgatgattcttgagcctccgaaaggcagccatgtgtcaggctgcttcacaatcatttcccactggctgtgtggaagactcagtgtcctaagttggaggtgctcagaacgtttcttgcttcttgtcttaagaggggcacatttgaagaggcgatgccgagtgctcctgaagagcaaacctggtaaagacgaagcttgggggaactgggcgctcatgcagggccagggttcaggctggctcagaaaacctcagtgtgtgtctctccaaagggattattgcgcgtctctccgtaaggagcttgtacccggggccattgccgtgctgctgaa

SEQ ID NO: 110608 - DNA, 1050 bp, Homo sapiens
tgtgaggtgactcactgctccacaccttggagtcatcagactttccatgtttgcactcaagtgggtgtgagattacagcttaatcttgttattttgcatctccctcatacctggtaagatggaacatatttttctgtgtttattgactttttgggtctcgtcctctgtgactcacctgctcatatctcgtgcctgtctttttacattgggttgcttaactttttcttgacccgtacctctctactctaaaaagcccatgtcatttccaggccccttaattttaagatgtgccctccaaatgtgtcttgaactcctgccaggtaccattcattctttcccaacaccttctaaggaggtttcctcctaagaatgttttgccataccacattcatgtctcgaagtgcaattgttagaatagcaattctgatggatggtgtattagtcagctatatggcaataacgaacccagtggcatgcactcagcatttattctcacatcactgtgttgactgtggtttggttactttggccaaggcttggctgggtgttcaggctgttggctgatgggcttgggtctgcttcatatctgtttatactgggactcgagctgacaggaacaggactgaggccaccaggacatgttcttcttatgcagaacaccagagctcaggaaccaagctcaaccacacaagcacattttaagacttctgctcaactcacatttgctagggttccatttgccaagccatggtcaggttcaacctcagtggggcagggggagtacagtttgaggaggttggtggggtggagggaagggaatgcttcctgaatggtaatttaaggtatttcaagtaatagctgattccagagaatacatatggtgtggtcatatttgataaatatattttagggaagaaagtttcagatttctttacggtaggatttatcagcgtctctgatacactaatacacattatacttctccaggagaaggttacacaacatttcttaatctcatttaattccataatctttaatttttctttaaat

SEQ ID NO: 110609 - DNA, 1043 bp, Homo sapiens
gcttggtagtccttcctcccttgtctctgatgtcctcagggatatttctcccttcagcacttgagttgttttctatggatcatggcaggaacagtctcccgccagagaacccaagatgatggggaagctggttgtccacctcaatcccactttttccagggcagaaacagtgagttggtggtaagttttctgcaggctcagtgccaggcaggatggggacagaggcatcaaggatgtggaagtccaattttcttaccatctgctctgagtcttttcacttctctgtggctctgggaacagtctcatcttcacatttgcattctgaaatattgctggtgatcatctcagtgttgtatatttgtttttggttttctgtgggtgggagtgaagccaggttgcttctatgctaccattttggaaccggaagtctccttgtttttttctgtcttttaatgtatagaattttaacatatgttgtgaatgcagtctgaggaatttgagcagtgaagcccaacagcaatgcagcgtcctctgacgctcactgatataaagaagcatcaaagtccttctctgcagaggccaatgatggccctgggggacatccccatggtgtgaccatgctgaaattgacaaagccttctgcagagtgtcttaccagcctatgggctgtcctgggtatcacagcattcctctctgtgcccccataatgttggagcaaacaaagagctgtcatgctgattaggctgttcttggtagataacgctgagagttcatagccagttttcagatgggaaaatttaagaggtgatatgctttgccctttggtcatccagaaagagggggacttcagagagaaacagtcttacactgtaaggggaactctacccttaaggtgatgacaagcatggaaagtcctctgtgcacatagacaggccttcgtttcaattctggctccatatttcccttcttggtgacctctctgggtctcctctgtaaaatgagcctaaacattcagacctcattgtagacctcatgggctctta

SEQ ID NO: 110610 - DNA, 1050 bp, Homo sapiens
cgaccttgagatgctcacttcccttgtcgacccccacctcctcatctgtgaactgaagtgggaggggttgaaccacaccggtgcagtccagcctggtcggtgccccctttgctacttttcctccatgagccctgcatttcggaaaaccaagtccaccatcttgtacgggttaatcgtcacccacctaacgtggtcagacacgccacctgggttcagcatgtcagaacctgtgcctccgtcaccatccattctctgaccttctcctgtcactgccctcttgagtgggccacctgggctgatttgtctcagagcccagctcagcctcctcgggccatgccgttctctgggacaaggggcccccaggctgggggaatgtgctgcccggagcctgcagcctcctctaggtcctggatgccctgcccgcttctacagcctgggcaggcccctcccgtggccttcctttccgtggacactgcccgtgggcccacaatggctgcctagggagagaggtgtgtggaccgggctggtgtgtaggggctggggtctacactcaagtttgagaccccctgctgtgcaagtcagagctgggggcagaggtggggtggtcccaggcccccttggtgctcctgccctaatccccttgtgtgtgagtgctgggctaggttgccatccaggccatctctcagacccacacactccttagtgtctccctcatctcatccacctgcaattcctccaggatgtcccggaacagggacctcctctcccatcctgtggcaccgccgtctctcgcctggacgccacaacccaggtctccctgcgcctgcccttgtccccgagagtccgttccaacaccaaagtgaacttcagagagcacagaggcctcgtcactgcctgctaataactgacccagggcttctcagcacacccggaggtccatgcagcctccagggcaccccgcggggatccgcagaccacggcccctctccatggccagatctctaaaggccctagtatgtacccgccccagcacctgccacccctccccta

SEQ ID NO: 110611 - DNA, 1006 bp, Homo sapiens
aattattcaccaaaaaaaaaaaagagacagagagagagaacatcgttgggtatatttgtatctggtttgaagtttctaacaacacatcacttctaagaaaagccccaagccaaaacaaacaaacaaacaaacaaacaaaacaaaaacaacaacaacaaagcagctggaccaccaagcccttttccaggctcccacagcccctctgcatctggtgtggccgagaaagcccgaggggcagcatccataggtgttctgggacgtcccaggcctccgccttacgatggcatctgaagaatgcccagcatgtgtctggctgaaggtgcaggtacttgctcggctctggcagcccggcgggagccctctccctcctcccaggcagagatgctcctctgtgcggcgcagtcaccacctctgggaaatccatgctcaacatctgtcttgatttcccatccttgctgggatgggtctcccaaacttctaggcccagtagggccagctgctcttctcctgggctggtatctcctctcccacagctggacagttacagcaccctccgctgaaaagccttttccagcctgaacgcggcggctatggagtcatttggatggactccttaagcctcagtctcagtgctgaatggtggtgctgccgtcagcaccagtgggcccgtcccttgctcctcctgcctctctgcctttagaccccaaggcagccactccccacgagcacttgcagagcacctcctgtgttccgggcttggttccgggcacaggggatggaggtgactgagaccctgccacaggcctccacagctttggtggcggatgagtgagtggaggggtcagagggcccctatgggggtggggcagggccgtgctcatgacctgggtgtgcagctgggcctgtggggtcatggccagtgagctccgttcatcacgggcaaccatctagtggagacgcatgtgctcagtgggtctgtgggagcagctggtacccaggcccaagg

SEQ ID NO: 110612 - DNA, 1054 bp, Homo sapiens
actcatgtgtgcggctcccagatgtgtgagcacctgctgcgtgcagatgctgggccagctgcaaggacactgcagggtcatgcccaggggctctcctggagggggcacagtgtcttaggggggccaaacagcaggagcagaaaccacaggagcacttgaacccagatggaaaccccccccggaggctttctgccagagggggcaccggggcgaggtggaggcaccagggtaaggtggaggctgttgtagcagctctgggatctgcgccttccctgagaataaaaacacggcacacggcatttggagaacgcttgtggtttatacagcgcttgcaccgccagactctcctgggtgccccgctgggcccctgagatgggttttctggtcccagcagactcatgaatgccggtctcgggggaaaggggctccagaacgtctctgtgaattgtctcaacattcttgtgaggcaggtatgatcatccccattctacagattagaaaactgaggctcagacagctggagggctgtgttcaccgtctttgccctcgctgctccacatcccggtggccaccccagactcctccggcttttcccgggagcttttgcctggcatattttgctctcctgactttgagcacaccccaagactttccttctgctcattaccagggcagcggagggtctggggtgcaaggagagagagggaccctgtagtggctgagacatggggggggactgctccgaagcccagcagcccttggagaatgtgaccaaagccccagacctctccccggaaatgtccagggatacgtgcttgtcatacacacctttggcagccacccccagggactccaggttgagaagctctggcctgagcgagacccagactcccacccccggctgttggcaagaggtaatgaccctactagtgatgggccctcgaagcctccgtccacccctgcctccgctcaccccggccatgaccccagcctggctcacagccagatgtccatccagcagaaggtaaaggggcacctgagcccatgggcaggc

SEQ ID NO: 110613 - DNA, 1271 bp, Homo sapiens
gccatgccaccccaacccctctggggcattggtgcacggatcaggggacagcctgggaagctcagagaagacaagcctggagccactgcgtggcccaacactgagttttctgatgttgctataatcttgggcgagttacttaatgttccttgggactcagtttcctggtcagcgaaatgggaaggtgtcctcctgttctgaagtgatagtaaggtctcggtgaggttcccttcactctgtcctctgctggtgtccagagcatggtgggcaatgatctcgctaactcctccccaaacagctttcgtgctgaagggcatcctgctctctccctgtatctctgtgggtcgtgggttcagatcctgctgccttcgctgctgcgtatttgggtgacttgcctggcagggtctcctcgtccctaacactgggcaccccctccggcaccgggctgcacttccttcccctctgttcacccacctcgctggcgcctgatgccccctttcacactcagaatctggagcgccttctggaattttattgaacaacttcactgtcccacaattgccctgtgtcaccttagttccctcttcctctctgatcctgggagggtttgttagaaagtctgggtacctcttcgcgggttctgtggagccatcgggtcctgggcgccacagcggtctgtgtgtcttctcatctcacagcacagacctagcctgaactggaacgtgaccgaagctcagaatgaattcccctgggaaaacacatctgcagcacctgtcacctctgctgagactgaggttccagtctggggttccctttgggcaagtccctttcccactgggcctcagtttccccatatataaagtgcaggtgtgaatacatgtaccctcaagaggggttctggggtccactcaaggggccttgcagctgccaagtgcagaacaggtgctggcactcagcctcgcagctgttagggacacagcggctgcgtcttcaagcaaggggtggtccatgccgtaagcaggggacaagctggagcacaccggcttcccttcagtggcacagtgacacaggcagtgccacctgcccaccactctgttcctgcttcgtgcatgttctacacacacctctggaatcctcaggacaggcacaggaggtccgcttcattaaccctttgttcagatagaaaaaaatcctaagtctcagaaaggtgtaaaccttgcccaaggccagagcttgcaggcgggtgctgcctttcacacctgcgcgtgtga

SEQ ID NO: 110614 - DNA, 1053 bp, Homo sapiens
aatagaggattgacccgggtgactctgattgggaaaagatcactttgtttacaggggcagttgcatgagtgtgtgccttgccaggtctgcctctctgttattggataatggataggttttgcaggaagacgtgaatactattaggactccatttagcaacaattacaggccgagcagcactttatagcttcttggagaccactttgcaacctgtcttagggaatgaattcccttttatttttgtctcgcctgcagcagaatcagcagtccctggccttgctgctcctggccaggcagcctactattgtcatggctggacccaaggccctgggggccctgacgacccccacacatcccctgcaatgctcagatcagcttcgggccgacagcaggtttccttcccacttggccccaggagccctgtggcatggggaagtgtgaaggcacggcccagaggagctggcccaggcatggaatttcttccaagcattgtgttttatatgaaaaatttatgtgaatgggcatcttactccattatatatcagtgttggcttgaatattaaaatcacacacacacacacacacacacattttcaccaaaaaatctttatgtcaagctggtgatctgggagaaggccaagtcctgggacaccctggcccacccaccatatcacccgggcccttgaccccagatatgagaagcacagggttaggacaaaatctccctgagttcacctcttccctcattccgctcactcgcccgtgtcttcgtaggggaactgccacgtgttagtaagcactcaggactgagcaatgaatcaagtgaaaattttgtttttaagaagctcaaagtattgcggaaagtgaaaacctccacttggcagaggcggtgtggtcatgataaagcatggccctgtgtcctgaaggccttttatgaaagttcagccctgttctctaatctctacagcagccctgcagggtaaggatgctcatgggccattgcacaggtgaaagaaattgaggcccagagaggccaagttgtttcccccaggc

SEQ ID NO: 110615 - DNA, 1043 bp, Homo sapiens
aggtttgggagggacttcgggcatagaacatatggtatttggtggctggttgttagcgatgataccaacagcagcagtagtgagaataacgacctttataggcatgccctcttggctgagacccgttttttttgtttgtttgtttgttttgttttgagacagagtctcgctctgtggcccaggttggtgtgcagtggcacgatctcggctcattgcaacctctacctcccgggttcaagcgattcttctgcctcagcctcccaagtagctgggactataggcgcctgccaccatgcccggctaacttttgtatttttagtaaagaaggggtttcaccatattggccaggcttgtctcgaactcctgacctcatgatctgcccacctcagcctcccaaagtgctgggattacaggcgtgagccaccgcacttggccagctgagtcccgttctaagtgccctgtgtgtagtaataccatgaggacatggatggtaggaactatttttatccccattctacagagaggaacctgaggctcagagagtttaagtaatgtgtctgaggtcacacagcaggggaaatggcagagccaaatttgaacccagacacctggatctgtcatatctagagcagcgcaaatatggagactcaccaggtctgtgtgtgaaccaagagctttccatgtgactgcctggggcacggaatggcggggctattggagcagcaaggagacatgagagagaaagggctggaggatgcatttataaaagacagccgagaaggggaatggctatttattgctgttgcaaaggtctgtctcttaaaacccgagtcgaataagagaaggaagctagtgcattctggccgcacagacaccctgccagggtactgccttgtttatgaagaagaaacagtaaactgaaaacatgacctccagtgatttgtcccaacattaaataatgactagtttgaatttaaatatgtggcggaaaattatgctccgatcccttcctctggaaagggttcagggtgtttgattaccga

SEQ ID NO: 110616 - DNA, 1022 bp, Homo sapiens
gacggggaaggtggacgtgagctccagagagcggctcaggaactgttcaagccacccacccccaccgcccccatgacccgggacctccggatgggccttgggatgacaagggtctccgctgcgcactctcatggtgacttgtctcttgtgtatcagtggtcagcccctctgctcagtgtgtggagtctgcctaaccccaaactccaatgccatctgccctgcactttgcattttatttttagcgaatgcagccgggcaccctattttccttcattccttggcagttgtgctcggggcggatagcgccagtgaatgtctgaccgtaatcatccacaggccagttttcaatcatgaggttgatgattagctcactaacaccctctccccagaccgtcaccttggggcccccagactaattactgcaggacgcgctgagtaaagttcacaatgccagggaattggggggaaatcttatcagctctgaaactactgaacagcaaatgtgttccgaagatgcaattagccgcggttggaatgggagattgttggagagggactttgtgggagtcacgcccacccctccctgccacatgtgtcctctccacacgtgagatgctggtgtcaagttgccagttaaatgaggacactcatgagggacgaggatgtgggctgagctccagaggactggtgtttccttatctccatgggaccctgtcctccaccagggcccccagcccacccctgtctgtgcatacctccactgtcactccaggggagctctgcacgaggccccccgggttcattgcatggcacattggcagagtcaacaccgggccggggacgcagacgagcagacctgcccttgtctcaagaaacagccgggccatagctgaggtctttccacctggggtggggcttgggggggtccttaagtaccttaaaaatgcaggcagagtggtgtggagggggcacattctgtgctcggtttttctaggcagcaaatctgttgattccatcagatt

SEQ ID NO: 110617 - DNA, 1040 bp, Homo sapiens
gtcactgcagcaaacctcaaataaaataagtgaatgtgccttaaagaaatgtgtgccatgtccagtagagatgcaagctgagctactgttcattgcctcgggcgcaaataagatgactgaaggatcggcggagcgttaggggaggacagggttcacactccaagaaggtggcagctttgggaactgtggagtttagggtccacgttttaaaatgagaacattgaggcccagagccaggagctcctggccttcgtcagaatcagcatctcctctttcctggtccgagtcctcaacggctgcagcaaagggaaatggtaggagaaggactctgatcccttagagaactgctgaatttaagtttcacaacgaggacctaagtcaggggagctcgacctcagacgttttgtggaagttcttcttggggaccaggtgccttctctgttgtttggagaacctgtgcctgccgcgggagtaacggcgtttctgggaattccaggcaggaagccgcaggcgatcctggaggagaagctgaagcagctggaggaggagtgccggcagaaggaggcggagcgtgtcagcctggagctggagctgacggaggtcaaggagagcctgaagaaagcgctggcgggcggagtcaccctggggctggccatcgagcccaagtcagggacatcgagtccacaggtgtgtgtccttctggctcacctcggaggctggcgcggccttgcgtggccgagggccagtgcacccagagagaatgtggagtggctctggggcgtagcttgcttgtggccccttagtgtgcccagcagaagacagttcatgtgttagcatcagacactttcatcggccgggcctgtgttcctgacatgctttctcacctctcgctgaaatgttaaaagctgtggaaatgctgagtctgtgtctttcccctttgcacaatctgtttagaacagatccagtcctcgtgtctcttctgaaccaggtcatgatttgatgccagttcagtagagccggtgcttacaaaccgtctaaca

SEQ ID NO: 110618 - DNA, 1015 bp, Homo sapiens
taattagacacatggattcctatcaaactgcttagtggacagcttttgcctcaatattaacagaacatcctctgtccacaagattttaaagctgtcatctaattccttgcaggggaaaggggagaggggaggggcttttagaaaaataaaggggcaacagtgaccattttcagttattttagtacagctgcaaagtttcaggcagaaaaaaggagctggacaaaggcccttgagactgagcctgccaagttgagtctccgcagctgctgctctctgttccagggagatgaagggccgagctggactggccggaagtgcagtgctgctgagcccataggacagagctcccaggagccactgaaagcggagttcaaatgccagcccttccacacagtgcagctgggtcagccgttcccctaaatgcaggacagagctgctgtgagggccttgtttgtgggggcaggggagggaaggctctctgcaggtgcttgccggctggaaaggtttaggggggtttgggccaaagtctctcaattgcctttcatattaatgtggcgaggattgcagcctggctggccaggtccgcccgcctaaccctgcaacgcctattgagtgacgttgactgacgcatttagcattgggcaggtcagctcagcacacagccgcgtagataatatgatctgagacatgcgcaaaggcccctgaccaaaatttatctcttatttgcccttctcctgggcttacaagtcctggaattattgtcaccgtatgaattaagccgttgttaccaggaaatgcgtttccacctttttctctcttccccatccctatttccgcctgtggctgggactgtggcaccttttgactggctcacctcattctactctgcttccccctccccaggccaccagatggaagttttgaaacgttagactaaccgtatcacattctgcattgagaaaaaccaaaagtgcctcctttgttgccagttcagggcctctaacactgctgtccc

SEQ ID NO: 110619 - DNA, 1130 bp, Homo sapiens
caggagagcttttttcccctccagatgatccttctggaagtcctgtgattggaagtttctactgtcgagcttacttagccttcccagcatggaactttaatatgttatacatcagccaccaccattaccaatttcactaaagccctttacactcacaagggacttctctgccatcattgcttcttaacctcaaagcaggcgtgtgtagtttcatttgtcagctgacagcctgagtctcaggtgggcgaagtgctaccatgatccatagcgatcaagcagggggtctaagtcagggtttcctggcttcacatttcattctcactgtgttgggccatctgacagtttgccgttccctcttttattccacatttctatgaccatagtgccatcccttccgtaaggagggaacgacaattatggaattcagtgtgaagctttctgtatgattctgttttcttcacccgatcccatgcttttggtcacctgtacccatccttctgcgttctgtgcttagctcttcctcagtggaaacccaaaaaaggccgctctgaaatttcagctttcttctttttctcctctgtccttacagttagttaagtatttcctgcacactgaagagcagcccccttcttgctggtgctggtctgacatgaagtcatcctggagtgtcactgggagagggcgtagagccgacagtgcgctgacaaacagaccagtaaaaacaaaactttctcaagatgtcagacgctgatggggtgaaataatcttgtatcgtgtttcaccagatgggagctacttatagatcagaggcacttagctaattatagaatgatgactccatttatgaacggaagttaattgcaagaattttttttttttttttttagcatttgctgatttttcttaaaaggaaagtaaataatacggggtaaagtatcttttctaaagagtttaaattgttcagttactctatttttcatgtctgtgatgttacttccagtacatataatggtacaggaatctaagaagtcttgattagaaaggaaagtcagatgacaaaactagtttcaagcagttacagaattatcttgggccagcagagacttgagatgggctagtgtagtttcttc

SEQ ID NO: 110620 - DNA, 1012 bp, Homo sapiens
ggaaagtaagagagacacatcagggctggccttccaagcctcttcgtaggatgaggttctcttttgccgaagactttacaaaggaaagaggaaaagactggccacacctgttaattggaaatccagaatttccttctaatggtcatgctaatttctgtgtcacttttcctttcttcctcagcctcctgacagtgggcctccaccattgccaacatcctccctcccagaaggttattatgaggaagctgtgccgctgagccccggaaaagctccggaatacatcacatcaagtgagtggccagccctgcccagccatgctgcctttgtgattggcaggactgttgcagagcctgtcccctttctgggtaggaagggcaacagggtattataaaacactgtgggccaagtactttttgaacccaaagagattgtcagtacaggaaaggttttgagaaggacaccgagtgcctcacacacaagcctctcttccgattgctgtcttccttgtgactcagaggtagtgaaagcttattgctgtggcaacaggtatcagcagtgcggaagagaaatggctctttgtggtatattttttgggtgcgtgctacagcccccacttccttagtctttgatgctcttgggctgcacccattctgccacgattaaagcagtttccaccaggttggctgttgggccagaaataattgggtacagcacaaacaggcgtctctgtcatagacttttggttttttcttttttgggggtacaggttctattagatgatttttgcctaagttctggttctcctggccccagttagtggcctgctggtagcactcagaagtacctgtttgttactacccagcttcaagtgcggatgaagcatgacatgatgttgagtctccggaattcatttctgaattggtggctctatgtctcctttcagtatctgtcaggcggggggctaccatctcataagaaagttgaatacctgaatgtatgtcaactaatggaa

SEQ ID NO: 110621 - DNA, 1034 bp, Homo sapiens
tgtttttatgcctcaccctctctgtaactgttggccacaccaagaccagagagaagtgaccaggccggttggtagcagggctaggactggaattccccagtcttttgactcccagcaggctctgttttctgtattgcactgcttttccctgtttcgactcctgttaggacagtggatgtgaaatgtagctgggcgcttttgggggtgtgctaggagtgtggcagatgcctcagactggcatttttccctgattctgaattttcatggctcagagtcagtccctaggccactgaccgggaagatacaagaagttgttttgtatggcagcctataccagggtatttttttcacccggcaatttatttggtttggactggaataaatctctgagattggcttctttgccaatattattagggagtggagcctgatttgttttagcccgattcgtagtgcttagcatctcaatgaatgtgtgttgaactgagccaaggtgtgagagcgtcttggacagtggtttgcaaccctagctgcatctggggggctgtgaaaaaagcatgcatgctgactccagaccagttgaaatagaatctgcaggaatggagcctgggcagctatagttctgttaaaaacccccagatggttctgatatacagtaaaaattgagatccactgatccacggtgaattggagtcctgaatcatacacatgccttatgctttcactagcttagaatggctcttgcgctttggaaccatgaaaaaaatgttatgcaaacaaatgtggaaattgcctaaatgccacatcctgttactacctgccgtgaagtatatttgccggttattcactctattccgatctctacccattccaccttttcttcatgaaacaataatttgacagttggttatgcagaaccagagtaagtctagtttgattggcaggaaacgattttgggtatgaagtactctttaggtatttattgaactcttgtttgtaccactgctgtgctggacagtttataaataatactt

SEQ ID NO: 110622 - DNA, 1050 bp, Homo sapiens
tttaataaaacttaactagttaattctgcttctgtgtcgaggtgtttttcatttacagcaggcttgatttttatgtggattaaatgaaagggaggggatgcatgggtatggagaacacagaggatatatttttgagctctgcatttcagagttcttttctctagccctggccggggtcccaaacagggaacttaattcgctctatcactgaagtatacccttgctttgatgccattggtattgtatcctagagatttgctgtggctgctaggagtgtttcatagtaaggactgatgcgacttctcttttgtcagcttatgagtctgtaagccatcttgttccctttagtattatctgcctggaactggaaggtcagagatgaagttttcttagattataagtctcaagtctttgctgtctaccttcctctctctcccatgtcacctgctgttttattttctgtttttcattttaatgtttttattgtataggtgtctattatttcaggctacctcaaaacagttttggatattgacaggatataagtatgaataaaatgtgaaagataactttagttctttttagcagaggactggaattcgatatgtggccctactaaagcttttgttaagtccaagtacttttctgaacttcagttcccttacctgtaaaatggagttaattgctagtaacacctgttctgcctaactcaggagattgttttgaggatcaaatgaaatcatgaatgtaatggaattttgtaaattttaaataaaatattgtattacctaagatttaaaaaaaaacccattaagaatggaatgaatctgagttttcctttgaaatcccaaatgtttaatgtacagagaagtcttaatgtgtctgttggggagcttgattagggttttttctatctttaattggccagtattgttttatattttagcatttttggggaacatcaaatttgtgtttcagttatcattaatattttgcaaaggtattgaatgtgcatgatttagtctttaacaatctcttcaattatttaca

SEQ ID NO: 110623 - DNA, 1991 bp, Homo sapiens
ggcgccgaggccaggggcccctggcgagaaccgcacacacccctcccacacaccttgctctggcttctctgtgtccatggggtgggcgggagggggtcccccagcaggtgcggcccctgcacctgccggcgacactcctgccggtagtttagggccgagacggctagcttcacgccacccttccccgctgtggcttggtgtcagggagaggctgtagagtggctgtgtcgggcatcagatggagcacacaggtggctgcagcccagcccaccttcccagcgttctcgaggtgccctggccccggtgctgggcacgtgggggacagaggtggccgggacgtgagctgtgaggcttgttgatgatggttgctgacaccatcatcgggggtgggcacacggcccttcggagcctgggcagcctggcctcacaggcagactcgcagacggggcagtgagcgtctgggacagtgccaagagtggggtgtgtgatttttgcaggcgtctgtgatgggtctctttagggacaaatgtcaacaagggacaagacagggcaccttccgccagcgcccctccatgcgctgcgttcctcctccagatcgacccctagatgcctacacaatatctttaaagtaacacagaagtttttattttattaaaaagtatagcctacttaaacgcgagatgacatatatagagtttaattttacggtccctccgcaggggagcggcctccagccttattctccaccgctcggatctgtgtggtttcagtctgttcttggtgtggtcctcatacacagagctccctgtctagtttcttttctttttcttttttctttttctcgtcacacaggtaaccttaaagacagacccctctaaagaacgctttgtaaatacatgtgaggtatagccaccactgttttccttgctgttatttttccaagtcttggggagaaaacatcctcctctgatggccaaagccctggaatcaagggtttccacgtaccctgcctaatacccgacgtagctcttgatgcaccgtccttgtgctgtggctggcggtgtctcagcctgaaacataaaccccacatgccccaggagcgatgtgctccctgaaacagacaaccacacgctgttggggagagaaggatggagataggatggagataggatggagatgtggctcttctcatctttgaagccagcagggcatcccggagcaggaggctggccgggctccccaagcgaaggcgttggtgtctgtcattaggtgtgtgttagggtgcagcaccggccgtcacaggatgctgataagcgcgctgagaggtggatgaaacaccaaagtctgtttccccgtccgcagtgggtgttgcctctttgtgtgtgtcccgatgttcctgcctgtgagtcggccttactccgtttccttagcgcccatgacacgccaagtcccgtttcgcactcggcttctcacccgcccagctcggctagggagggggagtttttagcacctaatatgcttcctgccattgcgcaatctgagcctgagcaactggaaacccccatttctcattagtgcaatgtcatatctgatcccaggaagcctggaaaataaaagacgatgcattataacttgcggaagtacaagatcacttgttatgaacttgtgtgattttaaaggcaaggccccttctgcaagcagtgcttgcggagggcacccgctccaggctcaatgctgggtgtgcgcatggggcaggtgaggccttggggaggggccaagtgtctgcattagggccctgtaggacattccccagaggcagcttgcactgacacattcctgggccctcaccagggccaggccctctgctgatggcagtgatgagggaaacctgatacgcacctgccccggaggctggggagacaagggcagccaggctgatcgctgctctgtggagctggccccaaatacacccctaggtcaggggaggcttt

SEQ ID NO: 110624 - DNA, 1073 bp, Homo sapiens
aatgtaaaaaatttcacgataaacaaaatagcaaaaatgtaaatagagaccagttccagtcctctgcctgggtgcttaccccactcgtgagcctgactctagccctctgactccagctctgcatcaggaagaaggtccagcttccctcggggcctcggttttcctgtttcagataaagggctttggactcggtgccctctgaggtcttcctgctctcgtgctctctaggctgtaaccagctcctcactgatttcctactgcaaagctcgcgttgaaaacactttgccctgtgacagacccgctgggctgagcataccgtctctcctttggctgcagaactctccctgctgaaatgtgatccctgtacccagtttcagcagcactggccgagagccctgaccccgtttgagaccccgttccaggtgctggggaacgaagcgtgaataagacattttcttcaacaggctccgtccaccgcgggcagccaaggcacaaccgcaacagagcatggctcagggctcatagtgcgaaccccgggccccagcaaggggcaggaagtgggcaggggcaggactgcccgacccctgtgggggttcaatgcatgctttacaggttggggaaccctccatagaggtttgcaggacgtgtcgatgatgcttccaggtggacagaagggaaagcgttccagacactaatggtctcaatgcgctaaaatggcagagtttgctgatgaatgccacgggcacctgagacaggtgcaggagctctcgggcccatccccctcagagtgtcacccttagtcattgtcagagacacagccaccctgtatgggtacttacaacatgccaggtgacatgccaggggccttacagacacggggctcctttaacctttgaaacagtcacacgcagagctgccgtgagtaccacggtttccagggaggtaggagccccctcattttggagcatttggggtggatggactttgactcgcacgcacagccacgtgcgtccgcgtagctctgagaataccctaggagttccacaaccgtgcacagtgccagaagacggcag

SEQ ID NO: 110625 - DNA, 1046 bp, Homo sapiens
tttcacatgtttggaaaatatttattaaaatgtttatgcatgtgactacaagacaagcattaacaaattttaaaagtttggtatttccaaactgtaatgctgaaaagaacacatgtgttagcatcagacagtcctgagttcaaatcccagctctgtttttgggcaagttacttaaattttctgagtctctcttttctagtctttaaaaaattatccttacctcttgaggtctttttgaggacaaataacattagagttgtgaaatcttttataagctccatagcatggttcccacatgagtaattatttaaaaagcaattcctgctctatcttgcttccatgtcgctagctgctgagtaaagtaacacattccaatgtgagctttagcaaggaaagaagggtgaccagtggcaaatggccataatctcaattcctattagcaatttcagtacagtttttggaaaataaaacacatgggctcaaatatttacagtcccatgtatttgtcatatgatctcaggcaagttatttaatctctctaaggctcatctgtaaagtgataatcatgcccacctcctggagttgcagcaaaggttagagaatgtacctatagagccacaggcacgtaagaagtgctaaacaggccgggcgtggtggttcacgcctgtaatcccagcactttgggaggccaaggcgggcagatcacttgaggtcaggagttcgagaccagcctggccaacgtggtgaaaccctgtctctactaaaattacaaaaattagccaggcatggtgacgcatgcctgtaatcccagctactcaggaggctgaggcaggagaattgcttgaacccagggacggaggttgcagtgagccgagatcacaccactgcactccagcctgggtgacagagcgagactctggctcaaaaataaaataaaaataggtagtaaacaaatgggacagctaaatcatttgttgcttttaaaatccctggtgcctgcactgagcggcgtaggggagtcagccaggaatatgccaggcagtgct

SEQ ID NO: 110626 - DNA, 1063 bp, Homo sapiens
aaccaagggctgttgcatttggtgagccagtgtgagccaagtgcccacctccttctcggggatgccctggccttccctgctattactgttaccgtgatgacaccaaataatccttagcgtccaaggctgttacttgaggctgcacggagattggattaacttgaagtcaggctctttggctgcccctagctgaagactggtgccacctcctaccctgagttttctgatgcttgggacatctgaatatgagcccagacaatctgggggctgattgccttgcagaggggccaggccctgtgccccaggacagtgaacgccttaggaagagcggcttatgtttgttcctctgcccacagcgtcacaggggtccccagtgaggatccttagggtggggcaggcttgctggtcccagaccccccaacacacagacacacacacacagcccaggggtctccccattgcgcaaggcagcctcgtcccagtctggaaatttgttcataaatagaggcaattcacctctcaaccgaggccactaaaaaactggccccctctttgttgcgctggagcagccgtggctgtgtgtaaccctgggatggcatccctaagcaggtactctccccaggggcaaggccacaggacaccatctccagaagccgtgggtgtcctcttgggctggcatttgttctctccgtctccttcaggctctgtcagacctgctgctgtgtttttgtccaaggcccagcctccccggatctcccccagggcccaggcacctctgcatggtttgaatctagcaaaccacacccctcaccccacgaactgctcttcccattctggaatgggcctaactggggaccatgcatgtggcacgcttctttgaattttctccaagggaattctccatttttcatcttccacatggaaagcaggggagataagagagctggaccaatgtccacaggactcctacgacaccaaaagacgtgcaaatccctgagctcaatgttaggggtcctggggacagtgggaaaactgtctagaatgttcccttctcacctggaac

SEQ ID NO: 110627 - DNA, 1032 bp, Homo sapiens
ggaggctattgattttatgttataggaagttttctagaacaagactcgctgccttgggggaggaacacaaggtggtgtggactccgtgtccccggcagtagggcctgctgctgcttggggtcccacattcctagccccttgaggccccatcctctcttttgaggtctctcacgtcccaccctcgaaggtcagaggcgtgtcagcataatacaaacccccgggcagcttgaggcactgcccagaggactcagtggcccctagaaaggacccagcacttccgaagggaataagaccctttcctccaatcccagcacatgaggcatgtgtgagaggtgggatagtgggagccaagggtggtctggccaggtgggagtgggggtgaggaaagctctgaattaactgctgcagcagcacaggggaggccccagttgggggcacttcacccccaacctgcctgtggcttggcattttctgtcactttctgtgtgtcctctcgctgtgggaccgggcggagtcccatgtctggtgggaggtgcttgtctctgcttgtctctctgctgcctggtctcggagcccgttgggagggagggttaggagacagcgaccctgctgcagcttttctgtggaagggaaggtggtgggtggggaccagggcagaggtggtcttcctcctttccctttttactcctctggagctgcaagatggggcagaagagttcttctcgcgttccttagtccgtggtcgaaggaagagcctccctgacgtgctactgtcaatctcgtgaggatatctggtgggacgggcagggcacctggcctcaggcttagagacgtgagaccccctaggtatggaatatgcagacatcagaactggaagaagagggccaggcacagtggctcatgcctgtaatcccagcactttgggaggccgaggcgggcagatcacctgaggtcaggagttcgagaccagcctgaccaacatggtgaaaccccgtctctactaaacacaaaaaatcagccaggcatggtgga

SEQ ID NO: 110628 - DNA, 1090 bp, Homo sapiens
ggcgtcacccaggtcacctcggccctctggatgcgtgacttgataatccaaccttgttcgcaaaacagaattatagttccaggtgagctcagcaattgaagcagggtcagaggatgctttccatttaatttgccaaaaagcagttgtatttaagaatgtggccagggtgcggtggctcatgcctgtaatcccagcaccttgggaggtagaggtgggcagattgcttgagcccaggagttcaagaccagccagggcaacgtggcaaaaccccatctttacaaaattaaaaaaattagccaggcgtggtagtgcacacctgtggtcccagcaacttgggaggccgaggtgggaggatggcttgagcccagaaggtggagtctgcaccctgcagagccgtgattgtgccactgcattccagcctgggtgacagagtgagacactgtcccaaaaaaaaaaaaaaaaaaaaaaagaatgtggtaatggatggatactactcttttcttatcttctgcagctggcaaaattttactcaatggcttttaaaggacaattttgatcattttagtgctttaatcctattctgagcagctaatttttagattctcaaggaaaacagcatgtttatatacaaggataattaggaagaggggcctttgttttggcgaatttgcagttggttggattcaaacaccagccaggatgcagaggcgcagatggagtgagccccctaaggtgttcttagttcaccgcccagccctctgccctcagcaatgtcgctcctctgccttgggactctggacagacttcaactcagggttggattagcaagtccttggacacagtctgggaacgtggatgaggcccacactccttcccctgggcaggggatctgggctgctccaccagacaggagagatggggctcgctgcaaataagcttttcatgcttgaaatattctactttgctttcccgtttccccttctatctgctgcctttgcccttccgtctggaggcagtgaaagtggccggagcacccccagcctctccgtgctctctgacagcaagccgcccccctccacctaccagcagg

SEQ ID NO: 110629 - DNA, 1062 bp, Homo sapiens
ctgccagaccccatgccaggtacatcacaggcatggcctccttaaccccagagccttcgggtgtgatcatttccctcattttgtacagaaggaaactgaggcttagagaagacacttccgcaaggcctactggctcttttgtggctgggcctcaggacccaagcctgcctgctctggagttccctgtgcttttgaccccgtccccatttcacctataccaggagctgggggtgagctcagactctgcccaaagcgctgtgaccccagcaccctcttcacggctgctggagcagccactgccctctggctttgggggcactgtcctgtgggatgcatctggctttgggggcactgtcctgtgggatgcatctggctttgggggcactgtcctgtgggatgcatccggctttgggggtgctgccctctggggtgcatctggtgactgtcccctccccaattctctttcccctctcaggccaagcttggtggtgagatcctggactacagggacttggcagcccttcctaaaagtaaggccatctatgacatcgaccgccccgacatgatctcctactcaccctacatcagccactctgcaggggacaggcagagctacggcgaggtatggaccctgcccacatggccctggacacctgtgtccccaagtgctgccctgcaggacaggcgtcatccctagcatgtgtcctatggggccagagccacttccatcttcaccactcacccacacgctcagcctcttcacgcccatcagatagccatgtgcacatcctatttcagtaatgcccaaggcactgtggccccaaagctgccgttgctgaaggagtgagcctggaatgcctccttaaatggagtagaaagtaggaagcatgctggtttgtaggaaagatgatagtgactcagtgaaaatctcctaattttcttaagtattagattattttcataaagcatgagatgcatttcctctgtagcggactcttggcccgtgccaccctcgctgccatggctctgccccatgctcctctgccccatgaattcatgagc

SEQ ID NO: 110630 - DNA, 1024 bp, Homo sapiens
ggccctcggctgagcgggagcccgcagcggggaagaagcaaggggaagtgtggcagctctccagtgggcagaggaggcctttgcacccggattccgtggttggattcagggaggaaaggggcctcctgcctcaggtgtgaggggctcatggcagagagggctgatccattctccagaagcccaaagacgggggaccactagctctcctctgctgggacaggaggggtttctggaggcgggacagctttgccacacctctgtcctgctggccctattctgcacgtcacagtggggacgtcccttaaaccgctgccctctgacccagcactggctgaggacctgtggtcaccctgagccaccacaggctgtgggtgtgcttccctggcacctcgttctgccttattaaagatgacagccacccttcagaaggcacaagatgtcttcctaaaaccactcactgcaaagtctttcagttgctcatatattttgaaatccgagccatcatgagccccacgcgggcgagggtgggacttccgcctgcctggggagccgtgcgcccactggaacaaccagcggccgaggtttcaggcactcctcgggtggcaattgggaggatgtggccactgtaccgatgactgggacgccccagtcactatgagagaatgggaatgacaacaggaggtgacacagggaatgaggacacttctaatttttgactccatcagcccatcgatggccgcctgtgacccactggttctcagcaggaagtatggggtagggagggggtgacctgtgccatgccggtaccttccagctaaatgtcctctggaatcacagagcccggttatactaccccagcctgagagggagggacagtcctctccatcttatacacggggacactgaaccccagcacgtgacacagggcctgagtcacacagccaggaagagagaatctcaggctggaatctgtcacctccatggctttggccacgagcctgggacaggcctgagcaccggcagg

SEQ ID NO: 110631 - DNA, 1021 bp, Homo sapiens
gtgctcagggatgcgggctgctgtgctggggatgcgggctgctgtgctcagggatgcgggctgctgtgctggggatgcgggctgctgtgctcagggatgcgggatgctgtgctggggatgcgggctgctgtgctcagggatgcaggcttctgtgcccaggccagcagagggtggctgagagcatgtgagagagtcagggaggggtcgggggtcctcccaggcccttgtcagtcccatctgccctccgcatgcagaaacagctcatccccctcttttactaaagtcatcatagttctcgtcccggtccccaccctggcaggatgcagctgcagaggttaggatataattttctgcactgcaggtggcgacccagtccctggcaggaaatcagtttagtgggtcgcagcagtgtgcgttatataagaaggtgagttgagtagaaaatagtagagcacatcacaaggaatgaaggtgttttctgtgaattttttgttcgccatttacatatagtatcagttaagctgctgctgcatgtggttggctgagaaattgtgccccacctcagcatatcaggtcctgatccctgtgacctgtgaatattgccttatgtggaaaaagggtctttacagatgggcttacaccaggatgctgagatggggagctgatcctggatgatctgagtgggccctcagtgccatcacagttattctaagagagaggcagagtggggtgaccacagagccagaggctggagtgatgctgccatcaccaggaaatgcaggctgccccaagagcagggcgaggtaacggcagcctcccctagagcctttgggggagctcagccctggggccaccttgccgtccacaagtcaggaaatgcaggccgccccagcagccaggcaaggcaaggacagcctgccctagagccttcggggagctcggccttggggctgccttgacatcagcccagtgataccgattttgtattcctgtccttgttgtactgctctctgcccagacc

SEQ ID NO: 110632 - DNA, 1016 bp, Homo sapiens
aatcgtcccacagagggaccggctgtgtggggtcttactccataggccccgtcctgtctgggcgcagggccagtcctgagtgtgaggtgctggggaagtctcagcctaggtccgggccttctctgtgtccagcagtcaacagcctcccaagggctcagagctcttccagaatgtcccttctgtccctccacgactatttattaagcacctactatgtgctgtctttgccctgatcccccaacagccttgcattcttcctgccgccttctgcctgcccccgctcccctggagtccctcctcctctccctttcaaggctctgccggactccagggcctctgtgaagctttcttcccatctctaggccctctgcttccctccttcctctgaacctgtggacacagaccaagctggggtttcctgtggagatttgtgcctgctcctgcctgctctgcagcctggagctgggacctgccctctctgaaatacctcctcttggatggtgttggggggctgaacagtggactcaaaggtgcccatgtcctaatcccaggccctgtgactatgtgacctcatgcggcaaaatgactgttcatatgcgactatgtgaaggattttgccacagggagactgctctggatttcagggggcctgaggcttctcgctaacgggaggcaggaggcagcagagaggagagagaagtctccacgcctggctctgaggatgaagggaggggccccacaccaagaaactcgggtgcccctagaagctggaagaggcacggaagtggatctcccccggagcctccagatggccccagccctacagaccccttcacactctggctggatctgccctggtatctggggaccccagatctcagcgtggcctgactctccgtagtgtctggggaccctgggccttggcacagctggactctccctggtgcctccagatcccgggtcctggcgtggcctgatctcccgggtgcctgcggagcccaggtttcttggtacat

SEQ ID NO: 110633 - DNA, 1061 bp, Homo sapiens
agcgattgtttatatagcacatggcaaggtggaaggagatggcatcccataccagacaggcctggatccgaatccaatgtcctagctgtggggcgccccctgcctcagtttccccagtagtatggccggccagtccacacatggtgagcccagcaagtgacaatcagtgtggtgtagcttcatctcactgcagcccatgtggtcacaaggggaccagtagggggtggggttgaggaaggtacctgagctggggcagggggtggggtggggggattccagtgccaggtctgccaccagtgggcaccagatccttgagcaaggcctgtgctccttctgagcctaaatatcctcctgggcagctgctggcctggcagatcagattcccccaggtggacagaggctcctgaggggttgtgttaatttgctccataacaaagtactaaagaccaggtggcttaaagagaagacacttatttttttgctgattctagaggccagaagtctgagatcaaggtgtcagctgggttacttccttccaaagcccctctccttggcttgtggacggccgccctctccctgtgtcctcgccccgtcttccctttgtgtgtgtctgtgtcctcgccccgtcttccctttgtgtgtgtctgtgtcctcgccccgtcttccctttgtgtgtgtctgtgtcctcgtcccgtcttccctttgtgtgtgtctgtgtcctaatctgttcttatgaaaaccccagccagacttggttagagcctaccctcatgacctcgtttcaccttagtggtctccttaaaggtcctgtctccatgcatagtcacatcctggagtactgggggttaggacttcagcatatgaatttagacaattcagtccataacaggggtgcggggccaagggcggccttgtggctggctcagccttctgtttccatgctgctcttaggatcatggaactggaagggacatgaggaatgttccagcccaaacccacccacctgcacaaagggggaaaccaaggtttagggaaggaaaagcagctgtccagggccaagg

SEQ ID NO: 110634 - DNA, 1039 bp, Homo sapiens
actccgagcggctgctgagatgagtgcaggtgggtgctggggaccgagggaccaacgggtccccgcgctggctcgcggcgccgcaagggctgggtggcattcggaggctgcacctgcaacgccggggaaaatcacccagcggctccacccaacttttgctccaggattttgcagccccgaggggccagagcgcagccctctgccctgcgcccggagcgcgtagctcagtggcgcgggccggggatcctttcccagcgcgccggccggcgtggctgcgccaggatgtctggaaggcgccccttctttgcttctcacgggggtccgggttgttccaggctgcagaaagcggtcagggtccgcgcgggggcctggggtccgggcgaagggccggggccccagcagacctaggcacgcagaggtgagatgataggcggggctttgcagctgggggcgccgcccttgcgccgctctggcagcgcctgggttgggggcgtcaggccgaccctcggcgcccaggactctccgcagcagatctggggacccggagcccgcatgtgtcagacccggccccgacccgatctctgcgcgtctccagcccctcgcccctgcgcgtcgcacccctgcctttcccgccgcacccaccctccgggatctgacagcctctgtgcggggctggaaaaatcccacagcgctggagcccagccgcgccttgtgctgttggggaaactgagacctagaactggagcccttggcggtgagccctggaggcggcctgaggatgcccggatctgagagcctcctggggcccgcaccgggctgagggcttgtcgttgcattcccggcagggaagggctgtcaccccatttttcagggtgtgacccgaggcgcaccaggcttgagtcacttgcttggctcaggaagggggggcggggattcgaaccccgggctcactgactcttgtgctctttcctctaagcctgtcgcgccagggactgcagtatggcccttggccatggtgcagaaaccaatggggacagcc

SEQ ID NO: 110635 - DNA, 1018 bp, Homo sapiens
cagagcaccattgcaaagattaactctggagcttggtgctcgaaggagtgggtgttaggttccctggaaaaccccagactcctgggcaggacttgcttcccggggtttccggcaattgagggcaccactgcctttgtctccggctgctccactcacaccttagaaagccccagagggcagttgagggaggggtgaggaacacaggtttggtgctggaaggactgggatctgggctggttctgccacataggagctgtgtggccctgggcaggtcatgcctcctctagaccctctgtgaatcagtccagcgggcatcaggagacactcaccagcaggcatcaggagatactcaccagcaggcatcaggagacagtcaagctggtggcgccatcagcaagccccatgtgatgacaatccttgtgaaggactgagcatcttcttggcaagtgacaatttgaatttattacaaccacatcagggagcagaactggagggcacttagaaatctccaagcccaactctaccatttgcaagatggagagactgaggcccagaggagtgacagattgtcccgggagaattgaagcctgagctggggttcggacaggtcctctggcaggcagggctgtgtgtgcttctgccccagtgtctgcagcctccagttgggcgtgcttggaaagcccccagccctgaaggctcaggcaccttcctctaggaggctgctgggtgtgctgtgtggagtcggggtgctctgtgcagttggggaggctcttggaaaattcccccggccttgggccagaagtacagctgcagagacaaacaggatacggggtctccagccacagcaggggacaatggccaggagaggaaatgtctccagacccgtgtgtggatgtggagcccgtctgggggcttttttcaacgtagcttccagaaaaacaaacacaggggaagccaagcatctctggccaggagatgaaatgtgttctgcctactctggagaaggggtggaggtgtg

SEQ ID NO: 110636 - DNA, 1060 bp, Homo sapiens
ccagggagctcgcatgcccagggagtggattccagcgctttgttgagacgcctccatgtgcttccggagaggagatgggaagacagcctggccttgcaggcaggggcttcctggtgctgccacagactcagggccaggtggtgggcacaggcagccacaggtgccaggaccgcagtcctgcagagcaaggaggagaaagcaaagtccgaggctgggcgagggcagccagggcatcctgcactgcccctgaaggtgcccagagctctccaggcgtgaccagggtcccaggacatgggaacagggagggtgaaggccccaggctgcacagggcatttgatcagtgaggctgtgttctgcgtccgcagttccactcacgcttcctcctttggaaagcaagtctcatgggctgcaccctgctcccactcctgggcgaacagcttccccggagggtctcttgggtgcctcttggcgtcagatgtctcctgattcaccattcccggcccccacaggtcctggtccctgcccctcagaggtggttggggggtgggaaggatttggccacaaactgatcaatcagattacagttggagcaggtgtgcagatggaaggtggggtgccggggcacttcacagccaggggctgtcgcctctgcaagccttgctggcccggggctgatccggctgaggccctgcactctgagcatccccagggagccttccctgactgtgggattccctccccggccagagctaggggaccctctctatgcctcatagaacctccctcacggaaccatcactattctgtcgaaattcccaacttagcaggcctgggtctccctccctctgtgtgggaggtgggtggttgttgaaaccaaggactttagaccgtgggctcctcccgcccctgctctgctgatggagcccaaggtatgaggtgagctggggcctgggaggccagttctcagggtgacagccacagccatgggggcaggggtgatggctgggcttacatgacacccactcgtccctgtctgcagccaacttgccccccatgaggg

SEQ ID NO: 110637 - DNA, 1067 bp, Homo sapiens
acacgtgtgtccttctgcctgggatgccccctctccctgaaccccgtgttctcctggggccttccatcagcccccgtggctcctctggggggggcactcttctggccatacgcctcttcctatgtgatttacacgccacccatgacctgcctgctcccagccagggaactccaagagaagaattccctggtcacttctgtgttctcactgcccagtgcgagcagcagcagggggtctttggagaggagtcagctgtgcccatcctttgatggaattctgtttccctggccttgtccttgttaagacctcagtcaaggagcccagagaatgtgggtgcatggagaggccaccttctgggtcatgtgatcctggtcctggccccaccaatgagatgcttgtcttcagtggtcctgttcaatgtttagggctgcgacagaccaacacctctcagaccaggtctcagaggccgtttgtcaccatgcctcatcaagccgttcacttgttcccctcatggaaagggtccgtctgctctggtacctctggcacctgtgcatcagaagcagctggaagctggccaggccatgcactgatggcaggagctagaccagcagttcccaaagcatgttctcacacactgctccatcatagacttcatcatgccctaaggagtggggaaaagctttgtccacatcccttgtgggtgatcccagggattcccagcacaaacaaggcatctttttcctgttgaaatgccttttccacacttacttaacctccagaatcctccacaaccctgtttgcttttggctgagctggtgttccatgggacactctttggggatccttggtctagctgatccctaccatctccaagggagaccacaaattctcaacaggtcactgggggccgtgtgaagtcaacatgtactgaacttacaaggggtcagagaagagccagggaatgagctagtttgttcccttcctttaacccagaaggatgacggggctgggtgccattagtcctgttcacagctggagaaattctgacttctctcattcactcaaca

SEQ ID NO: 110638 - DNA, 1050 bp, Homo sapiens
gtgttagagccatgttctcaaagtgtggtccctggaccagcagagcagcatccatgtcacctaggagcttgtggcaagtgggagttctagggcccgccccaggcccgtggagccagaagctctgggggcaggccagcaagctatatggacaggcctctggatgactgtgatgcctgcgcaccttgagaaccatcggcctggatagcatctgaacactgatggctcctggtgcgtctagagaagacacaggccatgtctgggacgcgggggagatggactagcacgctcccccagccacagggcagcatgatgcccagttccctcagaaggatgtccttcgtcttttccttgccgtgtgtgttcaaccccaccctctcagcagcccgggaagggcaggacactgcacacacaagagggccgttcccagtcccattccagattcatctgtcaccagacccacgggaggaggcagactggttccaggaggatgacagcccttgttctgacacctgtgtctgataccagggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtgagtgatgagggatgcaggagggcctctgcacatgttcactctccatccatccatccgtccattgatgatgatgatagatgatccttccatcatctatccatttacctgttcatccttccttccatccatccatccttccatcatctacccattcacctatgggtccttccatccatccatcatccatccatccatccttccattatccatccattcacctgttcatccatccatccatccatcatccatccatccttccattatccatccattcacctgttcgtccttccatccatccatcatccgtccatccatccatcaggcatccatccttccatcatccatccattcacctatcatccttccattca

SEQ ID NO: 110639 - DNA, 1048 bp, Homo sapiens
cacaggtcacagctgtgggcaactggggctcactcctagtggggctctctgggagactgtggagcacaccccactgaggcacgagaaaactgatttcacccataaactgctctccctcctggtagagggcaactgtagacattgcctccccagcatgtctggcctgcagtgcggacaggttggcacactcccaggctggtcctgtggcctgaggttgccacaggcagacagacagaagtggcccttagctggaatgatggaagccatctgcaggtgagcttgccaagggtgggcggacagagcatcatcggagcctgcttctgtgtcctccgacaacctgaggacctctgagactgcacccatgtcctgcacaggagcggcatttgatgattagcctgtgccgagggcccaggggagttgaacagtgagaccacctgcctcttctctgagtccgtgtctcctctggcccaaagcaggtacttagggaggtttgatgaagaaaacagagggtaaggagtgttcatgccagctctaacccagtcctggagaggccacaaagcattcattcattcaacaaatatttattggcagcctgtaactgccaagccctgaacttaagcctgtcccaaaggctagttgcagctcagagatcctgactcaaaagtaggacccttagtcacttgaaaaacaagtgaaggcagaggctggaggtgcggggtgtgtttacaggcagcgtgcgtggtatgcacagcttgggctttggaatcagataagcccagtcttacgttcagttctgccaccctccagctgtgcatcctgggcatgtcccttaacctctctgagcacatctcctcatctgcaaaagtggaccacaaatgaggttacagggtcacctgaggatttgatgacatcatggacatcaagtgctcagcacaatgccttccacatggtgagtggtcaacgtggcatcactatggtaatgggcatgttagatgggtctctctctgcccagaatttgtgccgagagcaaagatactgggtgcccaca

SEQ ID NO: 110640 - DNA, 1009 bp, Homo sapiens
actgcaagggtgcagcccccacacacggtccctgctcctaaagctgttgcccccactgcaagagtggagtaggttgaggtgtagccatgacattctggaaactacattttttgtaatagtcattttgaaaataaaacatttgaaaatactgtgcagcaaaaacttgaataattggaataaaaatgttcagtttaatgtcattgcttgctgccaccgttttctgattgtaaaactaacgtgattattaggtactattttggtaatgtagaaaactttaaagatgaaaatagatatcacttataactccacatggagaaatagttgcccctccaatttaattgatttacttttgggccacaggggcccagaatttgattcattgtactccttggttcatgccagtgttcctgcacccagcactgaagctgaacattgacagtgatttgcccctgccccagagtcctccctgcattcccctcgagggcccccgtctcctggccctggtgtccacttttctctcagctgctgggaacgtgttagtgtgcactgttctcctttccctcacctgctggcttcatgttagcatgcaccgttctgctcactttcttcccctcacctgccgggatcatcttagcatgcaccattctgctcactttcttcctctcacctgccaggatcatgtaagcgtgcaccgttctccacactttcttcctctcacctgccgggatcacgttagcatgcaccattctgcacacttccttcccctcatctgccagggtcatcttagcatgcaccattctgctcacttcaccttcttcttctcgcctgctgggatcatgttagtgtgcactgttctgcacactttcttcctctcccctgctgggatcatgttagtgtgcaccgttctgcacactttcttcctctcacctgctgggatcatcttagcatgcaccattctgctcactttcttcctgtcacctgctgggatcatgttggcgtgcaccattct

SEQ ID NO: 110641 - DNA, 1005 bp, Homo sapiens
cctgccccctggccccgcaactgagttatttctgctgaagcacctgctgaagcacctgggtctctgcccaaatggagattgagccttagtgggcaggaccctccctcagtcctcagggaatgctgaagtctgtacatgagcccttaccggcttagccagggagggcccagcgcctggcctcagcgcggcccaggctacacctgggttgggctaggtgtgccaagaggcaggtagtgccaggagccgggtgggcagggcaggaggtgagagttccccgtagtaggagaggcagggatggtcatctctgcagagggcctgctgtcctgcatcggggactgaccactgaccatccccagagcccatacagcccagatgatgactgccgctgagagctgagagccagagaagcccagtgggtttcccagccagggagtggcagagccaggatttgaagagactgtgccctgctgtagggagagaagacttggcgggagccttgggtcctgggggagcgcataggagagggacttgccctacccaccttcctgggagaggcagtctccccaggaggtgggggctcaccaggcagacaggcattcgaagggacactggagccagacccgccatggaggacccccaagcacacgggactgtctgccccgtgcaggagaagccggagcggccttgagcgtctacctgctgtgccttgctctgcagaggcaggcccgtctctgaggcagggaacgaccaaggaaaggagagaccttgcccatgatggaggggccccctggctctgggttccatagttaaaaccagagccagctggaggtgtcgctggcaggatggtttattaaacgtgcattcctggctgagcatggtggctcacacctgttatcctagcactttggaaggctgaggcgggcggatccctttagcccaggagtttgagaccagcctaggcaacatactgaaaccccatccataaaaattacaaaaactgaggtg

SEQ ID NO: 110642 - DNA, 1015 bp, Homo sapiens
tttccttgctgttcgtgaccatctgccctgctggggagagcttgggatgttgcagagcctttaggaacaggcggtggtcacaagggcctcccctcagcattggttgcaaaatggacctgagttttccagtaaagtcctgaagggtagcatgtgaggctcaaggatgacccctgggcagcctgccagcagcagagagccacggcctgggcactgaagacagcagacagtgactctcttggtgcagaggcagaaaccccaagtcaggatggggcagggctacccgcctccctctcgtggtgggggggcttttcccgcccaggctcctggcagctccaggagttcttggctgtgggtgcatcatgccagcctttgcctcctctgtgactttgctgtctctgcatcttgtaaggacacgtgtcattggatttagaatccatcctagtccaggagtccctgatgacctcacctgaatacctcaacttcatgacatcttcaaagaccctcttcccaacaaaggtcacattcacagctgtgggggtcagttggggccaccattcagcgccccatgcctggcaggacttggcgaggggagccttggctccctgaagatgcctgcatggaggaagcctccgcccaaccctgcctgtgccctgcctgcggggtcagcagcacccgtctttccatcccactccctctggggagctgagacctccggcaagccgcctgacgtgtgagcctgggaaacggcctgctctggtttgtgacgggcttctcagttatgccgtgagggtgaacagatgtaacagccgaaagcagtcgggtgtgctgtggcaggaactgcaacgttgggtattttcttttcttttttttttttttttgagacggagtctcgctctgtcgcccaggctggagtgcagtggcgcgatctcggctcactgcaactccgcctcccgggttcacgccattctcctgcctcagcctcccgagtagctgggactacaggcgcctgccactg

SEQ ID NO: 110643 - DNA, 1050 bp, Homo sapiens
cggggtttcaccatattggtcaggctggtttcgaactcctgacctgaggtgatccacccacctcggcctcccaaagtgctgggattacaggcgtaagccaccacacccagcctattttttaacctacatttttttcttttttagaaacagggtctcactgtgttgcccaggctggtctcaaactcctgggctcaagcaatcctcctgcctcagtcttccaaagagttgggattctgggcgtgagccactgttcctgactagactacttttttgaatagaaagttggttgaatgttcctgtctacttgccctctgccattttctttgtcctcggggattgcatcagcttttaggctgcccttggagaagagaagagcctcagggcaggacccctgtttaacagaagccctgctgcttccccacagtttcgccatgttccacaaggtcagagttcctcgccagagccttctgaaccggatgggagacgtcacccccgagggcacctatgtcagcccctttaaggtacaggcatggggggccgttcgtgtgccgtgcttcccaggtgccttcctctgcagggcctggctctgtgctcctccctgcacctggaaaggagacccctccacgtaggccaggtgtcgctggggcatacttctcctggctcgggttctggtgctcccgctagaaggggactcttggggcagccacagcaccaggtgctggtgtccagggggtgagtccgggccttacaatgcccactccccatcgggggctgcgattagaggactgctcgcttccagtgatgcttccctgaggatttgaaggagacgggtctcctggcgaactgtccacaaagggggacgacaaacagagttccccggtgtccagaactcacgcctggcttaagttcacggagagcagaagagagaccgtggtcctggggagcgatggcccaggtcatagctgatgaccctcaggaatcatgagctcacagcaggtgggccaccccgagcatgcacccttggaataacagtccccagcagcatgcagc

SEQ ID NO: 110644 - DNA, 1073 bp, Homo sapiens
tacatcattcttatgaaacagccatggctgcactcagacttaggaaggcactggctgtaatgccagcactaaaagcaaaccagaacccaagtggagaaaagttagctttcataagaggactcatcttttacgttcacaaacttaggctccctgacttttatcggtaatcagtactgaggacaatgcgttccacacccgctggctggctgatgtttgattctgtaactataccacgcccagaattctctcaaaagggaataaaacacaggtcaaattcctcacccacacactccacagttcaacccctgccagggaaaccaaaagcaggaaaggatctccagcggcgccattctcatttccggtcccagcaccccgcctccatgacgtcaacgcgccgcgccaccgggctgcgtcatctcggcgcgccgctgccagggctgtacacctgctggctgccatggctgaggtgggccgtaccgggatcagctacccaggcgcgcttctcccacagggcttctgggctgcggtcgaagtgtggctggagaggccgcaggtggcaaacaaacggctttgcggcgcccgcctggaggcccgctggagcgccgccctgccctgcgcggaggcccgcggccccgggactagcgcaggctcggagcagaaggagcggggtccgggacccggccagggttcccccggagggggcccgggtcccaggtcgctatcaggacccgagcagggcacggcatgttgcgaacttgaggaggcccagggccagtgccagcaagaggaggcacagagggaagccgcctcagtgcccctgagggactccgggcaccccggccatgctgaaggaagggagggcgacttccccgccgcagatctggattcgctttgggaggatttctcccaaagtctcgcccgtggcaattcggagttgctggccttcctcaccagctccggggcgggatcgcagccagaggcgcagcgtgagctcgacgtggttctcagaaccgtcatcccgaaaactagcccacattgcccccttacaactcccaggagggaaatagtcgtgc

SEQ ID NO: 110645 - DNA, 1022 bp, Homo sapiens
gaagacctggaatgggggaggtaagctgtccaccatcttagggaggggctagcacgctcccaggcttgagggcaggaattcacgtcttcagaaccgacatgaaatggtgtggccctgtgactacacactttgaaaaagccattgatggtgggtgcataggctctcttcaagcaaattctttaaaattttccaaatagctcttataaacataaaggactttgttatttccagggagtgacagagtttggacccttaattaacttttaccaaacatgcaggtttaggggctagaactactcattttcaatctagaaattatccaaagagaaaacaggttactgagtgcaagcaaaatgcactgtccccttgagtatgtggtaagatttggagctgttgtgattcgataatttaattctctttgaaatccccaaaacacaacaatcatccatggcaaaaggagaaaattacatcgattgttctcatggggtgagtggtgtgctgaaattatgttctcaggtgagtggtgtgttgaaattaacggcattcagagagccagccagggctgtaaggacctcgcctccttccgggcagggatgctgcttggccgccagagggtggtgtagagctgcagccaacgcctggcttctcttgcagttttgggaactggagaagagcacggagccccatcccctcccggcccctccgtcggtgacttctgcctggctgcgcatttgagggaaacccttcttctccaggctttgctttcctcacctatgaatgttgggacaaaatcatacccgtttccttcttcatcctttgtcctcttgtaccatgtgtacgtgggatgggaccgggccatggagcatagacggcccctccagaaatcattcgaacctgatggtacctggtcagcagagcctctagccatctggcgagagtggccctggctcagtggctgatggggccgactagctgcaaaccaccaggcaccgtggggcctctgggttggccctgctgactaa

SEQ ID NO: 110646 - DNA, 1042 bp, Homo sapiens
catcactgtggtgtctgtgctgttcctttttttagtgcctagcatggccttgctggccaccctagagccggtagcgccaggctggctgccccatggttggagcagccactgggaaggctcaggccccaggcttgccagcttggccttccttctttagtctgagaaaccctggctccaaacagccaccccccttcatgggtcaccagtgagaagagcttgaggtgaccacccagagcaggcagcatcacctgacgcctggccctgtgcgggcatggggcatgtgtggggctgcgtcttgtcaggctgtgccaccttagctgggtggggacgccacggccctcacggtttggtgcggtgtggtgtgggttaggtgagatggaatcgtccttcgtgctggagtgcataacgcgtgtgagtgtatggaactgaaatggactgtttctgcctgtgtgacaggttcgtaatattttgctgttgttttggggaaaaaaaaaacccgtttttccacagagagcctatctctggcagaagtagccaacgagctggacacggagaccctgcggaggctgaagcgggagtgtgggggcctgcagacgctgctccggaacagccaccaggtgttccaaggtacggagtccgcctctcccccgccgttctttccttctttttcccccttttttcagttaaataatgttttattttagagtggtttagactcactgaagaatctgacagaagcagcaagttccgcggtgccccacccagctctgacgtgggtggcatttgacctcagggtgggacgtgggtcaccccgttccctccttgctcctctggacctcgtcccatgcgatgtccccaggctggtctctctccccctatgctgtgcttgctgacgcctcagctccacttgctccacgcaggacagagcaagtcgggtagccgctggccggtcccctgttggctgggggtcattgtttggcgtcatctttagctgctgcaaactgaaagcatcctgagccacagagccagggtggggagtggg

SEQ ID NO: 110647 - DNA, 1050 bp, Homo sapiens
ccgaggactgtaatcctcaacccgttcctcagagcaacttggtgaaagggagtgtctgtctgctgtcagaagcagtggtggagatggcggctcctgtgctgaggtagagtcccaggggatgcgcacggtaaggagggaggaggcggcaggaacttgggtggagcagactgtggctctgtggttccatttcaaaatgaggagcacatttccagaggaggagagtctttctagctgttggttgtctttctagctggctagagcaagtgcctctggaaggccgccccttctggcacctggccagatgggggctcaggtgttaagaggggcggccgggagctacctgccatgtccagggttgtagacacggggagtgggtcagtgaggctgggccagcctggagcctgcctgcgccgttcgggagcctcatctctatcatcagcgcccgctcctcagtccttagacaccctgcaggtcctgcttccaaaacatggttgggtgtgctcttaactccggagccgcgtgggagggcctgccgccagctggcctgtcacgttgtggtggggaagggggtgccgaggctggctctgaggggaatctgtactcagcctttggcctcagtgatcccccaccccccattctcttgacaggtcagggcatcaggccagaggcccctcactgtttgggatcatggggagttggggggaagctctggcccctggggctcctcctgagcaccctttagagggttccaggtccctcagtggccaggatgtgcccttctgtgctgcgccaggaggtgctgctgtggggacatgggcagagtgtcgcgggactgccttaacaggagacttcaggttaagaaacctcagctccaatgttgggaggcgagacagagaggcagccgtgggagggcaaacagggtcaggcctggccttggcggtgcttccagccaggctgtgagggtgagcccccaactgtggcgccgttctctgggctcatttctctagtttcaggggaaactgtaaaacatcagtctgtcaaaagcacaca

SEQ ID NO: 110648 - DNA, 1045 bp, Homo sapiens
ccatccatcattgatttatccatctatccattcatccatcattgatatatctatccatccagccatccagccagccattattcatccatccatccatccatccatccatcattgatatatccattcatccactcaagggccaaccaccttcccagctaagtaccaatgtgcactttgacttattacacaaacatgaagagagaccatcagttaaatttgcatgaatcaatgataacatatattattcatattcttgagttatgctaactaagaattctggctaggcataaaaaacgagcttaacaaaagtgatgaccttgatgagacctcattatatacagaggttcttgagtcaaaacaagtatgaattggtcccagcccatctggtcattcttgctgagtgggggggcctcatgcctttggggacccccggctttgagatgatgccccaagtctctgtatttgcccccagtggagcccgaggtgaagctcatcggcaacattcatggcaacgaggtggcgggccgggagatgctcatctacctagcccagtacctgtgctctgagtacctgcttggtaacccccgcatccagcgcctgctcaacaccacccgcatccacctgctgccctccatgaaccctgacggctatgaggtggcagctgccgaggtgagcgcccagatgcctggatcctgtgggccaccgcccgaaccaccccctcattcatccatttatgagtagtttatcccagcagtgcttcgttcctgcctctctaggagaggagcattcagcaggtgtcgatactggcaaacccctgcttcaggggctggggagaaggaaggcactgagaattctaggtgaattaaaaaggtgatgcgtgtgatagaggaaaatgatggaaagggagtcgatggtgcccgtgtgtgtcagcggggggtcagggtagctctcggggaggtgggcaacgagcagagcaggtgactgtcgagggcgccccactcagggggagcagccagggaaggccccaaggctgtgacatcagcaa

SEQ ID NO: 110649 - DNA, 1060 bp, Homo sapiens
tacctggacatcgccctggatatccaggcagctcagagtgtccagcaagctttggaacagttggtgaagcccgaagaactcaatggagagaatgcctatcattgtggtgtttgtctccagagggcgccggcctccaagacgttaactttacacacttctgccaaggtcctcatccttgtattgaagagattctccgatgtcacaggcaacaagattgccaagaatgtgcaatatcctgagtgccttgacatgcagccatacatgtctcagcagaacacaggacctcttgtctatgtcctctatgctgtgctggtccatgctgggtggagttgtcacaacggacattacttctcttatgtcaaagctcaagaaggccagtggtataaaatggatgatgccgaggtcaccgccgctagcatcacatctgtcctgagtcaacaggcctacgtcctcttttacatccagaagagtgaatgggaaagacacagtgagagtgtgtcaagaggcagggaaccaagagcccttggcgcagaagacacagacaggcgagtaacgcaaggagagctcaagagagaccacccctgactccaggcccccgagttggacgagcacttggtggaaagagccactcaggaaagcaccttagaccactggaaattccttcaagagcaaaacaaaacgaagcctgagttcaacgtcagaaaagtcgaaggtaccctgcctcccgacgtacttgtgattcatcaatcaaaatacaagtgtgggatgaagaaccatcatcctgaacagcaaagctccctgctaaacctctcttcgacgaccccgacacatcagcagtccatgaacaatggcacactcgcttccctgcgagggagggccaggagatccaaagggaagaacaaacacagcaagagggctctgcttgtgtgccagtgatctcagtggaagtaccgacccacacgtaggggtgcacacacacacgcacacacacagacacacacataactacacccagaagcgcgcacgcaaacacacacacacccacacaaacacgaacacc

SEQ ID NO: 110650 - DNA, 1056 bp, Homo sapiens
gtgcggtggtctttcgctgttgttttgttccacttggtgaagaggatttgagaataaatagccacatgattcaactccctcctcagttctgagtaatatagccttgtcctagcaagaaagaagttcatattgtcgtggatgaggcaaatatacattcactaatctaacatacaaggcagtaagtactgtaacataaacaaagcactttggactttcagaccaggagcaagtggggtgattaattcttagcagggctagtaaagtctgggaagtgttcactaacacaatgtctggtcattaatgaaaccaactggtttctcaaaacagtctaatttattgtaacaatataaatggttgtttgttcataaactttcatcttttgccaaaatgtttgtagcttatgtccccatttaacaaggttttctggccaaaactgcacccacatcattctaatgacctggctgtccaataaaaaaaggactctcagtcttcccataaaagcaattttgcatgcatagaacacctctatctatgaatatccctaatgaggtacagaaagactcttgttatccaaacagagacattccactggtgctagacagccacagatggaagttttctctgcctcctggaaatgaagacaaacttttttctttcttcagccatgaggattgctgtcctcctcttcgccattttcttctttatgagccaagttctaccaggtaacaaaataaacttggtaagagtagagtgcctaacaccttacagggattcaatactcaaagagaaatcaccatcaactatgaccagaaaagagggtctcataggaaatctggaagactcattggctgagaggcctgcggccatctaattcgttaattctccatagcaactcagttaaatgaagtcaatggtgtttcaagtctttgaaaccctcttattccatctccaaattaggcaagtttactagcagttactagacatcaaaaattaaaaatcaggcattattctactaaatattggtctccaaagctcctctagtttctttcagcaaca

SEQ ID NO: 110651 - DNA, 1156 bp, Homo sapiens
tttttcttatataacatctgcagtgatatagagtaggaaaaatatactatggttgtgctgagaaggcaagagaaaggatagtaagcatagagaaaactactgaattagagcacacccttagccatatgcttctcaacaaccagatgaattaagagaacatgtggatacacttaagggaaaataccttttagctctgtgagtaattctccccaggtgtctgtctgtctgtctgtctatctatctatctatctatctatctatctatctatctatctatccatccctccatctatctatgaggtattgagcaacataggaaaggtatttcttacatagtcctgaaatgaggaaattagtttagataaaatctcaaggattgataggctttctatgaaaggagatgaagatatgaacatgaaccatttgatagggatgatgtatgcacagatgggaatttggagggacaaatacttcctttgaaactgtttcttagtggtggcattgttggtgtttggtgcaagacaattccttaggtgaaaaatttagcaatgctgtgctatctgctaaataccaaagacaccttccctaggcatggtggcaagaacaaattgtcccacacatttcaaaatgtacatgctaggggatgacaatccctctaaaggattttagaaattggcctatttcctccaaggtgtatataatctacaatcttagctcccttcccataaaaaggcactatttctctctacgggtctgatcctttcatatagacaatgttttctttgttatcccaaagccattcttctgggtgtttattgttttatgtatattttcaatagtgaattatgatgtttttaaatctcttcctgtgtaggaaagactggcgttattccaggacaaaaacagtgtattgctttgaaaggcgtgtgcagagacaaactatgcagcacactagatgataccattggtatatgtaatgaaggaaaaaaatgttgtagaaggtggtggatacttgagccttatccaactccagttcccaaaggaaaatctccttagctgggagcaaacattaagccctttgaactctagaatggatggataagttttgcagactcctgtttaatccaatgtcttattcttccttgactggaaataa

SEQ ID NO: 110652 - DNA, 1533 bp, Homo sapiens
atgatgcctctgtcaaggagtggacaatcacctactgaggagccccacccccgcctctggatggaccgaatcagggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaatgagccggggggctcatgttcctgcctgcagaacatttctgtactagtgagaagagggaatatgcattgcagttcagcaaagccggaattctgtgttgaacagatgtctgtctccctagtgtgtgactcacaccttgtggctgccttcagagcgccacctccagatcagatggggacacacaacccctggatatgtttcattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgctttgatgttcccctgtctttccctcttctgctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcactgtgggtcactgactttgtgtgatgggggtgtgtggggcggctgggtggggaggaacgtttgtgggattttcatggctttagaggtcttaccagtctgcagcctcaggcaggaaatgtttggaacacaggattgtcagatccatcatgtggtggaagggaagccccagagaaggggctggaaccctcggttcctgctcccaaccataccgccagatcaccctctgacctgggtcacatccctgcccttctctgagcctaagtttctttgtcaactgaaaacactggaccagatgatgtctgcatcccatctacttctcaaattcttagcagcctgtatagctttcaggtaaggaatagcatgcatttagatgttaaaaatcaaattcccaaacatccaaattcattgcaaagtgaaaggcactgttctttgaaactgccttttgtacttttgtaa

SEQ ID NO: 110653 - DNA, 1023 bp, Homo sapiens
gttggagactgccttttgtgtggacagctctggtccgcatgtgctgtacctcccaaagggactgtccgggacccaaggaggtccccccaggctgggagaggagggcagacatgccaccctctgcccccaaaacataaagaaatgtggggttagagggttgcgcctacccgataactagtagcagaggagacgccggagcctccccagcttgctggtccccagtaggccttcagcacggctccctttctgcctcatcccaatccctgtgtggtgcacccacacttcagataccccttcctaagaacgtgtcaacagtggacactgcaggcttcccagggggaatggttatgtccgtttgcggcgagattctcattcttgatgtaaatggagaatcttaggactgaagccacacctgagaacacccagcagtcctgggagccgggcttttccttaaccccaccctacattactgggattcagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacaggtgagagcactcgggtctgcgggggttccggatgagcctcagctcccctcggagggcttgtgccctccagcagttactgttctggaggacgcctcacttgctcctttcatctctcccaccccgtccccagcattgttctcctgttgttgggccctgagcccagcactgtgttacagatccaggtggtctgggtaatgctcttgcccacagacaacgaccaggtgtggactctgccctggaagcaggggcagcagatcacagccctgttctccaggaacctgctgcggtctctccctgtgtccctttcctcatcagtaaaggcgggtacagtggagcctgcctcaggctgttgtggattaggtgagcctggcacagggcaggtgctgagtacaagacagcat

SEQ ID NO: 110654 - DNA, 1895 bp, Homo sapiens
tcccagctactcgggaggctgaggcaggagaatggcgtgaacccgggaggcggagcttgtagtgagcagagattgtgccactgcactccagcctgggcaacagagccagacagggctggtgcctccaggaagaggcctcctggtctcagccatcgtgaagcttaaggattggggcttgagctctttcagagcccagagggaagagggcagctgctgggggcacctcactggggggggcataactggaggtggtctgccttcgctcgggctaatcagctttcccagcaggtagagcggtcagcatggcaggcaggctggagcagactcctgcccctccactaagggactgcccaggatgtttttttaagctctgaaattttccagtggactaacagttcacactgatgaacagctggagctgcaagctgtgtttcatagagagcattcttgaacctagagtcaggcctgcggcccctcatcaggcaggtaattgttttcctgcaggaccacagccgctttgtcaactgtgtgcgattctctcctgatgggaacagatttgccacagccagtgctgacggccaggtaagaactgggatgggttttggggtggggaatggcttgtctgcctgctcccgtgactgctcagagccgcaggctgcctaatgctagtcctgacatgcagaacttagacatcgccctccccacatctgcagactcgtcgtcagagcccagtaaatgcatgtctgcttttaaaccacactgggagcttagtctgtgagccccggttttctacagccacagtccatggagaaactgcttactccagagggtgttcacacacacatgacccacatgtttttatttcttggaagatatacatctatgacgggaagactggggagaaggtgtgcgcgctgggcggaagcaaggcccacgacggtgggatttacgcagtgagtatgagcgtgtttcccggcctagtggtgggaatttggccgagtccacgtgtcagtccatccacactcactccggagttagacaaaaacttgaaatgaggggctataagtcggggcggttttatatctgcccagaaaagctttaaggtcgcaataaggtgatgggagaaggtagtggctggaacgggagacctggaggcgggtgttgtccttggcctcactcatgtcccaccctctctctgggctccttctgtcctactcaaacagtcgcagtggacaagctgctttttggggtctctctccagtctgtagtcctctggcacatgacacactgcttttttctgaatagattagttggagtcccgacagcacccatttgctttctgcttctggggacaaaacttccaagatttgggacgtcagcgtgaactccgtggtcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaaggtaaggcctgccctggggaaggctctgcccgctgggtggacagggaagagaccagagtggccagcaaggaaggggaaccgaggggaagccaggtggaagctagagaggtgtcctcaggcctccttggcccttggggttttggtggaaggctgggatgctggttgctttcttgggacatgagtttagccatggtggcaggccaggtgccaagttccccttgagctactgtgagaactggagagtcagggcctagtgattcggggcagtggccatcacccccagctgttgagagcggttacttcctgcagggctctgccttccctgaattgggagtgcacagcctgtgctttacccga

SEQ ID NO: 110655 - DNA, 2132 bp, Homo sapiens
cagcatctcagaggcccatgccgtgcatgcgccccgccttaggcacccaggccttgccaagcctcctcacttctcccttctgcaagacgggggtgtgccggggccagcagcatctgagggttttgactatgaatttgaagtaggagagccacctggcaggtctggagcatctgtgatgcccattttcctgccccagctttgtaggagtgaggggaggagcccagcagccagtctcagcacaaccccacggctctgccctggctttccccatcccgcttgtgcttgcgctgaggatggacaagaacaatggacccggaaatgcacattttagggactgttgatgtccttggaggaggttgtgtttgcagattggaccaagttctcgggactcctcttggaaccgtcagtggtttcactgtctgcctcatggaggattaatgagatcatgtccttaaagtggctcagtgaggagcactgtccattttagtgacatcatgccatgaatcataaatagcctgcgcagtgcagctggaaagggcgaggacgggacccacaaagtgagcagaatttccagagactgttcttggcttagggtacaggagggggctttccaaggatgccccgttcgtagtgaaacaggcttcattttgtcacggaaccgcaggctgagctgggcctggctgggcaggtgaaagcatagggaggctccctgtatgcagctgaacacgcggcagctctcagactctgctcttgtggctaccacctaatgggtaggtagtggagacctggctattttgggagctgtattgaaggctgtggcttcaggccatgtttcttcgctagggtggaggcactgcagagcagggtgagtaatgctgagtcagctgcacaccccatctcagcccagggcaggaggaagcagctcagagacttctgtggtagctagaagccggctgtgggtgggggctccttggcctgccctgggagggatcatttccactctgcagctgtgcattaaacccagcacagggtgctcagcagggtcaggggcaccagtttgttccaggggtgggctggagcctgtcttcttcaccaggctgctgtgcccctgtgtgcttgcttggggacttgtccagaacattctttctctttagttgtcctttctaacttcagaaaggacttcaccccactgccctggcccaggagtgttgggtacaaatgtctgcccagctagcccagctccagggtgggtaccaccatgtgtcttgaagtcttttgtggaacccacaaccatgggccctgcctgaggacctgggagaaatagaaagggctgtggcctggcacagagctaggtggctgtgcccccctcgggtgagtcatgcctctgggccctcccggaaacagggtgacagtgacccttgcgtgctgcaccctcagccacagggagggtgtgagaggcagcagtgaccatccacatgctcaggagacatgtgcggactcaactgcccacgcataggaaggacaggaagggtgctcagggaccccacacctgcccccaaataccttctgagttgcagatacactttggtgtgtatctgcacttaagccctccggaccccagaggaaagctgcggtcgtgctctccatgaccaaccccaagacaaagggagcgcgtgcaggctgggggaagtgagaggaggtgtgagtgctaacatgaggcccagccacagtcagctttgaggacatggtgggctgagcatcgctgggcttcctcccgtatgtgggctcttctgatgtggtcggaaagcctgggatgtggaagttctcaggaattaattgagcctgttatagtaaaagattttaaaaccatatgtgggcattttttattttagagggaattaagttccacttgctgtgaaatccacatagcagtggtcttttttccccagatctttcattctgcagcacatgacggctgagtctgggctgcctttgcctccgcaccagcgctcaggccttggtggccttgcctgccgcccctcgcctcctgagaatgagcagctgtggtggcaactcgggcctgtcttcatctgcgccttctgcacccactccctgcagaggccccctgtggc

SEQ ID NO: 110656 - DNA, 2279 bp, Homo sapiens
ggctgctgatttgccaggcagcagcacgctgttgggaagctgcacaggaagcccggtctgcaggcccaggtggaggccgccaggccacgctgaggcatcgcagtgggcagcacgctgcaccctcacagctgtgcacctcgtttccagaagtcactgcagcaactgcaaaggagaggcaggtgtagccagtgccgtcccattccacaaaggtggcctgaggcccacacgtcattctgatgcccctacaagaaaagaaacacagtgagaaaactaaaccacttcctggcatattggagtttaccatgatgtgtccctgggctttttctgatgcctaagcagggtttgttatccagatgatttctggcaagatttctggcaaaatgcagaggcccaaatggcaggcctctggatgccacgggctctgacttaagggtggctgaatattgttgccctaagacacgttctcttcactaggccttttcctctagaaagcctaagcaaccagacatggttctgagtgggcctatggccacgtggccctggcccggcagtgacctgtggctctccccctgccctttaccccaccaccgcctccccccctcccccgcccgctgtgccccacagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtgagtcactcctctcagcccctccctgccctgttgctgtggctcatgcgtccatgtgctatgaccctgggagggggatgcgctgatgtctgtactaacttgcactcgtgagggttgagctcccagtaggtgccgggccccgtgagggctggctgcagccccaggtaaggtagaactccacatcacactgggtttgtcaccagggcccagcactcatgtatctcctctgacgtcctgagtgccttgcctgctagaaccccagctctcatgcccacctgcaggcagcaagaaggggacagagtgaaagagcaacagcacttctattcggggtccctcacagcagctgccccatgaagctgccagggaggctgaactgtttcttccagctgggcacctcccccaagggtctctgatggaggagggaggggcagtggatgctggctgggtggcactgggtggctactgacctcaggggcctagtgactggtgaggttggtgccgaaacccaggtttttttaattcaagagagtcagagtcccccctgcagcaccatggctggccataaccccttgaacttgacagtggcatgtctgttcttcactgaatggcactttctcgtacatgttctagtaggtgtttttccatggcttctcaagtcattcctgttggtcttaattccttcttttttcagtagcaaatagtaactaaaacagtgtttttgttgaatgtcagccaagagcagggcatctcattcctgtaggggatggtaactgttccctcccaatagaactgtaaggagaatggtgaagctgtaaagatagccctgggccctgtggcgtggggccccacagacacacacatgcatccccttcccgaaggcgccggcttgccccatcttgttcttgggtcctttggacaaatgccttgtggagccagaaccccagtgcttccctcatttgtccctgtggcgttctgagctgcctgctgacagtcactccatcctctgtgcactggcagctcagctatcagattgcttaccagccttctgggattgattttttttttttttttttgtcttccacctgtgtcattgggtcaaggtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgtaagtgaacttactttttgggtgaaatttgtggtttgtacatgaggctagcagaggctgagcctgtttagatgctgatggcagagaccacagcacatgccacgtatgccatgatacacagaagtgggctcccaggggtgtgcagagagagggagggctcccccacccagcactcgtcctccccaggccctcagctgggcatggatggttcccacaaggaagggcc

SEQ ID NO: 110657 - DNA, 2421 bp, Homo sapiens
catggttttcgaggtcacactcagaccatggcagcctcttactggtggcgtagccttagttgagtaactcaccttcctgggcccaaattttctcttccaaactggggctgctagtgcctgcctcttagggtgtgaaggagccagtaaggcatggatatgcccagcatggctgttgcactaatgggtacttacccctgggtgacccgttacctgtcacaaaactggggctctgttctgatcgagccaggcggctgggtgagctggctgactgctgttggcggtcagctgaggtcacggtgaagggttgggcccggagtctggctcatagtaggcatttaatggtttttgtgtttagatcttctccagctccatctgtaaaacatgctctcatttacatcccatgatttatttagctctgtgatttattttttccccaagccctgcttgccagcaaaagtctcttcatttaaagccccaagatttggcccgaatgtcttttacatgtttaacatggagccgaatgctcttagaagtgtcttctcaggagaggaatgcagttggcaagggcctccgctcctgcctggcacattgtccgtgccctgtcagctgcaagctgagaacctgcgggcccaggcctgccctgtccccagtccccagaaaggtgtccaatgagacagaattcaatggaaggctgttgcggagactgttgcaaaggacagaccacataaataagtggccatcgtgggacgctgtcctccctgaaaagtgccctgattttgtagaggagccaagggagtttggggccatcctcaggtccaagtgttcttgggcgagatcatattttatgtttctaatacatttctttgaatagagcgaagcaattgttaaggcttacattggaacgtttgctgcagagatgaagtggggctaaaaatagtgtggtaggggggtggtttggagaagggggctgagaaagagccgtgctggcccactaagtgggttgcctggcagctggccccagccctctgcaggatctttagaccctgtcagtctgactggttcatgactgctgaagtgttgaaccttgggaagggctgcgcacctgggagcctccggcactctgggagcccacattcccacggggcagtcctcagtgcacaggtcatttcgggggcaggcccaggcctccttttcctgaggttattttcatgatactgttctgtctgccttggcgctggggccgtggttccaggctgcccttgggagttggcgagggccatgtgacaggcgtgtggtttggccttacgtaggcccagggcaggcttcctggaggaaggcgcctctttcagggtgggacgccctctgccttgtcctgagagcaatgtcttctccatggggcagcatgggccctggatgggcctgagcatagcagaccacgtggtcacatgtgcatgtgtggacatgtgtgcatgtgtggatatgtatgctcctgagtgtatctgcatgtccttcctgcacacacagtgctcccctccgatgctgccagcctgtggtgacttcctcttctgaccccttcttcccccccggcctgttttatcagtgaaaggacttaactaagcagatctccaggtcacctttggaactcagctcaggtagcacagcaggtggtcttcctggaccttgtgcagagaactgggcccttctgggactccccttagttagtgctgttcactggatttggcatcacctcttgcctgtccccgcagctggactgagagcaggacagtccttacgtgcatctccctcatctcagaggatggctcagtctaggctcgggctgtgtctgcccacaagcaaggcatcttcgtggcctgtgtagagcctccgttaattcgtggactcgttccacctgactcgtaacgagctcttgctgtgcactgaagactagttggagacttcgcacgtgttaactcgtggaacctacagcagccctgtgagtggctctgttatttccactcttctggataaggacacaagccatgttgcttgctgagccccacaaagcctgtgtgtggcagaggctggatttgaacccagggcccctgctcccaaggcctggctcttagctgctgccctcctttgagctgctcagttgcagcaagaaaacaaaagctcttttcactggaagcagctgtagagctgtggtggttgttaacgtgtcctgacaatcctcttaaaaaggcgcctttacctgcttagcagatggggctgaggttttaaagcgtgaagccttgagagttagtctagaatgctcccatttcttcacgccaacacagtgctcatttggagagggtgtgtcgggattgggacttggtacttggtgacaggatcgtggtgggggattgggggtacgtggccccc

SEQ ID NO: 110658 - DNA, 1038 bp, Homo sapiens
ttcctttccaaacccaagtttttgatagagagggctcccacagcgtgtcctgctctgctcctgcacagcacagccaggcgctgagtttggggtccaacattgattggcagccaggagagctggtcctaaacacggaagagaacagagcgctggaatgaatgcagcttcccacaaatgggagggattagaaccagggcttcttgctctaatccaccttttgtgtatctgtttcactgatatatttgttctgtattatggaaagtacagaaaagcagaaaaggaaaaaaatcaccttgttgtacagtcatagactaaggagaacgaattaaagtaacatgaaattctatcacccagagataggtaggcaggcagtagatacgtaggcaagtggtatgcttctgcggttttcttcacggttttagcttcagtgtttctttgtacacccctttcaccccatatctgttgatgtggagagctggaagcttgactgcttctccattccttctgttcattccggggtctcctcctgcagaacccagcccttgctgacatctacacagagcacgcccatcaggtggtggtggccaagtatgcgcccagcggattctacattgcctccggaggtactgtatgggggcaaggctcgtggacacctgtgggggcctgggtggcgctcagggcccagggcgaagctgggcttctggccttgggagagtgggaggagggaggtggggggtgggggagcaggctgggggtggtgagttgaggggagccagtataattagtttcagctgaggctgacaaggaatgtgtaagccagccttgtccaaccggtggcccatgggctgcatgtggccccggatggcttcgaatgcagcccaacacaaattggtacactttttaaaacgtgaggttttttttcttttcttttttcttttcaagctcatcagctatcgatagtattagtgtattttatctgtggcccagggaagccaaaagattgaacacccctggtgtaagctaccaaaatgccccttt

SEQ ID NO: 110659 - DNA, 1072 bp, Homo sapiens
ccgccaccccttccaccctcacccccagcagctgcttatctgctttctgtcattggggttgccttttctaaaatcttctttcatatgaagtgagaggcaatgtgtagtcttttctgtctggctttttcactttgcataacatgttggcgattgatagctggtgttgagtgcatttgcactttgttcctttctatcactaagcagtgcggtgtgttgcctgtttctctgttcacctgttgatggatatttgggtatttccagtttttggccattgcaaagaaagcttctgtgaacattgctcctgtgtcttttggtggacacatgcttccatttctccagggcagatacctaggagtggggttgctggtgtttggtgtgagtagtgtctgtttaggtttataaataacctgcccaactcttttccaactgtaccattttgcatttccaccagcagtgtgaacattccagtgtccccacccctctacccttgccagcacttggtgatgtcagtcttttctttttattgattctagtgagtatggagtggtattctgttgtagttttgacttgcatttcccaagactaatgacactgagcgctttttcatgtgcttacttgtcattcgtagtatcttctttggatagacaccttgatacattctaatttcactggcgaacgattatcccaaaatggattaatttatgactggtgtctattatatcacataatgctgtgttaagtcttagggatgaaagagaaggtctgtgtgtacttctttttttctcccccaaaccacttattgagatggctagtgagataaaggtcatgttaagcagggcacagcagagttggaggagatggacaggaatgctagggactatgatgtgtgttgtgccatcccggtggacatgttaaatgatctggaagcacagaagagttgatacggatagcttgggccatacttggaggcttcatggaggagggaacgcttccgttaggcctgatgggtgagtgggtgtccgtaggcagggagaggtgctggccaagggcacagactacacacagacgtgga

SEQ ID NO: 110660 - DNA, 1036 bp, Homo sapiens
catgcgtaagactactggagagatggccttgcccaagagtagttggagatgcttctttggagagtgacctccaccttctgcaaggcccttgttagggacagctgtggacacaggaaagggccctgtgtgcgtctcttcgccgtctcagtgatgggcaggcactccctgccctggcgatgtgcctgctccttagacctgtgggtccttagctttggtcaccttgcttgtcacttctacgtatgggtcctgcctgctctccagggaaaggccagcatcccacccctacccccgccccactgtccaatccagtgtatacccctgagcacctctctgttctttgttgagtgtattttgtgctggtctgtggctgaaacttggtgtgcttgcctcttctgtttccatgcctgcgagagtgggaggaatgttatcatgggatcagtgtaagatttaacggagctaattcgtaaagcatcttcagaaggttgtctgggccctggcagggacctctgctcttgtcttcatgactgccctgttgggtggataccctcatctctcttttgagaggtgaggatgctgaacctctggaaggtgctggaatttgaaccctgggagccacccccaggtctacctttgcaactcatcagttaaggccctggtgggccctgggtggggagtaggagaggggaagactgaaaacggaggtggtggtgtcccgctcacacgtagtccaatgaggggtgctgctgtgcagggccacacggtgagtacccccaggcctgtttcaaggcatctgaggctgagctgggaggcaggaggggaaagtcgttcagggcatggcggcctgtgagtgaccaccccgtcctcagccagctcaaggagctgcctgtacactgtttggaagcacacagctggttggccagtgcagactttattctctgtattaaagaatcacactaacattgagaccaaccgtaaggaagacaacaaaaccacagggaggagtaaaggccgccacatatggtccctgatttgcagt

SEQ ID NO: 110661 - DNA, 1179 bp, Homo sapiens
aaaaatgatgtctataaaattgagtttccgggagtgcaaggtttatagcaatttgacactgctgggaacccaggcgcagtatcagtggacttttctccttgaacagggggcagaccaagtggggggttggggagggtattgggctcactcttggtttcccttggtgtgagctgccaccattcacatgcagaggactcacctgtgtttcctgcgggttgggggtaatggtggcatgacagagggcttgaggactgacctagctgcttctccggaattggacgcctgctgactacctgcgtgtatccagatggccattggcctgtgggggtgcaggatggaggccctgcccacatggagctcactgtcctgggtgggagtgaaataaactctaggtggcagaaggaagtggtgcgttggattatcacctgggtgcaaacgagctggcagcagcgcctgccaggtgcagagccaggaacctctaggccttcagtctgaccacctgatggcaggggaagcagagggtggtggggggccttcatctcaggagaatctgagtggctgcaggtgccagtcaggacgctgggcttctgcagatgggaccacatctgggaggaccgaagggccgggtgcttatgggctgttactgtggcactgagcgtgaggggagtggacaggacccaggctgagaagtgctggtgtgcagtggtggcaggtggctcacacagccctaccatagcgcagccctgctctgaaggccactggagccattcagaggtctcacagacaagtaatcagatccagcctacggtaaggagaagttctgtatctgagatctgaggcagggaagccaattaggaagctgctcaaagatgaaggcggcgtcagcgcaggttccgttgcgtggtgcagccatctctggctctcacgtttcccacacatgttcactaagcccctgtcttggcaagccataccctaagccacagaggaccaggattaaaatcagtgattttcagggaggggtaatttcccccacctcattcccctgagggatatctggcaacgtttgcagacatttttgtgccactggtatctgaagtcagggttgtggccaaacatccgacaaggtacatggccgtccttccacaaagaactgtccagccccaaatgccaggggtacca

SEQ ID NO: 110662 - DNA, 1044 bp, Homo sapiens
agtgatctgctcgctcgccttggcctcccaaagtcctgggatacaggcgtgagccaccacactaggcctttccctttggtttatacttagatgtagtcaccttagtagaggggtgtccccggaatagaattttccatccccggccttctgtctttctcattgctgacaataagtaggaagcaagctaacaagcagcaggctacggctgcctacaagtgtacataggtatctgcctgtccccctaactgggcatcagctccaggccagcagggctttcccctctctttcagtcactgccgtgtcctcgcctaagagagtgtctggcacacagtaggtgctcagtgagttactcattgattaaaaagcctggaaaaccaggctgtgtcgtgaagataataggcagccactgaggtcttactgcatgagaacaaggaaagctcagctcagtgtagattgccggacctaaattttgtggaatcgcctttcatacctaagaggcgagcaccgttgccagctttgcacttggagccccctctgtcatttattttgttgacttaaaagctgttttgtgaacccagcataatggcacttcttaaacttgtagaaaaagggtgtttcttacctgtttatttcaacacatctcgttgcctcacctggagaggcaactctcctctgtagagtgaaagactataatggtggccatgtagaaactaatattccagaaggagagagctccaagaaggggattccagtgaaccatatgtacactgtgtttgagagacattagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagta

SEQ ID NO: 110663 - DNA, 2350 bp, Homo sapiens
cccggcccctaggcgccgtgcgggtggcgggggagtcctcggcgcgggggaggggtgcgggcgccggccggaggcgtggcggggccgccctcggtggtgcagggcgggacccccgacggggggtgcgcccccaagttggcgccgtgggccgagccggaggagccccgctgcccccaagggcctggcccggggcgcggaccaggaagtcgcgcggttcctggcgctcgtggaaagtggaggccgccctcccggcgcagtcaacaggtgaccggccgagaccggtccggggctccttctcccttctgtccccgccgtccccgccctgccctgacatgccccgccgcatttgtgtctccgcagagaaggtgttcgccagcctcccgcaggtggagaggggcgtctccaagatcatcggcggcgaccctaagggcaacaattttctgtacaccaatggaaagtgcgtcatcctaaggaacatcgacgtgagtaccccctaccccgggcgcggttctgctccggagccaccttgggatgggataattcgccttcctctccacttctcacctcctgcccattggcccggggagggtgagggcgccacgccccctctaccgggagccacacctcggagccccggaagccggcctcagattcacccaggtccttgtctgctccttcttgatgaggaaactgagtcttagttcgtttctgtctacggtcatagcaccctgaaagcgccggatcgcctctgatcttggaagctaagcacggtcaggcctggttagtacgtggatgggagattagattagttcattccttaaaagcaagggctccggatttgagggatcagactgacccggtcggccgctgcgtgaccttgagaagattggcgatttgggcatctctgagccccagttttctcgtctgtaaaacagatgatgagatgatgaccactctcgcttcgcctgctggctgggcagatggaatgaatgagctgctggcgtccctcaagcccagcggtgcctggtgcactttgagcccttgctgaatggaatggcactcagctaactcgctgttaataccctggtcttccagtatggcagagcccggaaaaacacccgggcctctgggccagccagatctgccaccatggatctaagccccaaagcaaaaacaggaagcagtgttttcccatgaatcattctctgcaagcctccggtacccaggctgaaaaggcttctagagccagctccttgggaaatccttgcaaattcatgttattcctctgtaattgttggggtgacccagtctgtcagtctccctcccttcctgggttacacgcttaaattttgcttttcccttcctcagcctgagtgatggaattggtggggtgggagttggaggtgccggcccggccattgggtgatttctcctgtgctgtgcttagtgggggcggctggcacaaagatgtatgttttgattgatgccataggcatacaagggttgtcaacttaaagtcagcctgatttcccttggtaggttgggactgttgatcggacacacttgccctccaggaggccagcaactggctgagggaatgaaggggtctctgggtctcagtttccttctctgtgaaaggagaagcctcttggtccgaagagctgctggctctgcccgcatctgtctcgttaacccaggcagtcgctgctgttcctctgctggaagacagagctctacctgccctggattgctgggcccctcaaatgagggggtgggcgggtgtgaatgtgctttgaaggtgctaacaacttgctagtcacacagattcctagaaagccgaagggccttgcttagaactggagaaaatcaccagggatctaatggtaatgatctggaagtctccgaaggcaggtcctgaggcttttgagaaaataaaaattgagacaaccctaaagagatatttagtagtttggcaaataaaatccactaacacgtcctcggatacagagcagtaggatatttcgttttgcccctaaccaggccttccctgtcgttgcagtccacattgacttccagggagggggcctcacataaagtacctgctgtgcatctggccctgtgatagcttcttaaactgtagcatctctttccaccccacatgggtccgttactctaaagaggagtcagacttagcaaggtgaggcaggccagtaactggagctgcttctaatggagtggtcattcagggacaggcacccctttgcagaaagcatttcccagcttgtgaaacccattctgcctgtttctgagctctgtattcttaccccttccccgtggtttgccattttct

SEQ ID NO: 110664 - DNA, 1050 bp, Homo sapiens
tgagcacgctctgagtcctggcttctagagccacaaactgcaaatacgtcagatgtgtgaggcctatactggaagctttggggaggaacaaagccacaggagagctgaatttctctccaaagcctgtcaagctgcttcctcactttcaaccctcatgggttctgtccaggctcaggaaaagggggctttctctttcctgttgcttcaactgtatcaaccccctaggaagagccctatgcaagggtagcgctgctcccgtctagctcaccctgtggactgaacccccgccctttccacaaaggactgttgggtatagtgggggaagcctttctgctccaggaatttcagtcccttttgcaggcctgtccctgtctcataaataagctcaagtcatattcaaagtttcatctccggagtgtccctggagtaaatcacctttatctactacctcaagccagtctcgctgcctccacctccccatctgcacagggagttggagtgattgccagtgagtcctctagagggtctgacacatggtgggaagtggctgcccacagcctgagttaatgtgtaacgcttttagcttcgctgtcaggctttcagatctttaattctcaaatctcactggttggatcgagtccatagtccgttactagctgtgactagggagggtggtgaaatgcatggcaaaagcagctactggtatccaccttttgacctggaaaaatccgggttgtggggcctgggctgtccctccaaagtgaactggaaaccgggctaccttgccagaagtgcttggatgcctttgtcagaggactggtaacaaagcctttaacctgctagcataaaccttatgcaaaaggggttagcccggttaattctgccaaggcaagaaatgagttatctgcaaccctccagtgaactcgtttactgaatcccttcttggggggccctatgtgttgtaaatacctttctttccagttgagcagcccattggaaagtgggttttgcaaataagcaaataactaacacctgcatgctgcagcagct

SEQ ID NO: 110665 - DNA, 1124 bp, Homo sapiens
tgaacaagtgagtagaaacccctttggatcattttattactgcatttttatttggtgctttttaggaagtagatctttggtaccacttcactacgtagagcattcgaagttttatccatgttatatattgtactcctgtggcatgaaaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagttaaaaaaaaaaaacctgacccaaagtatactctgatagactatattatattcaattttgtatccccagtcgagaacatcttgtaagccttcattaagggccacctgctgtctgttgaactagactgaacaaaatatattttctcacaagctccatccctttttctttaggacatgttatatataatccatctcagaagttgaagatgtgatgttgctcggcctttggaataatttttaaatctgtaaatgtctatatgagcagaaacaaaacattgtgtaacatgttttaagcattattgtaattcctgtgttaacagtttgtgtgtctgctgctctggttttgaaacat

SEQ ID NO: 110666 - DNA, 1904 bp, Homo sapiens
aataagtaaacagttactctttaaagcaagttatcttttagtttattctggtttggagtccctccaccaagattcagtagaagaaatacagactgtagaaatgagaggactgctaattcttcagaactgtaggaatattgggagctaggagtctgaacctgaagtatgtgattggaccccagaatgtatttgaaggctctgaaattgtacatgcaaattggtacatatgcatttttctggagagagcctgtgaaactgaacagattttcagtgggatctgagacttttctttgtttagcaccccgttttctgagtacatactgatctttcataatccattcagaggggcagattgagaatgttttacacatgctcttcatataaatgctacagaaaaacctttgttttggtgtgcacatccattttgtttttgctttaatttgtgttctgagtatttggtgcacaatggaaattatattttctactttactgtcttcaatttggttatagagaaatggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattcctgtcttaggcgatttgtggggtgcagtgaatgaaactaaagagttgttgcacctgaaaaagacaccagtgattgtttattgggtagtcgattggagactttgatttttttttttttttttcacatgggaaagtcttagattccagtagatggaattgcaatcctttgcagtttgttctcattacagataatcaacatttcttttgtataattcaatacatgatcatcaagttaattggtaaatttttattgaaatttaaaacttgcatttttatatatgtgtatgtgtacacataaaaatattttttaccatatgaaaattgcagtagctaattttctgatttcctattttataa

SEQ ID NO: 110667 - DNA, 1013 bp, Homo sapiens
ccttttgtatcaaggctcagaggcagaggctgccatgatgaccattgctacatgtgcaaagtgcaaaagtgttcacaagatctctcttcaagatttgcagaagggtacagggaaggacggtatgtatgtctgcttccagtgcagcctcggtgcagctcctcccaattttcattttgtgagcaataattccagtgcgactcatgttggaaataaaactgaaaacttctcaagttctgtcaatagcaaatttaaggtaaggaactttaagccaggcaaatactattgtgataaatgtcgattctctacaaaggacccgctgcagtacaaaaagcacacccttcaacacgaggagattaaattcatttgttctcactgcagctacatttcgtatacgaaaggagagtttcagaggcatttggtgaaacacacaggcatatttccttatcagtgtgagtattgtgactatggtgctattagaaatgattatattgtcaaacacacgaagagagtacatgaaagggcaggtgcgaaacggccagtcaaagctgttgccaagctggagccaaaaagaaccggaacttcaaaacaaaacccagagcttctaaaagcttccaatccacggactacatttcaaaataagtggtcagaccaactgtcaggtttctctctccatgcaaataaagacaaaatgcacaatatcatgttgttacctgaaccaaaggaataccaaaaagatgtagtttgtattccaaataaaatgaccctgtctgagccaaatgaagtcaacctatttgagaacaaaaatgttgaagtagaagtgttatcccctgcaaaagaacctgttcagccaggtatgccattgacagttgttgcaccagcagaactagttgtccctgcaaactgtttagcccagttgatagatgtgaaggttgtcaatggtacacagcagcttgttctgaaactgtttccgctggaagaaaataattgccttgaagctgggagggataatggag

SEQ ID NO: 110668 - DNA, 1007 bp, Homo sapiens
aatacagcttgtcatcagatatgatgtgttattttggtgctttccaaagggcaggttttacaccagatctgagtgcgttactgttgcatctcttgagcccctgtggaggggcttttttaaactccccgacgtcggtctttcagactacctttatatggctcttggcctgttagcattgtgccagaaggaagctacctgtgttgccacccatcattgtcattgaacaaacactgactgagtccctctgggtgcctcttgacacttggagaaggactcaaaaatttcaaaagtcttctcttatactctagtgttcttatactctagcattctaatcatcatggcggctctgggaggaattggataattgttcctaattctagttgctagatgaaaaactgaggttcagaagatctaagtgactttcttaagtcatgaaagaaaggcttttagcagattccaaactagaatggattttgttatgctcctagtttgccatattctgggaaaataagtgtctttaaagattgtataaaagagtcactgtggccaggtgcggtggctcacgcctgtaatcccagcactttgggaggctgaggcaggcagatcacctgaggtcaggggttaaagaccagcctggccaacatggagaaaccctgtctctactaaaaatacaaaattagctgggcatggtggtgcaaacctgtaatcccagctactcgggaggctgaggcaggagaattgcttgaaccctggaggcagaggttgcagtgagccaagattgcaccattgcactccagcctgggcaacaagagtgaaacactgtctcaaaaaaaaaaaaaaaaaaaggtcactctgtgtatattggagtgcttacttgctctagaaaaccttcgtcacctcttgtgtcccaggccaggccatccgtgatctcctttctgctccagcctctcctctgccatgtccgtacaatactgggttattgtctttcctagaacatgtcccgttcc

SEQ ID NO: 110669 - DNA, 1130 bp, Homo sapiens
acaggttacaaaggccaaagagaactcccatctacttgttatgaagaaacctcacatctttttcacttgcacagagggatgtggcaatgtagtaacattgcattatcttgagcatagttcagaagccaagaagatactttcaaacaggtgacataattcatttatggcccagatgtcctgccttccccatcacactgcatttgctaataatcatggctgcatgcttcatattggcacttgctcctatggattcttaattcaaaataactgctgagaaagttttgcagaggcctctccaagactctgccttcctcatgcgttctggctggcttgtgtattctctggggactttccttggctgggatgctctccattccttgctgatggacgtgatcttactgcccagtctgtctcagattttcaagtatttagttttagaataaatgataccttcccgcccccaacttttgaaaggacttagagagaaaaatggcaaaagtgccttctgggatttttgaagactcctgggggctgagcaagaggctgaaacactgaaaatgagccagtggaatcctggtttggatgattgttcaaatagaggaatcttgtcacatgacttagttgagaatttcttagggctaatatagagggtgttatgttcaaatagttggtaagcaaattgtggcaggcaggtttctttctcacacactagtattacaagactggtagatcagagcataaacagatatcaacttatatgcaaatctttggaagagaattgagaactgaggatgagagaggtgcagattggtaactggttgaccaagaggaattaagtttatttttgttgctccagagtcaaggcagaacaaggaaatttataggaaagctgatttctgtttcatttaagggtaaattgttggtaatgagaactatgtgaatataaaattggctgcctatagagggaagtggttttttgtttatggcgatattaaactatcagctgcatggtcaattggagaagatgttttaaggatttaaatattctcagaagcttcagccagtaatttggaatgctggcttttcatcaggattacctagggtgcctttacaagccacaaaaatctcct

SEQ ID NO: 110670 - DNA, 1011 bp, Homo sapiens
cagctataccctgccccagcaatgagtatggtagagccacattcaaaggcggactttggggtcagcattcctgaaaagagctgcttaagtttgcttctacatccaaaaacgatgcagtcacagtcaactaacactgagcttgctgggcatctcctgaacagaaatgtatgtggtggtccatgtagcatgtatgcgatataattggccacccacctttccttttcacattaacatttatcacagaaacacattcatttgctacagggatatttcacaatttggctgaactttgagagaagtgggtgaggaaaaggtagtttcgtaactagtttatatataaacctaaattgtagtgagtactcttgtaagtggagcatcttttctatggtaattataaatggctgttagcccctttgcactaaagctaggtgggtggttttgccacagaggtaaattatctttcgggcggtataaccaaacaaataaaatataaagtgagattcagggcatgttctgaatacagcagttaattaggcagctaagaaaactgtattttagcccctctgactatgtgattggtatttttttaaattaaaaaatggaaaataatatttttaacaggttatgatatgtcagtcatttaatcctcacagtaactctgtggggtaggtaggtactgtttctatctcattttacaggtaaggaatcaaaacagtgggtatacccaggttgtatatctagaaagtgatagagctgggattttaaactttataatctgattccagaatctctacctttaaacactatgttaccacttacttctcttcaaattttattgagcattagatgtttccagtatttagaagtcaaatgcttcgtttttaataggaacttacacagtcttttatgtttttttatagccctcaatgtcactgatgtggattctcccaaactcgatactttgtttgtttttatgtccccataataagtctttaagaaaacagggcaagt

SEQ ID NO: 110671 - DNA, 1045 bp, Homo sapiens
ctcctttaaaaaataatatcccgggcacatgacaggccaattgccctaatgcaaccaaggttaagaactactggtttaatgggagatattttttctgtgcttgattatactgttttattaaactctgaatccatttctttctgcaaatttttaaggcaaaaaagaaatgtgaaaatatacgtctcatttttagcaccttcagagacccggagtcatttgatgtgcttcatgacataaaattttgtaatatgccgtgtgatactaccttatttttaccatatatgtatttttaatgcttaacaagagcatatttgctctttcacatttttttttcacatacaaagttttagacatcaagcactctaaattcttttttacaaatatttttttcttaaaatgttaagaaaaagcctataatatcacttcctttgtttcctgatgtagactcagttgatgtgcacagcagtgtcaagtcaatctccaaaatactccctgtagacagggtggggagaagaccctcacttcctgccgactaatgaactcatgttgatacagacctttgcctcatcagattcatttgttaagctaaccagtgtctgcttctctggacattactggactcttctacctgtgaagccatcttaaaaaaatatattgactgatttcttaacgaaacatctactctttgccaagcataaagttacctcccacttgcatacacccttttctcatttgtcctcacatcagctgtataaatgagaaatattcacattttataagtgagaacattcaggctcagataggttaacaagtttgaaatcatgtgctagtaaaccaaacacctaggttttgaaccttgttcttcttgtcccaaggtcattattctctactgtgttacactcagctgctttcacctggaaaagcagaggaatcaggctgtctcctgcagctgtcttggtccattctgctgcccaagcagtacacttggtttcagatggaaatctaggatcccaagcatgggtacatttgtcggcagcatttggaa

SEQ ID NO: 110672 - DNA, 1083 bp, Homo sapiens
tattgatatctttaactaggatgcaatttttaaaagttactttcatcttggatcaaatttagccttcaaaaataacacttttttgcgtagacagtttgctatgctgataacattcattgcaaatgcaatttgaaaagagcagacaaaggatggcattcctttatttattgggactcctttctgatgtattatacccgatctgaagatcttaaaaatgcaaaatggcaattaaaaaaatccatttagatctctagagatttatttgcctttaagtaagggcatcggggccagtttttgtgcaaaaggaagaacaaagaacattttatttttgtctctgtgaagcctgctctttcattcattcattcactcattctttcaaccagtacgaaccttattgagtgccttccttggccaaacccttcgctattgatcatgataaacaagatccttaccagggagggtttccccaatcatgattgttctcaaactgcctgctgtctactgcattttctttgttatgcaaactcagctaactgcaatttccaggattcatccttggagtgaaagcagctacagatcagccagtctaaacattgtcatcatagggtgagggtggggaggcatcaaaatcaactagggagaattttaaaccatatgcctgagccccaccctaggaaatggtaacctgatctgctaggttgcatgtgagtcctgggaatcctttttaagttccgtgggtgactttgccatacacccctgcttgagaaccacttctggggctcattccccttatcttcaacactctgagaaaccaaggctgtgccggtccaggacttaaacccaagtgtttggcttctgttgcaggcctctttgtgcagcgccttgctgacgcccagggttctgatgtagaagcctacaccagggcctgaggttgtgaaactcatggcagtccacgcctgagaagagaaggcctgaaagagaaggaagagcccatgggacttgccacggttttgacttacatctgcaactccaaggctacaggcaggaagtaagaacagtgctcaagtggcagcagatactgac

SEQ ID NO: 110673 - DNA, 1070 bp, Homo sapiens
ttgattcattcattttttttttcttttttgagacagtgtcttgctctgtctcccaggctggggtacagtggcatgatctcagttcactgcaacctccacctcccgagctcaagtgattctcctgtgtcgtcctcccgagcagctgggatcacaagcacccaccaccatgcccagctgattttttttttgtatttttagtagagacggggtttcaccatgttggccaggctggtttcgaactcctgacctcaagtgatctgcccaccttggcctcccaaagtgctaggattacagacctgagccaccatccctggcccatttattcatttttgatggacatttaggttgtttccatatcttggaataattgtgaataatgctgcaatgaatatgggtgtgcagatatcttttcaagatcctgatttcatttattttggatacatatacagaagtgggattgctgaatataatagttccatttttaattttttaaggaaacccagtactgttttccatagtggctgcaccatttggcattcccaccaacaatgtacagggtttccattggtccacattcttgccaacatttgttatcttttgttttttgataatggccaacaggcatatgaaaaggtgctcaatttcactaatcattgggaaaaagcaaatcaaaaccacaatgagatattaacttacacatattaagatggttattacatgtgtatctttccggccaggctctgagctcacaatcacagggattgtgtcttttttgtctttatctccaaagtctagcataatgctcatatgtcaataattgttctggtaattttatcctaaatttgccctaaatataatttcaaaagagctttaggggtaatagggcatgaaacaaaattaaactatgttttgaatttctttcttcaatactcagagacagagaaaattataacattcaattacatatttacttttatttacattagtaaggctgtaaattatgaatgtaaatgtgcttagctagaacaaatattgctcagaataaaaaagatatacaaatataatgctaa

SEQ ID NO: 110674 - DNA, 1009 bp, Homo sapiens
ggcaggagaatcacttgaagccgggaggtggggcgggggttgcagtgaactgagattgccccatggcactccagcctgggcaaaaagagcggaaactctgtctcaaaaaaaattaaaaaaaaaaaaagcatatttgattgaagtctcctatctccctaaaaagtataaaaccaagctgcaccctgacccccttgggcacatgttctcaggatctctggagagctgtgtcacgggccatggtcactcatatttggctcagaataaatctcttcaaatattttccagaatttgactcttttcggcaataatataataagatttaccattttaaccatttttaggtgtataattcagtggcattaagtacattcacattgctttacagccatttccgctatccatctccaagtttctaatgactccaaactgaaactctgtatccattaaagaataactctccattacctccacctccttcctcagggcccagttaccaccatcctaccttccgtctctatgaatttgcctattctaggtaccttgtattcctggaatcatatatttgtcctccatgtctgacttatttcactcagcataatgttttcaaggttcttgtatattgtatcacgttagaattttattcctttttagagctgtaaactgtttcattgtgtgtgtgtgtataccattctgtttatccattcatctgtcaatggacatataggttatttccgtcttttgtctattgtaaataatgttatgaacatgggtgtacaaatatctgagtctctgctttcaattcttttgggcatagactaaggaatggaatacttctaaagtcactttctacaatatataatactagttaaaaaaattaaccagagtagtgatataaagtgaaaacaggtcaccttaaagaatattattaactaaatgttattattgacaggacatagatatgccacaaatcataaaggtatactcaaatagctgaaatcagggaaatcct

SEQ ID NO: 110675 - DNA, 1039 bp, Homo sapiens
tctcacactctcccaccagaatatgtgctccaggagagcaggggcagtgtctgtttgctccagtttctagaacagtgtattgctcagaaaagaagaaacaggcggcatttctgtctgggggagttaggaagcggttcatggtggaagaaatatttaagaaaagagatgtggtgagaacagccaaagaagaatgataagacgtagtcaaaattgcatagccctcaaacctttgttgaaaactcatttgtctattttagggattcccaatacggtcagtccagctgaataactggcatattaatacaagcgctttgctgaatagatcctggtctgcttgtgcaaaagcactctggcatgaaaagaatgtagtagataattccttactttcacataatgtgacaatacccactgcctcctttatctctcgtacccagtcctgcgaggactgcaggggagctctcaccatcttcatttgctatttaaggaaactgaggtccagaagtgaagaaacttttcttagagatgcccagagtaaaggtggcagactccggatccagggacaaaattctctacctgctgtgagcagtaggctcaaggtggagatttgttaaatccctggagaactgagtagtccacattttctataagcaaagaaatacatttagatgtgaaacattcacatctcctttcatccctcaagaacttctatttcagcattttatgtcttgtcgaatttccactagaattcctgcagatgaagtacttgtacaccctgtggtaggttgttttatgtaaatgtcttcactctttagtttaggagggtaaatcaaagttctgtgtcagcagttaaaatacagtgagagaaaggtgatttcggctgcagctgaaatgaaaagcaagcttgcctagctgtgctccgaaaaatacatacttgtgtggcagggaatgagagtgggctgggagcctcctctggaaaactggcttgcactttacttgaattacttctaaaaccagatctctcccagtgtcctgggtagga

SEQ ID NO: 110676 - DNA, 1050 bp, Homo sapiens
cctgggtccctgtgttagagacagttgttgcaggagagtggtaactttttagcagcttccagggaaatgcagtaactttccagctagtgctggaaaatatcagggctattcccagtttttttcccctcaacctggctacttgacctggtgctttcaattgaggctgctcttttcttatggcagaaggcaggagagtgctagctggatttaaagccaacttcttgccccatgaccttgggcaacaatttctccctccctgaccctaaatttcttcctctgcaaaacagtgatgaaaagattattataagaaagtgagaaaatgtatatgaaatgcatcttgccgattggagaacacttgtgcaattgtaaagggtaaaaaatacaaaaaattaagttttatcgtagatctattttaatgttcattttaatcatagtttgcatatgtctgagtaaatgacatatgctaaacattaagtgggagagatttcttttaattggccagtctcttcttgtgatcactccacctgaatgctacaagcaccgggcctcactacttctcagaatgattcctttcttgttttcaggatcacagtcaatttttagagtgtttttccttttaacataatacacattacatgtcttaagaaaatctgtttgaagagagggccctgatgttaattaataatttttttaaaaaaggagaaaagtcacaaatggggagtgactccactggggaaaagtaaaacatgaccagtgtcacgagatgacccgggtcccccttgtctgaatctttcatcagcataatgcactggctcctcatcattgcattttaggtgttgttccaaacgtgtctccagaacctaactcagtgcctgcctggcacttagacattcaataagtatatttggaataattgaatgagtgattggactgaatcttcacagcaaccttggagagcagatggcgtcatttctattttaaggatttggaatctgccgatcggaaaacttaattaattttctaaaggtacaaaggattccagactagaat

SEQ ID NO: 110677 - DNA, 1048 bp, Homo sapiens
cttcttaacatcttccctacccttctttctaaaacatctgttcatcttcaactctggtgagcactttgctctagcaagtggttcctcagtctgcatctttgcagagattttctctacgggaagaaagaccttggatagggcaaggtagaaaacctgctttttctcctagctcaaaaaccaactccatgtgtgactagtcaaaccatttaacctctctgggctcagtttcctcatctgaaaaaaacaggacgttggacaagagcagggatctgggacctatttgttgagtacagttatatgcactctttctcatcagtatggcttatttattatgggtgcagtacaggtgcactgagctctttgtaagcattttctcatttcacataggtggtagtcagccttcaagatggttccaatgatccttgcctcctggtattcacctttgtgaatcccctctcacattaaatcagaactaacctgccatccatagaaacggatgtggtatgtgattttcgaggcgagatcataaaaggcattgtcaacttcctccttggccccttcaattgccccttctgaggaaagccagacaccatgctgtgaggacactgaagcagcaatgtggagactgctatggagagaagacctcccaccaacagctaccaccaacttgccagtcctttgttaacagccagcttggaagcaaatcttccggccccagttaggccttcatgtgactgcagcctcaccaaagacccagaactagttgaactgccccccaaatttctgatccaaagaaactatgagataataaatgatcattgttgttgtaagcccctaagtctttgagtaatttgcttcacagcaatagataactaataccatgggtatttgtattatctctgacagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtc

SEQ ID NO: 110678 - DNA, 1031 bp, Homo sapiens
ggcatttcaggggctccacatcagctgcctcctgcctttctacctcttctcatgccactccactgtaccatcatcacttctctgcaaacagagctatggactcattcctatttgttttgtgatgctccacaggactctgtttgtcttggtcatagttttttttttttttttttttttttgtgctaagacacagtgcctggcatgactggtgctccatatttgctacattgaagtgggaacaaaagccacccttccacaaagccagtgcttgtctccacagctcacagttccacatcagtacctctctgatagccactgcccctttctgctttgaatcgctgctatttgtgcccctgttttttattgtttaataatccatgagctcattgaagggctgctctagtctcttctctctcatgtctcttatggtgcctggcagcgtgcctttgtcatagatttgccacaagtgtgtgtagaaatttggatacctaattttagaggtgtaagggattttggaaaactttgttcccttccttacgtggctaaggaaaccgaagtgtggacagaaaaagtaacttgccagagatcattgaatcatagagctagacttgatagatctgtctctaggctgagaaattaaaaaaaaattaattaaaaaattttgaaaactgtgactctagttgttagtgggtccagcctctttctattttgatttttatatttttcattttataataatttagcagacttttaagaccttcaagtgataaacccttcaagctattgcagcttatcttcctaatatgtgcaggccagttgactagggatgttaatagaatataaagttgaataaatgagctctcaaccctcgaggactttacaatctagtgggagagatgtttgttgttattgctgctattttaaaagctgtgattgattgaagccttctattaaactaaacttgcccaaggctttacatttagtaaaaggtgaggccatgctccgcttggtcattttgtgttgatttcacc

SEQ ID NO: 110679 - DNA, 1161 bp, Homo sapiens
ctcatttatgttgtatggaattgacagcgtattgtcagggcagaaatagtgaagtacccggaagaagaaaatcaacataccacctctactcagagtagaatctgttcagtacagtagtgcaggtattaagtgataaattattacagtttggggaggtgggaagggagaaccattgaatgctatcttgttctttattccctatgaatagggaagttcagatgattattgtacattattggaagttaatatcacgtctacgtcttgatttagaactaaaaaattggtcctctgccaggagacatgaattaagaaattgggaacaaattaaaataacatttcagttacttttaaacatatttgtctttatggttgtgtttattacatgtgcagtgaagtggagaattgaggcagttatttcattattcattccttaccatttttcctgaaatagcttggtaattgaaagagtatttttaaaatttgctttgaattgcccttctttgtctgcttgtgtgtgcagactttgtagagttgaaaacagtaaaggatttgttttaaagtattacttagagatgaatattaagcatattgctaagtgtatcattttagatgttccttgaagtgtgtgttagagggaaggagggaagagttaaaattatcttttggtttaaattattttaaaaacatgaatatgaagtaattttctaaattttttcatcatactcttttttgttagagttgtattcataaccaatagtgagccatttggaaatagggattttggaggaaaggtttagaagttggaaaagatttaaaaatgggttgctcagaatatttctgctttatatgtgaatcctctttaacatttaaatgtcttcttccaaactcacaaactgctgtaaacattcaatgaaaagttttcgctaaatataatggcttatggaaatattaatcaataatgctattttttactttgaaatgatgagttcttttctatgatttaaaatatatgtgaatgatttatttattttgctctaaattattatcagggtttaatttttcattattgatttgtcagtttttcattagacttatgataacctcaagttaatgtcataaaaccagggacaactcagtagctgagttgccattctcttcttg

SEQ ID NO: 110680 - DNA, 1033 bp, Homo sapiens
aggctatcaggaatatgtatccttttttgttagaagtaaaaattaataaagttttgataaatattctataagcatgtgatgaatagggataagaatatggtaggacatttatgaagaaaagataagttatactacagtaaatgtcaggattggaactctagtaattacagcagacctgacataagctaactatgtgtggaaaggctatttatagaaaaatatttgtctatttttgtttaatcgtaatggcatatatttttcctttgctctgaactgataaaatatagtaaacagtaccaagttgctttactcaagaaacatggagaatttgctggaatgatatgaaaggcacagagagtattaaagtgttagaaactaagaccttttgagataggccaaaggtggctaaaaggaccaagataaaaccgacagtgaaaaactaggttggtaaagtatagattatttttattttcttcaggaattatgggagtttttatagtagtaagtaggattgttttgttgttttttaaagtggtagctgtaatcatcatgttaaatctttcatgtgtgtgtttagagaaaatgatcaattcattgaattgcatggagttttaaattatggctttataatttaaaaattattatatttaaaatgttgctacatttgacaaataaagctatttttggaatcacctgctatatcatatttttgcaattattgctgtttatcatttttaagaaaattctgtttatttgaagataacttaagcatgcctcttttaaatcatttaaacccatttttgttatgtaggtcttcctgtgctttcagaaagttgctgctgaaatccttgggatcaaattaaacaaagcagaaatagaacagtcacaggtgattaccttgaactttatatttaaaaaattaatgaatttcttacaaggcattaattttcacccataaattctttcccatttatgccttctgtgtacgtatctctaaaagctttgggaatagattgtatgtatgaatcagtgt

SEQ ID NO: 110681 - DNA, 1354 bp, Homo sapiens
tcaataaatgtttgttgaataagttctttttttttcaattgaacaatggtactactagtctttccatggttatatttgttaggaaaaaaacttttgtttgagtagtaaatgatagatggagatttggaaggaaggagggagaaagagaaataaaaagcaataaaccattagaaaaaacaaatgtacacacacattaagtgacacaacttttatttttatttatttattttttaatggatggtgatttcaatgggtggcgatttcaatggggatttttcctcgtgacaagatttgttcttactcttgttgaattagaaaagttagctccaatattatgataaattggatatataaatgtcagtgctaatagcttagtattttagtcttccacaaattgatgcctgtggtatctggacattccttgcctgttcttgtaaataaggagatagtgatgtttaaggaatagcactctggccagaagagcaaaaaaaacaaaacaaagcaaaacaaaaagaccaggtgctgtggctcacgcccgtaattctagcactttgggaggccgaggtgggtggatcatttgaggtcaggaattcaagaccaacctggccaacgtagtgaaaccccatctctactaaaaatacaaaaaattagccgggcgtggtggcaggcgcctgtaatcccagctacttgggaggctgaggcaggagaattgcttgaacccaggaggcagaggttgcagtgagccgagatcatgccattgcactccagcccgggtgacagtgcaagactctgtctcaaaaaaaaaaaaaaaaaaaaaaattccatattttccaaggtaagcaatataaatggggctcaggaataccccattagattaaaaaaaatctcctagagagagaacccttgagcctacaaactaaagactttcaatataattttaaataaagtcttttatgtagtatgagtgcattttttagttgataatcaattggcactattatgtaggcttactagatttgcaaatttacaagtttttacaagtcatttgggtcccttcctcaggaaatcagtttaagttttttttttcctatattgactcaaagagcctagttgtccttaaatcctgtgaatatatttgccttataatttgacggcattgaatcaacacccttatagggtctgtagtgttgtaaaaagagaaactgttaaataaaggatcacatttggaaaaatacactgtgctggataaaaccagtattggatatgagtactgtgccttgctttaaagcacctacaactatttaaggaaatacatccttgccccttactctcaaaatggatactctagatggaa

SEQ ID NO: 110682 - DNA, 1986 bp, Homo sapiens
cttctaccttcagaagtaactgctatccatagtcttgatctttttcttgcttttctattttcataatatgtgtatgtgtcatcaaataatgttgttttgccatttaatatttttatataaatgcaattatttatgtgtattcctttgcatgttgccctcaccacctttgtgagattcattcttattgtggtgtgaaactctagttcattaattttcagccctgtgtagtattcctgtaaaatgcagccatgcatattattttagacacaattgattatttgtatttattttaagagcctaaaaatatttctcttcactcaacaaatactttgtgagtggttgttttattatgtgctttgttaatttgttggtttttgtttttagctgcatgtaacaaaacaaccaaataagtataggctaaaagtagcaaccttattatctcagaatatttgacttcataaagtcttaatttctatgtctcaaaaccctcatgaaacgtttaaaaggagaatgccaacctaaggtgaatgtttggagtgaatatggcagatatccttaatatacaaagtgcttacacagattgataaggtaaacacttaaaacccagttttgaaagtgggaaataagaggcatcttataaagaaatgtaaaaactagtatacaggaaaatttttaaactgcattgaggtctttaaatttataccagaaacaaaagtactttctctgatgagaacttttttcttcatctgtttgtggaacacgtggattttccaggcagttatatttataagaaggttggtttaagaatctacagagtcaaaatcaagttctgctaattttttattttcttgcattagcaattcttctaatatggcatgatttactatgtcatcatagaaagacagcattagagagtgtacatggcagggtaaaattaaacacatgctcacaatcaaattaatgtatttcatctgtcttcaactaataacaatctgtcatgttatctatctgagtaggggcataaacagtttattttgtgtttggagtaacttcctggaggtagttaatgtgacaagtcgtttgtttgaattgagtataaccagatcaacactcaagatgtttccctgataacctaaaaattactgtgaaatctgtacaagtgctatatttatattttgcttttacttcttttaagttagacagtgacattttttactagtttgcttttacttcttttaagttagacagtgacattttttacagtcatttcactgagaatactctgttcctgccattatgtatggactgaagagcaaaaatagtttataattttaatttttttttccatcgacagcaagtagacattaataatacaattaattgataatatattccctttttaaaatacatggaataacattctggtttgaatgaaaaagtcttgttcattatagaatatgttcttacagcatgttggaaaataaatacttgggaaactaggaacattgtgaagcctcaggccagtgtaatatagatactcttacaaagtgcttcagaattttgaaattgtacttaaaacttcataacatttagtctgatcagtagctctgatctgtgaaatgtacagagctgatacaaatctatcagtagctctgatacatttgatatgtctagtttaaaaatatttattacatttaatactgtatcttttaagactgttcgttctctcccttgttatcagtagtcatataggtggatgcagtggagatcctgagtaaggaatcttgaatgccagtaaacaaatagtacctaaaaagaaaagtaattgtatacttggctgtttgtattagtgtgtgtgtgttttagaagtcaaagtgtatatataattttaaccacatgtgaatcaaatttaataaattattaagggaattttgcttgttatgtttgggctaatcatggatcatttttaaactttatgtaatttca

SEQ ID NO: 110683 - DNA, 1041 bp, Homo sapiens
ttggtacgccggggcactttacaggaagcagtgggcaaggaagattttatagcatacataatactgaaacagaatcttaagcaatatgcaggaatatgccataaagagaagggtgagaaaggacagtctaagaagaaataaaagaacgaataaaactgctgaagttagcaaatagtctggaatataaggggacttggcaacattttgtgacaagtggaacagagtgcaaggcaggaacagttgagaaatagacaaaatcgtttaaggagtttggatttttcacaagagctatagaaagccactaaaggtttttgagccagaggtatagacacaagtcagcaaactatgacccatgacctgtttttctatgacctgctatctaagaatgcttgttacatcttttaatcacaggaaaaatgtaaacaaaacgtgtaatttatgacacctgaaaattatatgaatatcaaaatttaatgtccataaatagttttataggaatagagccacacttatctgtttctgtctttcctaggactgctttttcactaaaaaagcagaattcattagttacttcaaagaatatgtgagccagggtccgggcgcactgactcacacctgtaatcccagcactttggcaggccgaggtgggtggataatcagagctcaggagttcgagatcagccaaggccacatgacaaaacccctttcctacaaaaatatacagaaattatccgggtgcagtggcatgtgcctgtgttcccagctacttgagaggtgaggcgggaggatagcttgagactgggaggcaaaggctgcagtgagccgtgatcacgccattgtacttcagcctgggagacagcgtgagaccctgtttcaaaataataataataaaaaaataataataatatatgaggcagaaagcctaaaatatttactatctggccccttacagaaaatgtttgctaatatctggtctaaatatatcaattaaaatatagaaataatcatattggatagaaaagcaagacccgactactatat

SEQ ID NO: 110684 - DNA, 1011 bp, Homo sapiens
tttcaaagttaaaatgtatcatttagtaatataccccagtaaaagaaagaaggactgctagttttaaatcagatattcttagattgggattttggctatgtttttctcctcccaatttagaaaattttcagctgattttccagcacaaaccatttacttctcaagtatgggtttaaattctcgttaggagacagaggtattctacacaaatatgttggatcttttaaaaataaatacctgaatgtggggtttaaaaatctttaggagtgattattaaattctgttttagaattttctgtaatttgggaataaccaaaaaaaaaaaaaaagtacagagtgacagttccttcttaacaaaaacgaaacaaaatggtgggtaactgaaaaccaacaaaaaaactggttagtattgttaaaagatattaactgaatttgttcattttagtttctgtaaaaaaagtattctttggtttaaaaatggacatcagagttgattggtataattttgtttccttccatattccaacttcctccctaccactgccatttatatatccataagttataatttgatatgctaatatattgagacaatgaactgaattctttgcaatggagatgtttgaagcctagaatatttctaggtttgaaattaagctccttctttcttcaggattttttcctttttatgcagtatagtttactgatcattattctatatttttataaaaatttgtgaaaattgattaaattttgtgtttaattttagattgaggaatggattgttcctctttcaaaagtggttttctgttaggaatatctttacttgtaacttttccttaagtagatccattatttattttattttattttattttctgaaatggagtttcgctcttgttgcccaggctggagtgcaatggtgtgatctcggctcactgcaacctctgcctcccaagttcaagtgattctcctgcctcagcctcccaagtagctgggattataggcatg

SEQ ID NO: 110685 - DNA, 1439 bp, Homo sapiens
tttgcttaaattctgctgatggaggtgatataatttgatatctaatctgaatggtgaaagctcttgtgctattgccatgaatttttatctcaagtttattttgctatgcagacacgtgtgtaataaaaaaaaaagatgctgcataaaccatcatttgagtttgaatgtgcttctgtttttggttgaggtacaaatgttatttctggctgtgtccttcatacttagctcttcttacaacaaatggaaagtccttaattgtacctgagggaatagttaatccacagtggacatatggtggacaaaagctgagtctactaaatgaaataaaattgtaaatggtgaacgtgaatgcctacaaagtcttgcagccatgtaggattgactatttgagattaccctgttttatgtataacatagttcttttttggtgagtttgtgtggtatatgtattataaatttgattttaaaacgtgctctcaagttatgtataaagcatatttatcttttttactgttcattgagttcgtgatgtgactgatgtcaacaatagaggacgatgagctcacatttttggaaagttactgctcttttgattgggggcagttaattagcattaacccagaacagctcttgggctttatggatttgggtgttatgtggttgcactgctccagctaaaggttaagtattaatggaaaatggtcacagcccttttacttaaagaaaacatgttacttgtaagttttcttttgattttacttttacagttacattgaatgtcttcattcatttagccatccataaagcaaatattgttgcacatgcaatggataataagtctttttaggattacttgtgtggtatgtcacagatcattaactgcaagtaaccacctgacttgagggaagcctggaagcatcattatagtgaaataagcttttatttaggtatcactgtagcacattgatttacagaattgtcaccagtggctactttgaaaatatattgtcattatcatttaaggaatggtagagattaattgctgtagactataacaaagttatgttgattacagtggaaaatataagaaatattgtggtctgtatttaattactttttaaaggatttttaggtaattaattaggctaaatcgagtgattctttaggatgctttcaactttgtgtatgattgaatatatgtattaaaggcatgttttcagttttccctactttgaaatgcctttaaattaagaagcatagcaagggcgtagcaaactttatgtaactatttaacacagttaatgcgtattaactttcctttgtgagtacatggcattatgttcatcttacttccacaacaagactttaagtctacaaaagaaagacaacatctaatttagtacttttgtatcacagcgagggaaaaaatcaaggatttt

SEQ ID NO: 110686 - DNA, 3102 bp, Homo sapiens
gatggcctttagggccaagtggcctattgaatgccaccctgatgaataatgtcagagggagttccttgggaaatacatcatagttttatactagatcatgtttgaaataaaatttcatggattttatgttataattttaggttaaataaatatgaaagacttaggaagtttgcttcttaaatcctaacttgtggcttttacatatatgttagaaatctaagcttttgactttttatttacaattttttgtgtttagttaaaaaatcataatctgtactgaattacagttttaatttttcagtgtttcaggcaagggtataattgaaatgaagtggaaattcaggaatattaacttctaaaaaattaatttttaaaaagattaactttttaaaaagattaattttaagttcaatgttttataaccacatggcattttaatttgtcattttgttattttctatctttaatccgttatgcctttatactatctgatccatcagctagtttctctcctgactagctaacattctcagttggatagattataaacagaattaacaggggttacatagaagctgccctcttcctgatttatagcttcttagttagtggaggggtggtggttatcggtaacttgtattgggggtgggaattatcatgctccagtacagagtggatggatgaatgatttctactcttaaagatgttaaccagatccttttgcaaataaagactaataactcagatttttaaacaatcttcatgacagatgagggcatagagaagagtgcatcaacactaattaagaatgttgagtgtatattcttcttaacagtgattgatagttcttggagtactatctctgcccaggaagtgatgttttacattggaaagtttaaaggttacgttttaatgtaccctataagttgtgttccctgaactcagtgaaaatgtattagtaaaataagtaaacttcaagttgaaaattttacttatggtctcaatacaattatcagcaggcttttaaaagagacttttttcctcagtaatagggaggtataagaaatggttatatgtccagtttgaaaaccattggaatttatatgaaattacttgcctatactgtgactcttttgagtcttcaaaaattctttatctgtaaaatagacatgtgaaactattaaattggtaatatttaatttattttgaaggattcatatcaacttgtataaaatttatcacctataatattataccaaagtgaacaagtcattgttaccaatttgtttaagagagcttataatttatgaagcataaacagaaactttttcggggatttgaaaagttcattctctttatacattttaagctaaaacattctgcccttttaaccatttcttttagtactttgcttcttttttgttccagataatactaatcccaaagtatcagaaccaagtgtctttttcagatggagctaatatttctgtctctattgctgctgctgctgctgctgctttttctttttttaacttcttttcacatgtaaatttttcaaatagaagtgtgatcatttacttactggaacatactgagatcattctatatattgaaagagaaagtattttgttatatatacttaaagctgttccctcacatgatacttcacactccttattgtattttaaggacatgttgatagcatttcaagtttaattggctgagtagtatctccaaatcaaatgcataagcttgccttcagactgttgttgttactgacaactgttggggaataaaatagcaaatgagtgctgtttcataatatcaatcaaaaactgtttttcatctgacagttgttgtagtgatgttattttgttatttcatagttacttttttggatagcctgccccaaaccattttgacagtactgtaatttactttgtctaagcaatattatggtttttgtggttatgttttcattggttttggaggagttgtataagcattttgatataacaatttgtttatatgatatctctccatctttttgtcataatagagaagatttattaaatgctaataaaagcataattcatcttatttgttttcttttaggatgaatctttgattttaaattttagaagaaattattaaatgttagtatcaaataaagaacacagagctatagaaacatttctttgtgaaaaaggaatttggaaaattttattaatttaagcccctttaataatgtattttagtctgtatttgcagtggttgtggaaaaaagccaaaataatttaaaggaatactagactgggtatcagaaaactttagatatttttctaggtgctgtaattttatctagttacgtgagcttggacaattcccttaaccacttatggtcatcctcttgtataaaatgagaggatactagtgaataatacctaagcatctttgactcctaaaatttgatgacccaaactatgtttagttttaaggttgcttaattgaacatggttatttccagacagttttaagagcatttaattttaacttcatttgtagtttaaaccttgtcttcttagtttttgcagagatgactttttggctgtattttatcattcaattgttagattattaagatcctgtttgcatgtatggtatatgatggataggtacatatacatcatcataataaatatagctattaataataataaatctggatttattgaattctcactatttgccaggcaaaccctggacatatggccaactttaagggtattttgggggctctaaatcgcttttttaaaaaaaatttaaattgttcctgaagttagaatttaagtattttccactttatgtgacattgttttctgaaatttcacatgaatgtgtagttttgcagtgtaagtaaatcaattcaacaggtatggtctttctctctctctctcttttttttataacagaaatttattatcccaaggttcagaggtacaaaccaggttcagaaatatgaaactaaggcgcaggcagggctctttaagatataaagagggagggatctaggaaaaggacagatcaagaaagactttgtgg

SEQ ID NO: 110687 - DNA, 1780 bp, Homo sapiens
catactggcagttgattagagagtgcccacccagattgagggtgagtctgcctctcccagtccactgactcaaatgttaatctcctttggcaacaccctcactgacacatgcaggaacaatactttgcatccttcacgccaatcaagttgacacttaatatttaccatcacatagagtgtatttacacaaacctatatggtatggccaactacacacctaagctatatggcacagcctattgctcctaggctacaaacttgtatagcatgttcccatactgtaggcagttataacacaatggtgagtatttatctgtctaagcatagaaaaggtacagtaaaaatacggtataaaagctccattataatcttatgggaccaccatcatatatgtagcccgttgttgatagaaacattgttatgcaacacatgaatgtatgtgaaatattatatgattcgttgttttctaacttatttgaggtcagaaaaagagaaaatgatttcagattttaccatggaagatttaggtcaggtattatttcctgacaacaagagttgttaaatcaatacctacatacattaccaagagaattatcttttccaaaggtctttaaaaatgtagtacatttttttttctctgtaattgtttaggaagcagtgcttcctgaaagaccaaaccaagatttttgcattatgtggctttgcacactagatgagtatttaataagttcaagcttaatttaaaaccatgatgacacaggtgtgaatgtcatttctctgaggagttaaaaatacaggcattgtcatactatcatacactctggaaaatggtattacatatcataaaatgttatggcttgggtagaaattgtagtttgcttttttaaaagctttagttaaattttgctcatttgttttgcaaatgattctttttaattgagtgaatcagatgcttttcagttcattgaaaatccccctttgacaaatcatgttttgatgagcttacgttctgtttctgggttcagcttctcattttagttgtcatacaaagcgttggcttatattatggttaagtatgtgctttattggaggttttgcattaccttatgagaaattatagagtgtttgtgggagaggcgttatgatttgttttaatttttttcaggatataatctaactaccactagggataatgtgtagtggtacataattatatacattatgttatatgtatgctatcctgtgaggcatccatcattggtcactgtcaaagacaggctgttagagtagatgggctattggactggactggtggtggcatgcccatgttttaaaaacaaatatttgtacaagttatttgaatttatgcaagaaattaatacagtgttatgttggagatttaatagcataaaagacaagaggtttttttttttcttttttctttttttacttttggcatagctataacccctttgtatgtatttataatacactctttcagtatgagattatatattagtgtatgcagtcacacagaatgttatatatgtaagataaagagattatagataaatattttcctgaatattatttactacataatctgtcactggcccaatttcatgtgatcatgtaatgaaagatccttctgcagttaagcctattagggctttaaccctaagtctcctgaatatattttaatttctatttccaaattaatgttatattggtatggtataatagtatgtacttattttcttttgggagggatataattata

SEQ ID NO: 110688 - DNA, 1035 bp, Homo sapiens
aacgaatgttgcccaagatcaatagatggggtcaggactggaatccaacagcaacctgagttccagcgtagagctcttttcaacaaataatatatcacccatggcagttggaggtggggccagtagcttgaagattaatcttcttcagatatcagttctggggctttattcttaataagaaagtgagatactctttgttttagataattctgtgttgggcattatttcaaagcgtcttggaagacagacagatgttcaagtgaccaaaatgaaccagacgagtgattttgtatattatagaatatttaaagcgaaagggatcttagagaccatctaactcaaatatcgaattttagagataagaaacctgagacctggagaagctaggtaacttggggaccaatatggtttaataaacgagaataataatcctggaaggtcataacagaagtatgctagggctggcttgctctagcttcagagagttaattgttaaatttttagcagtttttgtgagccagttattaaaaacttttacaatgaaaaattatgtataaagtcacacattatattaaaacaaaggtattatatgcctaatctctatcactaattattttactatgtatttctgttatctgtgttctcaaggttgtttacatctgctgtatctatatggtggaaatgttttataatggtgacctccccaactctgttcagtggtatcacattgatagcttaaaaatgaccgcaggctagcatttacaccatgaaaattggcaaagattacggcaaactgtcacccctgctgggccctgaaccccaagccaattgattaatatttaccagtgtctcactagttatgactactgtgttctatacttgtttgtgtgtttagttttgctgcaagactgtgagttccttatggtttggaacttaaatccgtaggaatccagcacaatgcttggagtttagttgacagacaaatgtttttaattatttagtctttggttcaaatactggctccatcacttacct

SEQ ID NO: 110689 - DNA, 1602 bp, Homo sapiens
tttaaggtactttttttcttgggagaaagtgaatgttatagttcttagaacttgtataaagtttctgtcttgaaggtacatatcgacttctttctcttttggtggtgcattttatcgtttacacttaatgattgctatgactcttataaggatgtactgtgtttttattaaacaataatttagtacagtatttctgagaaattcatggatctttctatgaaattgtctgacaaaactgggaattctgagatgatgaaatgaattgtcaaaaatagatgataggtcatggtggcaggcacctgtagtcccggctacttgagagactgatatgggaggatcacgtgagtccaggagtttggggctggagtgagctatgatcatgccactttactccagcctgggcgaaagagtgagactcagtttataaagaagaaaaaaaaaggatgataatataataacttttttctgctttccagagattccaaataaatgctatgttaagtacataaagtacattgaccagtggtctattttgttaaactatttttaaattctatatccaggctagagaagctgtgactcattatttactactataaattggagaaaatgttacttttcaaaaccagtgctttcaaaaacatcctaatagcattttaataagctcaatatctttatataatcatataattattcttcaaagtagatctgtattgcttctggagttatagatgctttatattacctatctcatgaatactttggattttgatatactacaggacagaaatcttcagagatgttgagacaagctttttcaggatatcagtttaatgtgttatttagggttttgttttaggttctctaacttctgtattgtgtatagaaagaattatacatgtctgggtcattaaactagtcaatctgtttctttaaagcatttcttaacatctgcgtagaagcttatatgtaggctgggagttaacttggatccaaataaaactgattattttaccctcttcagtccctttgcccccagcaacattaaatgttagcaatagcctgttgaaagtgttgatgaaaactaaattgaattgacaccccaaaaagaattagtgaggtattttgacaagaactagttctaagaattgaaatatgtcccagttaaattcccagattttaaattaacttaaaaatttctaggagtctttagaaagatgttataggggatttttcatagtggttaggagcaaacacacagtacatagtgtttagtgccctgtaacctgtggctaacagaggctaataacaaacctcagagaaggactggatgtttcatttttgtagctctttctgtcctggaatctaagtggtttgcaaacactgacccactgagcataaactcaatgaagtgtagtcacttgtgaggtagaacataactactattgtgtgccagtggccccacacagatgagcctactttttaagtaccaatgaaaggatttggtgcctacatgacagctatggagagagtgcatctcaaaactggactctccaagaccttctgctctcttttactgtaagttttttagttggatatttg

SEQ ID NO: 110690 - DNA, 1050 bp, Homo sapiens
tttttgtagtttgctattattccatgagttttagaagccatagagtttagaacctacgacagaattcatatgtatgattggatggttgagtatataaagcttcagtttttatttttaaagtatatttcttgctccatggacatgtgcttcattctgttctctaagaaaaacatttttctaaggcttaagtttacaaattaaagcttactttattttcttttgttttgaaggtgattgtaaatatggttccatggaaatggagtaaaaagataaaactagattccccactataatttcttttgacgttgttttcgcaattccaaatatcatgtgagcctgcacataaaggcaaattgggctcagagtttcttattgtgacttagtattctgtgatactgtgtcacttgttgtattgttacttaatttttttggtattcttatttttatattcattttttatattctaggaaacttgaatgttacccttcaaatttgggatataggagggcagacaataggaggcaaaatgttggataaatatatctatggagcacaggtatgatatgaattctgattattccagtattgaaagtataccacttacaagcacacatgcaaatctactcccaaatgcacacacacacacattctttctaactttttatctgatacgtagagagaataattttatatttgtgctagttctttggtttcatgctctcctaattatgtttggagtgatttgggtgagggaacaggaaaactctgaacagctttcgtatgttatttacattactaggtgttattgttagcagttcaataaatgcagtgataaatgatattttgatatgtattagctggttttgttatagtgactgctttcaaataaactgaatgaaaaacacagggatgaaaatttaacttcattttaagttacaaggactgaaagtatatctatatgtctatgtttttgtgcaatgaatattgatagcttttcagatttaatagacatgtctgtattttctatcagataactaaatatgacagtgt

SEQ ID NO: 110691 - DNA, 2148 bp, Homo sapiens
tcctgctgtgttcttgctagttgtttgaacttgggacagtctgtatattggtgggacccgctgttgatgtctttgttttctagatgaaagaactagggcccagagaaggaagtggatttgagcaccatcagcacctagagtgtggtagagctggaaccagagcacaggcttcaaacttctcttccagtgtcctgtgtttgtgtgtgaggttgacagcaaataaccagttagttcaagctcttcgcgaggtagctccttttcatgtataaatgttactgggtttttctcttcttagctgtcaagttcaaaactcttctgttttttaaggaactcccaagttatttgaagcagctgcttttaaacctcaccattgccttgactttgcttaatgcagatcaaagacacagctctccccttctatcaagcgcaagagagaagtcagccctcctggggcccgaacaagaggccagcaaagggtggaggaagcccctgtgaaaaaagcgaagcgataatcctgaccactgctgccctaggcttatggaggaacacggtggagaggaaagagacatgccttggtggccataggcttctctttaaccaggaaaaagatatgcatgtgctgtaagtccctaggtgcaagctttttcttgttatgttttaaacagctttataaactattgttcatagaagatattatgtacatttatttcagataaaggacaataagtttactttgtatctgaactcaaaacaaagtagttgtatattttaacattcaaaattgggatttcccaatgtgacacatcatgaatgcaaacccctccagcccatcagacgccaggctgcctactggtaatctgtgtatagtatataaacatgtaaaaataggttgtattttactctatgtatgatgctaatcaatgaacactttatttattttacagagaaaacttatctgtgaactttactatatatctgtttattttactttattttttttttaaataaaaagggttttaaatgctatgcagtcattagtagaaaattttttaggactctgcctgctctgtaactatcttaatatgatctggcagaaactcgcatgtatccaagtaaagtagtttagctaaagaaaggttcttcattgcttttctgttcacagttgtggctctgttttttaagaatgtaacttgtttttagattatacttgcatctgtgactttactaccagccacgttgacacaaaacaggttctggttcaggtaaagttgcgtcagtcacctgcagcagaaatccctcttcattcctcttctctgtgttcattcctcttctgtgctgttctgaagcttctaccaatactctttccatattgtctttttcagtgaagagaaatgcattcaagattaggtccctcctgtctatccagtttcaggattttatgttgttttatacacagttatttcagtatagaaactggctttattgccaagtgtttttttaaacatgttttaactctcatatgagcaaactgtccaacttcagtttttcataagattaaacttcttacgatcaaatttgtctcttgcaatgatgtgatgagttgccaaataattgagattattttaaaatgttttgttcatattcttgttttataattaaaatttacattcagtgtgtatgggtttttttttttattttgactcttaatgtaaggtggatatttctgtcattttacatggtttcttactgagattttatatataaattataaaatgtttaccaaaatttgagtggtaagaattttatttgtgtgttttaaaatgtgtctgcatgaaaaccatttcttctctctaaataattggtcttagctgtatcattccatgctcacattcaaatttgagtcagtgatggcctttctcagtagaactgaactcggtagaactgaacttggaagaactgaactttagatccagaaaggccattagagatgaggaacatgagagtttctcatttttatgtatatggatgatttttaaccaaaactcaaaaatctaaagtgatttgtcttaaaagtaagaaatgcaaatcaaagccacagtgatgtaccatctcacaccagttagaatggcttttattaaaaagtcaaaa

SEQ ID NO: 110692 - DNA, 1234 bp, Homo sapiens
tgccgcagtggactgccacacaggcttgtccttgacacctgtgagccttatctgccttctcccatccaccaagaccaaaggcaaggcagtgtggtaaagcatttaacagcccagaatcatttctgttttagctagagcattggagaggtgatgaggtgataaagcttcctctttcaggcacggcccctgccagcttacacctttcactgcagccttactggtcttactgcttcccagaggtggtcctgagccttcctttcttgcctttgcttgagccagtgaggagtgtcctcaccaccagcacccctagtaagtcagatcctttccgtcccgcttcagcccattttcatctcttcttgctgcacttctggtcagtactgggcacttgagatgccacatagcattggtttggtatattccttttatttacccctctgagctctaggtttctttcttgagataggaatttgtcatactttctatacattatcatattcaaaaataaaagactcttcactgtacacaaaaactgttttgacctcttaccacattttcatcttcacagcatacttgtatgtatgtgctgttttccgcacattctagaaacgaaagcaaactatagtgccaggcagtttcacatacatgctctcatttaaccctcagtgagtgaattgtaatagttactcttattttatatgtgagggaaagaatctcaggaaggtttccatgcatactactcaaaattgaacatgcagtcaaatcacttgaggctgttggtaaaatgcagatcctgggtctgtaagtctaggctggggcctgagagttggcatttccaacaagctcctcagtgaccaatgcccctcctcacagaccacattctgggtggactagaagggcctggataaactacgaagctcacatggctggggagaagcagcctgactcagagcttctgttggctgccacttggcccccagcacaatactgcgcacggcacctttactgaagaggtgttcattgagtggctggtggctttccatggaaacagtttgaaatggattatcaacaaacacattttcagtcattgtcaacacatgtcaaaaccacatcatctgcaacaatttttgactcagtttatttacttttgctgtcaaacaagaaacggaagacgtgtcttcatatcactaagagtcccatttctccatctcctgcaattttggttttccaactcttt

SEQ ID NO: 110693 - DNA, 1628 bp, Homo sapiens
ataaatcttatttgatttatatggttctgtaatcacctggattatcaaagctcttccttcatgcactttataatataaacttttgatttacaaatgagttgttttctctctagtttagattccttggcattggttgatcagtcccagggctctggtgtcttcataattttacaaattgtctgagttgggtgggctctcagtggtcatgtagtaccaatagccagtcagtgcctgagtcactgcacctgcagctcctctgaaagggtcttcctgcttttgcatggacctcagtggcagggaaagccacatcctccttagcattctctgacttgtgttcagtagaagccggcctccctgtggcttctactcttgattctagttcgactttcagaaccttctgtctaattttgccttacatatttgagggcagcttccaggtcttctctgcttgcttattgagccccttcatcatccctgtttgtgctcatcagttacctttatcctcttttagaagcaaatgtgcagctgggcgcagtggctcatgcctgtaatcccagctactcaggaggctgaggcaggaagattgcttgaggctgggagttcgagaccagcctaagcaacatagcaagaccctcttaaaagaaaaaattaaattaaattaataaaatataaaagaggccacgcacagtggctcacgcctgtaatcccagcactttgggagtccaaggctggtggctcacttaaggccgggtgttcaagaccagccttgccaatatggtgaaacctcatctctactaaaagtacaaaaagtagccgagcattgtggcagactcctgtaatcctagctacttgggcagctgaggcaggagaattgcttgaacccgggaagtggaggttgcagtgagaagagattgtaccactgcactccagcctgggtgacagagcgaggctctttctcaaaagaaagaaagaaagaaagatagatagatagaggctctttctcaaaagaaagaaagaaagaaagaaagatagatagatagatagatagatagatagacagacagacagacagacagacagatagatagaagcaaactctgtataccaagtgtggtctaatgaatccagaagaggactgttctaccttattttctggatattgttcttcagtgtgcatcctcattactgagcctcaaattgaaaaatacaccagctaaacaagttcctttttcagagtttttactggaatcagaattccttatctgattcttgtgcagttgactacttgggccttaacacttagccttgtgaattgtactttcgttaatcttggccctttattctaccctgatgagctcttttgtaatctttattttgtcggccagtatattttctatttttcgcagatacatcttttttctaaatcacaataaaatatcatgcacagtaagaacaaagatagtgtcacacaagcagaggtagttgtagatgacattaagatcgacttatcagcagtggtcaggaaaaccaaccatttttctgattttagttcctattgttctgacttgcccacaaggagcctcatacttcctacagagttccagggactggagtattcagtgctacca

SEQ ID NO: 110694 - DNA, 1112 bp, Homo sapiens
gatggtgaagaaaaaatagtaacaagtgtgcgtcggagaggaagaaaacccaaacgttctctcactgtatcagatgatgctggtatgtttctagcaaattcttaataagtcttattgtttcaaaaccacctttttaaagagtttttctttgaatgaggaaaaatccaatgggtacagctaatattaatattatataaatatgtgtgaaataggtctaatcccgtgtcagaaatggtacatcccagatgcttttctgagtacatgtcaattttttatgaacgctggctgtgaactgcatatgtaaactatccaaaatgtgtttgagattaagttaaacagttgtgaattgcaagtgctgaaacaaaaaggaagtggaaaaccatttctctgcctccaagtccctaatatcctaagttctaaactccatgactctctctcttggaagtatctttgggaattgtaaaatccaggtgttacccttctatttgaacagaatcctcagagccagaaagaaaacgccagaaatcagtttctgatccagtggaggacaagaaagagcaggagtctgatgaggaagaggaagaagaggaagaggacgagccttcaggagccaccacaagatccaccaccagatcagaggctcagaggtaatgggggcagcacagagctgccagagaccttcaccagcttctccatctgaaaattgctctgggttttctgggattctctttgaactgaatcattcatgctgcagtggaagttcttccctttcatttttattgttagcagtgggcacatagttcttggagaacacattttctgtcctaaaccattttgggggattgcctcaaagtctttaccaggttttaaatgcctatttggtggaacccattcaattccttacaaatatattttttgagcatctgccatccttcagatgtcgtattgagcaccattcatgaatatggacatacataaaacatcatccctgctctcagcatacttaattcaacccagaaagcaggaggaaccaggcccacgcaccgtcatcacatgcatctcaccagtgctatgcaataggttgatcataggaaagtgcccaaatttgacca

SEQ ID NO: 110695 - DNA, 2096 bp, Homo sapiens
ttggtcacaactaacttgggccaaatcccaaattaaatggacatacatacttattacagaagtaaaaggttacactttgattacttcattgtctcaaaatcctcatggctccattaatttatgacagttagtgatatttatcaggttgaagaagcaatggtgagatcagtaaataaaacactaagccctacatcacatatttttaaagtgacaaagctaggatttgaggtctcttagacaggaactctaaatctgatttttgagaaaactttatataataaaggataaaattttttttcttattgctgttgttgttttttatttcccccttaggaagatcagccaataattattaaaaggaaaagaggaagacctcgcaaataccctgtagaaacaacgttaaaaatgagtaggtacttggtgtgttttcagttcacacacaagaaattttcgaaccgattttctaagtgaattttttttttttagaagacgactccaaaacagatactggcattgtcactgtaagtaattgcaaaacatgacaatttcaaatacttgctcttaacctgaaaaacggtataatgcaatatctagtattttgaactttattttttttacttgaaaagctttaaaagactgagtaaccattcatatattttgattactagtatctttgtgtaaacagagttacattagttgttcttcattctgattccattctaattcaggagtttgattatttaaaaattatctagggatttaacttcttgtggccacccttggttaaaatatacaaattagctattttataagattttgagatagtggcttctttatagagacttgtgagttgtcttaccatcttactactttctttggaattctttttgacctaaaatattcactgagttcagtgcaggaaactccttagtgatattttatgtttgaacgttctttatctttgaccctgacgtatacccaccaaaatcattgtatcaggattccatcgcatgcatttcaatggattattataaggaggacattacaagaagagcattgtaaggaggacagacgtgtgttcactgacctaacaaaacaacatgggattcaagcctcagctttgtcacttatcccgagacctgtgacttagggccaatcatgggaccctctggtgactcagtttccttgaatgtgaagtggtatgatgcctgcagtacttatctcatagaattattataagacaaaaccagagaagcacatgtgaatgcatttagcaacatgtaaaatggtttgccttgggaaacattaaccacagtggccatgctgcattgcctcacttctcatcctgtagcatcacaaaagggaagttacttattggaaagtctgtatttagaagctcaggcatccatgtttgctaggtatacttaatcaattacagaaaataggtctcaaatacgcctatgtaaataaagatcctataccacctttacatcattgattgcatttctatgtgatgattataaactgctgatttaaaatttttttttgtttgtttatttaaacataggtagaacaatctccatctagcagcaaactgaaagtaatgcaaacaggtatgtacctaccgcattcctctgtgtgttatctgagggaggggcaggagaggctggctgttggagaaggtttggaacttccattctgcctctcattgaagtgggtggcccccttggtaaaaataattgtccttgtatctgggagagactgtatctattggcttacagagcccaggactcaagaattgaaattgttttgactatttttctcctcattccaaggagaagaatatattccaaaatgttgataatgattagctctggagggtggaataatgggagcattccatattatttgtcaatattgcttgcattttccagatattttttgcaatgtatatgtatgcattttgtggtctaaaattttttacataaaacaagaggtgccattagtgagctttgaagtgttgatatcaacaacaaagattaatgtgacagctattttgtatcaaataaatagtatggtcagactgagaaagtaca

SEQ ID NO: 110696 - DNA, 1053 bp, Homo sapiens
ctagcagcaataatagttacacttcaaaaacattttccaaaaactatccttaaaaagagctaggaagtttttttgaaatagaaaggcaaacttgtgtggggaggatgaatggacgaaggcttcagtttgaagaaggttctagtctttttcaacttctctataggaagagaactccagagatttggaagaattacctaaaaccagttctgagacaaatagcactacctcaagggtcatggaagaaaaaggtgagtaaaatatctgcttgggtaaattgactgagccttcaaagcagccagcgtgtctctcaaccgaaacgtctattttgctcatttacttttcctgtgtaataaagtgcctcatgcttaagattaatagggctagggaatcatttttaatttggatcctgctatactcaaagtgtgctgtttactagtcacccaaactcaggcttgttaattttgatggtagaaacatgaaaatggagtgtgtggttatgtgtggctgcagctgtgtaggtcacctgggtaaaggtggggaaggctgaccatggtcactagcattgaacaaagttcttccttttctacagatgaatatagcagcagtgaaactactggtgaaaagccagagcagaacgatgatgacaccataaaatctcaggaggtgagatgtgcttttcgtatttgtttgttcacaattatttaagcactaaccaaattaaattcattaaatactgttatcttgagtttttcttaagtactttgaagaagctgcggtttttttagtgcaatggaacaccatttcatacagtgcattttatcagtgtcattttgattaatttttttctcttcatctttgtttcttcaaaacatttgtatgagacccacttatgtcatagccagataggatcagcttagtgctctacgtcagcggcaatgtcaggttcctggcctggcaatgctgagctgccaggccaggcacatggcagcaaacaggaggctgtctgagccatggagtccagctaggatgaaataggaacagcagcagggtgtg

SEQ ID NO: 110697 - DNA, 1119 bp, Homo sapiens
agtgatgcttcttaatactgtgttgctacacaaactggggggaagggccttgaagtcttctgtgtaaagtccagtgttgttaccccagacatgttactgaccttcttgaaccccattccctcacatctacaagtggaaaaaagagaatttaactgacagagttgtgtggaggatcccatcaaaaatcatttgtgactatctaccacaatgccctgtatataactggtactcaataaagttactaactcagttttctcccagccccctaacacatacctaagtaagtattggaatataaaaatatttaagatttttttttcttttttgtatttattactcagagatatccagtggtagaaaagacaacgcagaagccataagcggtcacagtgttgaagcagatcctaaagaggtgcattttaataaactcaagtgtttgatattttatacataatattttcactgtacacaaagaagggctttagaaaggctttatttctttgtataaattaaatattaaatgggtatactgagagttccacatgtcacttttacctgtatatgccctttcaatgtttaggcaatttggcagttcccaggactgtttggaagtgcccacgttgtacagtcagaatggtttttcatgcacctttcatcaaccataagaagtccatttttaataagccactaagacagtagaaaaatactaattgtgatgtgccatcagttgtaagatatatatagcttgacttcagaaatggtgaaatgataaataatttttttaaatgcgttttagaattattgaaatatagtatgtagctagaaacagcatgtgttgtatgaatttgcattcaaacccagaaaagagactgaagtttacaaaattagtctaatccaaatctaaatatcaagtgttctagatttttttttctttttttttttttttttgaaacagtctccccctgttgcacgggctggagtgcagtggtgtgaacgcttctcactgcaagctccgcctccggggttcacgccattctcctgcctcagcctcacaagcagctgggactacaggcacccgccaccacgcccagctaatttttttctgtatttttagtagag

SEQ ID NO: 110698 - DNA, 1335 bp, Homo sapiens
ttaatggcctcggggtttctactgttacagggctgcaacgaactttcataatgcatatcactacatgtgttttaccaagtattttcataaaattggattgggggagggagggtcaaagaatatacaggttaagtatccctaatccaaaaggcttggggtcagaagtatttcgaatttcagatttcttagggtttgggaatatgtgcattatacctcattgagcatcccgtatctaaaaattcaaagtcaaacttccagtgagcctttcctttgagagtcatgttggtactcagagaatttcagattttggagcatttcagatttctcatttttgaatttgggatgctcaacctgtatacgttttgaatttttataagtacttgttactcatttgaggctaaatattgaataatgagtaggtatgcattaagtgtacaaggcaaagagaagggcagtagatgtggaatgattcagattaagtgaatagtgcatataaatcctcacccatgactatctggggaggtttggggagtgggagcagttgaggaccttcttacacaaaaccatctgaaagggtctcagaagactcgtaagaagtgtcagccagtcctggaagaccacaccaagacttggtaagtcatttatactgacatgttaaaaccctgaagatgactaatctattcaaaacttggaaagatacattaattaaaatgtgcatgggtgttttatactacaaataattaacgtctcatttgttaattgtcaagaagctaacatttttggattctgaagtccgttgttcccacagttatatttcagataactttactgtgtttaggtacagttcagtaagagatctacttacgtaaaaggaagttgtttaaaagaaaaatgtgtgttctgtcattgttgagtagaaacagtagactttgtacttcatgtttccaaagcatataaacagaccattgctgttggaggggataggatctaacttttcatttgacgctattattttaaatgaaccagtgttatactgcagcttaacagctacattaaggtcttttactttttttctaagcttcagatcaccaacatagttaaatcaccatagtgatgtaatataccactgccgttattataaaaaatgcaggcaacattaatttatgttgtctttttctggtagtatattctggtagtacaacatggattgattgtgggaaataactggtcagatttttataatttatgaaagcagctaagccacttggtgacataggataggttccctatcctaaaaatcttcaaatttgtttctctgcatttcagaaacaatat

SEQ ID NO: 110699 - DNA, 1047 bp, Homo sapiens
ggcttgcaaggaggacactggaatagaattttgaaagtagagtggaaatttcccagaaaagaaagaaaagagccttccaagcaaagagaatgttgtgttctagactcagagacaggagggcacgtggtgtgtctcaggcgctgcagtggttcacggtgagctgtgatgagacttgagcctggaagggagtgggagcccatcaggaagagtcttgtgtggtgtgctgagttggggtttttacctttaaagcaatagaatacccattgatggatgaaatacgagattaaattgattttttacttggctttgtttttaaaggttgatgtatttatttttaagttttgtgtactcttgaaaataggcttttatattgtttcaggatgctgggtttttttttgtttaattcacttgaggttagtcttcttgtaaaaaccctggttaacttatttttatggtgctttggattttttaggcttatgtgccttcagaggaagagaaaaatggtgaaattctggcaccaccagaaagtctgtgtgggggaaagccaagtggaataggtgagctctttagaatggttgttcacattgtttttgtttttgccttgcatgtggttttacctttctaaaaatcaatagctgatgcatagtaacatacaggctctattaacttgcctctcactttttaaaatagattagggagaattctttactattttatttttaacatacacttttcctcatgaaatgtcaatcaacattatgtagggtaattgtttaaatctgattacccccaaataataatgcaaaacgaaagttgttttggagcaaactcttgctctatcccagaaatgtttctccatacccctgcctgtccccagatgctattgcagcttacttccaaaaggctagtctgaggataagggcccactttacaccatttgctcttgtctcttgctcaggcttttccccagtggctgcacagatactgctctcagcttgtataacctcatctcagtctctctgtgcaacattcttcactgtggactac

SEQ ID NO: 110700 - DNA, 5882 bp, Homo sapiens
acaatttcctgatgttttaatggcatatttttaagtatttaactttattttgtgataaatctctatgagaaataatctcataaaattgttcatattgtttagaattagtttttttattgtaaaatatggttgttgcaaactcctgttagttctttgaagaatttagcttcttaaaatcaagttaataatacttattttttaaaatcaggtgagtttttgacacctacacaggctgtttgtaagaattaagtgagatgttacatatgtgacagcactcaacatattaaatccacccaaatgttatgttttaatctaaaaattgattttggtatttctcatattttaacctttgttttctttcagcattgtgaaaaggaaaaaatttcttcttcaaaggagctgaagcatgttcatgcaaaaagtgaaccaagtaaacctgcccggagactttcagagtctttgcatgtagttgacgaaaacaaaaatgaatccaaattagaaagagaacataaaagacggacatctacccctgttatcatggagggggtacaggaagagactgacacaagagatgtaaaaaggcaagtagaacgctcagaaatttgcaccgaagagccccagaaacagaaaagcacacttaaaaacgaaaagcatctaaagaaagatgattctgaaacaccacatttgaaaagcctacttaagaaagaggtgaaatcctccaaggagaagcctgaaagagagaaaactccatcggaagacaaattgtctgtgaaacataaatataaaggtgattgtatgcataaaacaggtgatgagactgagcttcactcttctgagaaaggtttaaaagtagaggaaaatattcaaaagcaaagtcaacaaacaaagctttcttcagatgataaaaccgaacgaaaaagtaaacataggaatgaaaggaaattatcagtattaggcaaagatggaaagccagtttctgaatatattataaaaacagatgagaatgttcgtaaagaaaacaacaaaaaagagagacgcttgtcagctgaaaaaactaaggcagagcacaaatcaagaaggtcaagtgattctaaaattcagaaagattctctgggttccaagcaacatggtatcacattacagagaagaagtgaaagttattcggaagataagtgtgatatggactccactaacatggatagtaatttgaaaccagaagaggttgttcacaaggagaaacgacgaacaaagagcttgttagaagagaaacttgtgttgaagtctaaatcaaaaactcaaggcaaacaggtaaaagttgtagaaacagaattacaagaaggtgccacaaaacaggcaaccactccaaaaccagacaaggagaagaacacagaagaaaatgactcagaaaaacagcgtaagtctaaagttgaagacaaaccttttgaagaaactggtgttgaacctgtattagagactgcttcttcttcagcacatagtacacagaaggattctagtcatagagccaagttaccattagcaaaggagaaatataagagtgataaagactccacttccaccaggcttgagagaaagttgtcagatggccacaaaagcagaagcttaaagcatagtagtaaagacataaaaaagaaggacgaaaataaatcagatgacaaggatggtaaagaagttgacagtagtcatgaaaaggccagaggtaatagttcactcatggaaaagaaattaagtagaaggttgtgcgaaaatcggagaggaagcttgtcacaagaaatggccaaaggagaagaaaaattagcagcaaacactttgagcactcccagcggttcctcccttcagagaccaaaaaagagtggtgatatgacattgatccctgaacaagagccaatggaaattgattctgagccaggtgttgaaaatgtgtttgaagtatctaaaacccaagacaaccgcaataataattctcagcaagacattgactctgaaaatatgaaacaaaaaacttctgccactgttcaaaaggatgaattgagaacttgcacagcagattcaaaagcaacagctccagcttataagccaggccgtggaacaggagttaatagtaattctgaaaagcatgccgatcatagaagcaccttgaccaagaaaatgcatatacaaagtgctgtgtccaaaatgaaccctggggagaaagaacccattcatagaggaactactgaagtgaatatagattctgaaactgttcatagaatgttactgagtgccccatcagaaaatgatagggtacagaagaatttgaaaaacacagctgctgaagaacatgttgctcaaggagatgccactcttgaacattccacaaatttagactcctcaccatccttaagttcagtgactgttgtgcctctgagggaatcgtatgatccagatgtaattcctctgtttgacaaaagaactgttttggaaggtagcacagccagcacctcccctgcggatcactctgctctccctaaccaaagtctgactgttagggaatcagaagtccttaagacaagtgacagcaaagaaggtggtgaaggtttcacagtagatacaccagcaaaagcaagcatcactagcaaaagacacattccagaagctcaccaggctactttattggatggtaaacaaggaaaggtaatcatgcctcttggaagtaagttaacgggcgtgattgtggaaaatgagaatattaccaaagaaggtggcttagtggacatggccaagaaagaaaatgacttaaatgcagagcccaatttaaagcagacaattaaagcaacagtagagaatggcaagaaggatggcattgctgttgatcatgttgtaggcctgaatacagaaaaatatgctgaaactgtcaaacttaagcataaaagaagcccaggtaaagtaaaagacatatcaattgatgttgaaagaaggaatgaaaacagtgaggtagacaccagtgctggaagtggctctgcaccctctgttttacaccaaaggaacggacaaactgaggatgtggcaactgggcctaggagagcagaaaagacttctgttgccactagtactgaagggaaggacaaagatgtcaccttaagtccagtgaaggctgggcctgccacaaccacttcttcagaaacaagacaaagtgaggtggctttgccttgcaccagcattgaggcagatgaaggcctcataataggaacacattccagaaataatcctcttcatgttggtgcagaagccagtgaatgcactgtttttgctgcagctgaagaaggtggggctgttgtcacagagggatttgctgaaagtgaaaccttcctcacaagcactaaggaaggggaaagtggggagtgtgctgtggctgaatctgaggacagagcagcagacctactggctgtgcatgcagttaaaatcgaagccaatgtaaatagcgttgtgacagaggaaaaggatgatgctgtaaccagtgcaggctctgaagaaaaatgtgatggttctttaagtagagactcagaaatagttgaaggaactattacttttattagtgaagttgaaagtgatggagcagttacaagtgctggaacagagataagagcaggatctataagcagtgaagaggtggatggctcccagggaaatatgatgagaatgggtcccaaaaaagaaacagagggcactgtgacatgtacaggagcagaaggcagaagtgataactttgtgatctgctcagtaactggagcagggccccgggaggaacgcatggttacaggtgcaggtgttgtcctgggagataatgatgcaccaccaggaacaagtgccagccaagaaggagatggttctgtgaatgatggtacagaaggtgagagtgcagtcaccagcacggggataacagaagatggagaggggccagcaagttgcacaggttcagaagatagcagcgaaggctttgctataagttctgaatcggaagaaaatggagagagtgcaatggacagcacagtggccaaagaaggcactaatgtaccattagttgctgctggtccttgtgatgatgaaggcattgtgactagcacaggcgcaaaagaggaagacgaggaaggggaggatgttgtgactagtactggaagaggaaatgaaattgggcatgcttcaacttgtacagggttaggagaagaaagtgaaggggtcttgatttgtgaaagtgcagaaggggacagtcagattggtactgtggtagagcatgtggaagctgaggctggagctgccatcatgaatgcaaatgaaaataatgttgacagcatgagtggcacagagaaaggaagtaaagacacagatatctgctccagtgcaaaagggattgtagaaagcagtgtgaccagtgcagtctcaggaaaggatgaagtgacaccagttccaggaggttgtgagggtcctatgactagtgctgcatctgatcaaagtgacagtcagctcgaaaaagttgaagataccactatttccactggcctggtcgggggtagttacgatgttcttgtatctggtgaagtcccagaatgtgaagttgctcacacatcaccaagtgaaaaagaagatgaggacatcatcacctctgtagaaaatgaagagtgtgatggtctcatggcaactacagccagtggtgatattaccaaccagaatagcttagcagggggtaaaaatcaaggcaaagttttgattatttccaccagtaccacaaatgattacacccctcaggtaagcgcaattacagatgtggaaggaggtctctcagatgctctgagaactgaagaaaatatggaaggtaccagagtaaccacagaagaatttgaggcccccatgcccagtgcagtctcaggagatgacagccaactcactgccagcagaagtgaagagaaagatgagtgtgccatgatttccacaagcataggggaagaattcgaattgcctatctccagtgcaacaaccatcaagtgtgctgaaagtcttcagccggttgctgcagcagtggaagaaagggctacaggtccagtcttgataagcaccgccgactttgaggggcctatgcccagtgcgcccccagaagctgaaagtcctcttgcctcaaccagcaaggaggagaaggatgaatgtgctctcatttccactagcatagcagaagaatgtgaggcttctgtttccggtgtagttgttgaaagtgaaaatgagcgagctggcacagtcatggaagaaaaagacgggagtggcatcatctctacgagctcggtggaagactgtgagggcccagtgtccagtgctgtccctcaagaggaaggcgacccctcagtcacaccagcggaagagatgggtgacaccgccatgatttccacaagcacctctgaagggtgtgaagcagtcatgattggtgctgtcctccaggatgaagatcggctcaccatcacaagagtagaagacttgagcgatgctgccatcatctccaccagcacagcagaatgtatgccaatttccgccagcattgacagacatgaagagaatcagctgactgcagacaacccagaagggaacggtgacctgtcagccacagaagtgagcaagcacaaggtccccatgcccagcctaattgctgagaataactgtcggtgtcctgggccagtcaggggaggcaaagaaccgggtcccgtgttggcagtgagcaccgaggaggggcacaacgggccatcagtccacaagccctctgcagggcaaggccatccaagtgctgtttgtgcggaaaaagaagagaagcatggcaaggagtgccccgaaataggaccatttgc

SEQ ID NO: 110701 - DNA, 3669 bp, Homo sapiens
ctaatgcttataaaaagcttacattttttctgttaaaaaaagttgtagagaccataggtttattttatacccagaactcagctttttaatgagcatattcctatatgccatgagcagagtaggggtgagataagcatcacctctatactggaccctaggcagtgtactgtgtctagttctaagggtgttttgttttgtctgtttcagtatttccactagtgacacagtggtagaaaagtttacagacttgtatagtatggtatatctaaatgctactgtagcatgaaacttagtttccattgtctatatccaagtaaatggattgggacaatttaaggttggatggatggatagatagatgacagattgtagagtgttattttaaagtaattaatgcaaataatatattattttttcacctttccataaattatcttgtgtttcagatcaggaatgttggagtctggtattgaccgaattatttctcaggttgtggacccaaagatcaaccacacattcagacctcaggtagagaaagctgtgcatgagtttttggccacgctaaatcacaaagaggaaggaagtggcaacacagctcccgatgatgagaaaccagacacttcccttattacacaaggtgctttgcttttactcttggtcagttccattgtttttcttcttgaactgaatatcaagttagggatacttggctctttaacacattttttaatttggctattccaatgaaattgtactttaaatatcacctaaattcctcaattgccataacatttcgttttctagattaataaaaataataagcattgtagtaatgtgatgtgagtgtgagtatgataatagaaggaataactaaaataattagagaatatagtctttttctaggaagtagacaactcctcagatttgcatggtgccctcgctaagataatatattagagaggtagataattcagaatatggtatatactagtactggtacctgaaagtctaaaagaatatacagatggtctgcacagcatatgcatcatataaagatgacaatggcatgtggtattgatttagcagaggtattttccttctgattaaatgtattctaaaacttctgtttttctttaaggtgttcctactcctgggcccagtgctaatgtagccaatgatgccatgtcgatattggaaaccataacttctcttaaccaagaagccagtgctgctagggcttcaacagaaacatcaaatgccaagaccagtgagagagcgtcaaaaaaacttccatctcagccaaccactgatactagtactgacaaagaaagaacttcagaggacatggctgataaagaaaaatctacagctgactctggaggtgaaggactggaaacagccccaaagtctgaagagttcagcgacctcccctgtccagtcgaagaaattaaaaattacacaaaagagcataataatttaattctgctaaataaggatgttcaacaggaaagcagtgagcaaaaaaataaatcaacagacaaaggtgaaaagaagccagacagcaatgagaaaggagaaagaaagaaagaaaagaaggaaaagactgaaaagaaatttgatcactcaaaaaagagtgaagatacacagaaagttaaagatgaaaaacaagcaaaggaaaaagaagtagagagtttaaaacttccttcagaaaagaacagtaataaagctaaaactgttgaagggacaaaagaaggtatataaaaacttgcaaacatctacaaagtttaaagaacagagtgttttgggatcagggaagtatcaaatttgccttcatattttaataagtttatttaatacttttggaaacttatatcccctttgcttaagaaaaaaagcaataaatatttgtatttttgtgtactcatatatctgttcacagagtaaattaacagaagttattaatttataatttgtcttataatttattcacatacattattttaagcaacttagttcatagttggatatcctaatttttattaggtagtaaatacttcagttacttaaaattcattttattattatatcatacattataaattaatagtttagttatttttacagaagtctactttgcctttgtattttctggaaaccactctgccttgtttgatagtttgacacgtatttaaagcagaaaattttaagtgtaatttagtaattgagctctgagtatgttcttataataagatgatttttttttctgtgttttattttccgcttgaagatttctctttgatagattctgatgtggatggacttacagacatcacagttagctctgttcataccagtgacctttcatcttttgaagaagatactgaggaggaagttgtaacgtctgatagcatggaagaaggagagattacgtcagatggtaaagcattttacataataatgcctctgaagcatcctgtcaagcattatttgtatattctgatggctatatcctgagaaacagtgtggtatagtagcaagagcatgggattttgtagttggaagatttgtttctgagtcccagctccaaagttgtctgtctgagcaagcttggtaagttactaaatctcaacaacccttggttcttcattccttaactctatcccctagtattattattaatttaaaatttagaggagataaatatatgaagatgctttttatttgtgtgtgtcacatttggggacagcgtagtccacaacactgccctcaattaatggcaccagttgcaagttccgggttccctaagaccaccgttagatttgataatttgctaaaagggctcatagaacttaccgaaaggtggtatactcacagctatggttgtttacagttaaggtgctcagattaaaatcagccaagggaagaggcacacagggcagagtccaggaaagtttcagacagttacttccaattgttcccccttgaattacttcctctgcattgatgtctgacaacatatgcagaatattgccaaccagggaagttcaccagagccttgggatccaaagttcttaaccgaggctctagcatgtagtcagagttggctgcccatatggctgatctcagtctctaccccctctagaggtcaaactcttactccatgacccaacactccgaccctaaatcacatcgttagactgtttagcttgactcaagagccttcgcactctgaaacactccagtcaggcatagcattccagaggcttagagattacctcccagaagctaatggtaaaggccagacctctctgggcaaggctgaattctttataatacagtttgtttttcagaaaacccctcctgagcacttcctgtcttccaggcactgtgctaaggacattcatgtaataactcctatagtcctcagaaccaccccaggaagtaggtacaggcaaggagacaaagtcacagagagaccatgtcttgtccagtcatgtagctagtgagcaccagtgcagatttcaaacccgagtctgtgcttcttaccaatatcttatgttgctcttaccacatgattaaattctgtttaggactattagtttaggagtaataaaaatattgagttttatttgcaactgcctgtagagagcatcttataaatttgttgcc

SEQ ID NO: 110702 - DNA, 1015 bp, Homo sapiens
acaaccagagggaatggtagttgcaggatggtaggtgcagatatgagaatttctcactggagtgtaaactttgaagctaaaaggaggcaaatggcagaaggtgaggctatacagtgcttgcttaatatcagtcagggacactcaaactcatccacattaaaagctgtatagaagaaaggtagaaagaacatcagtgttgggagacagcctctagaaatggagtgcagtgctgagtgcttggtcacatattccttccaggcaatgccccttcaggtagagatgatgtaatatgtgttcccctccatgttcccctcagggagcacatcaagggttctcagactcagcactgtcgacatttggggctggatagttctttgctgtcgggggattgtcctatgcattgtaggatcttcagtagcatccttgcccttgacccactagatgccaatagcactctcatcagttgtaacaacctaaaatgtctccagacattgccaagcgtcccttgggggatgagagtgaaatccttcttggtagagaaccattgccttacctcagatttaatgcctagttcaagtagttgtccctcaataatttctcttgggtctatgccattagctggtttctgccaccccagtaaagaccttcctcactgtagtttattgcatgctttcctaaagtattttgtgtctctttactcttgcactgtaggatgattaaccatcagaaagcttagctgttctatcactctgcccatatgtgcagtgggctcccattctctaccctgtaattccaaacttgtacaagtaaccaaagctttttagcacctggccccaacctctctgtcttaacctcatttctctgctttttgtattctcttctatagccaaattggaccaccaatttggaggctcactaaatgctcctggcctccagtttgctcatccacttgctctttgtttacattgactgtatgagcaaagccagccattctcattcccagcttccttgtgca

SEQ ID NO: 110703 - DNA, 1035 bp, Homo sapiens
tactacgtgccagtcatggtttcggcacagtgattaccccggtctgatgagcaagactaaggcattgttcttacaggaactggtttggaaacagtggcgctaacagtagccagttttgtattcattctcatatctgatgattttactttgtatcgaagttatgtttgccttctttcttgaaggtttctgggcggtaagggcctttatcctttggagaaatgactaaatggtaattgaatcaagttatgtgtaatatgctttgctggacatcgtgggggtgggagcgcaaagataaggaggcaaacctgagacaggactttagtattgtttctagcagtgattgcctgatttaggtaacttaggccatgtcaccattctaaggtaagaagggacaggaaggtggggtagagagaaccgagtcattcagtggagaaaagatgcaggagaggtgacagcagatactgaagtggagaaaggacaggaaagagagcagattcaggagagtaatgtagagaagggaaaggacagcaacaaggttccctgtccagaaagagaggctggaaaggggaagggattttgtaccaaatgtcagagtgaaagggacattagcaggaacaagtaaacttagctggattggcaaagaattagccaaagacaccaggaaagagcagtcagtgagatggatggaaaaccacagtacagtctagaattctggaagcagaaagcatgttggaaaattaactggtttgtaggggttgtttttgtctgcttgttaaatctggttgggtccattggattggagttttgatgaaatgagggtttccttttttttttttttttttttttttgagacagagtctcgccctgtcgccaggctggaatgcaatggcgtgatctcggctcactgcaacctccgcctcccgggttcaagcgactctcctgtctcagcctcccaagtagctgggattacaagcgcgtgccaccacgccctgctaatttttgtatttttagtagacacaaggtttcaccgtgttg

SEQ ID NO: 110704 - DNA, 1058 bp, Homo sapiens
gcctggagaacagaagggaatggctgtcttttactgaagcagtcctgctttgaagtctactaagtatttaaaaatctttatgttattcttggcagggtgtcagaggatgatcaggcaaacttcatggtcactctgatagcacagctaagaaatccagggcaagaagtgatcctggagatcaattctattcgtcttcctactgtgcagatgtgaagactttcccagagataggcctgcccgaatttattagtttggtagtgctgccataacaaaattaccacagactgagtggcttagacaacagaagtgtatttcttcatagttctagagattagaagtctgaaatcaaggtgttagcagagtaggtttcttctgaggaccctcttcttggcttgcagatggctaccttctccctgtgtcttcacatggtcccccagcttgtgtgtgtctatgtcctaatatccttttcttataaggttaagagtcatatttgaccaaggcccacactaatggccttattttaagttaattacctctttaaataccctgtctccaaatgcagtcacattctgaggtactgggcattagggcttcaacatatcaatgggggagcagggcacaatttaacacatagcccacggtcacatcatgtcagcactgagcccagaagctcatgctttccctgagaagaaggtgctctctcaggtttttactaaaagtgcttccattcagcttcccagatgactgttgttcccaatgcagatgctggttatctagttgcatcccttgccttgtattctgcacgtctccttccttggggatgcttccaatagtcaagaagttagaggaaacccaacagagccccggggtaaaggacggctggtacacaaacagatttgtgagtcactggcacatgtgagggatattatctttaaattagttgggggaaattaatattgctcacttgctatgctcacccttattgtctgctccaagaatcagcaggtctggagcctctgttgatagtattttttaattaaaaggaaaataacttcttg

SEQ ID NO: 110705 - DNA, 1034 bp, Homo sapiens
aatttgactattttagatactattgtaggtattttagatacctcacgtaagtggaatcatgtggtatttgtctttctgaaactggcttatattgctttcagtgcaatgttttaaaggttcatccatgttgtcacatatggcagaatttttttctttttaaaggctaaataatattctactgtatgtatatgccacattttctttatccattcacctgtcaatgaacatttatgttgctttcacatcttggctgttataaatagtgcttcaacaaatgggaatgctagtatctcttagagatcctgatttcacttattttggataaatacccagaagtggaatttctggatcatatggtagttctatttttaattttttgaggaacctccatactgttttccgtagtggctgcaccattttttttattcccactaacagtgtgtaaggttatcaatttctccatattaccagcacttgtcttttgttttttgataatggccttttagattgattcaatcctttctcctttaggacaacactttgaaagaaacataacagttcaaatattttttgggcactcactaagtgtagggcacagagcttggacactgggctataactgcaagcaaaagcagacacaatccttcactttgggaaattttgtgggagagagatgatggcaaatagccaccatgacaaatgtaaaaggggaactctgacagatctatgagggccagggtacatgtctagtagactgtataatggggtaagggttgagaagagtattctgaacagagggaataacgcatgccagagtcggagggcacacttgagaaaaccagcatggctgatgtgcagagcaaaaaaagggagcaaatgtgttactacccccacttacagatggaaatacaacctcagaacaatgcgtggcttacaatatcaccatcagggaataaaggagcagcacctagaagtgtataattaactccaacactaccacaccaacctctccctccatgctaaacttgtggagg

SEQ ID NO: 110706 - DNA, 1055 bp, Homo sapiens
acatgaagacaggtaagtcatcccaagactataacgctggggaatagataaccctggagtacaagggggaaaacttctgtctcaggagactagagttgggactccaggaacacaggggttcattacaggagcttgaacaaagagaggagtcaagaccccatctcatagaaatggaaccagttcaggaggcactgcagttaaggtcaactggatgccttacttccatgctgctggtttctttctgtggcagagcccatgcccataaatgtaattaaccccacagaatgggaaagctttgagtctttagatgggagctaattagctctggtttggagttggaaaaggagaaagtagaaattaagattcattctgaccttgaccaacttcaaggtgctttattgatgtggcactcaagagtagtaccatcctcaattacttctagttctcctacttttctaaaccttccttcataatttcctccttcactttctccttacatattctttacgtgtgagagttccttaggcttatgtttctggtccttttctatatttctacctactttttctagatgaatttattatcatgttttcaaacatcatctaaatgctaatgtcttccaaatccatctctttagcctcatggtcaaaatcatatttccaactgcctgtttaacagtttgacctgggtgtccttcagccacatcaattcaatgtgtctatacctgcattcaacatcttccccaaaatctgcttctcctattttgcttcttgtcttggctgacgtcatcatcacacaaccagtttctcaagctgaaacatgagtcatcctcttccttcatctctctcaccctccaaaaacaattgtcaaccatgctctgtcaattatactgcagaaacgttactcaaatgtaattccttcatgtatctccgcattcccttgcctttcacattcctggaacacaagtgcccaataagtatttgttgattagtaattgcccaatgaatgctgtaagaagaaaagatgaagaaaaggagaaaacaaggtaaggaaag

SEQ ID NO: 110707 - DNA, 1036 bp, Homo sapiens
ctacaagggaatatgtgggccgtgtgtattttaagtaggtaatattgtgaaatgacactgggcagaatttttattttccggatcttttttgattcaagatcttttttgttattccctcaatacaatttttgggtgaccgctagattggtaaattggcattgaaagagtgtcttgttggttttgaatcttgttagcatttgttgcagagttcattctgtttaagtccattttctattttcgtgattaaggattgacagagacgcaaaatatgaccttaaccccataactttttcagttgaccaaagttttcaaggattagtctttttaaagtgaatattatctaaattaacccaagtgaaagttaacagtttatctaagttaaccaaagtgacagtgaacagtttttgttgaatcactgatttctttcttagaaaagagaatgtggcctatgaggattgaaaatagggattttgaaataatgttccactttttcatgatttttataaccctcagcaactgtcttttgtgtctcaggatcttcattttgttatctggaaacttgcccacagaaaattatctgtaggtaattttgtatttacttaaagttgtggtacagagcgttggaagaacatataccatgatccatatttaactgtaatttgcttttggacaaaagatgggtctagccatggagtgtgagaggtcacacagctttcatatggaattttagatcactggaagataactttgagcattaaatcatttaataaggagagtaaggccctcaagaatgaagtggtttgtccatggctctgtaattatgctttggacctctgtggaagaggaaagagtaataatatactcatgattatgttagcatttaaaagtgtttaaaaattggtgctgtagatcaggagtttctcttttaattgtcttacaaaaagcaggttcaattttaagagaaccatatttatttgtagtaactgtatggttcatacttctttagctacatcttaacaccaaagtattaaagtat

SEQ ID NO: 110708 - DNA, 1089 bp, Homo sapiens
actgaatttgaatgtatactaggtaccaggtggtgaggattattataggttatagaaaactcagtccttatatatgcaggttctttcttacagagctcaagtttgaatgagcatagacttaacgttgtgtgtgttatatgaatggagctatgttattctaagtctcttccttggttaatttatcaacatgagatgattttacaagtaaggacataaacagattaataatacgtttgtaagtaacattctaatctagaaggttagcattaattttgataatcaaccactaacaattgttttagccaagtcctgcctgttttccaaagtagtcctgccagggtcttcacctagaaatggtagttacttcatgcaatttgcaacgtattgtcttgttaatataagttagctatttacctctactctcttctctagtctggtccagttaagccttattagtgacgtttttatggtagcatttttgtatttaaattcaatacatgaatgcctaggagatggtatgtttaggagaagaaaattaatgtaattattttgaaggtggcaagagaaatgttttcaaatagaagaggacataattactctgtgcagaaagaagcaataggatggatacatatataggatacatatataggagaaataagtatccatggaaaagaatacaaattagctggcatacatggtccatgaggcagggacagatgttgagaaatcagattattgagttgatttcagttggagggatgctagagaggagataggggtgataatgaaagggaagctttcacaccagcctccggggctgccctcccacttagacttcaatcaaagctattctgcttttacctgtattataacctaagattttagggaaatttattttaggaaaaatgattttggtgcttaaagataaacttatctggtaaactgctgagatattggcattccctttggacttttgagccagaggtgtgatgtgatgaagtaaaacacagtggtgggggaaaaaagagataatggaaagtgaatggaactggaaggaaagaaggcctgaaacttggatcttcttcctct

SEQ ID NO: 110709 - DNA, 1045 bp, Homo sapiens
taaatataagaatataggggttttctataatcttatttttctttggaagagtacctcattttcaagaggagaagtttctaattgaccacttctttaaaaataaaacagggtttttaatgtatcccagcaaaaaaaattaatatctcttcaaaaagttctcttgtgattaagtttgaattccctttgtcatactgcttctaatattgtacactgacctccttagttatttttcagtgtttataatcttttcttaggttatcttttttcaagatttggattactttgttcttttctgtgtttttcagcctttctaagcttttattgatactcctgtaagtgtttgtggcaaatgtctgggtttaagaaaaaccatgaaataaatattataataaaagaggttatgccttttccaacaatgttttctaatcattttattctgttagttattgtgagattctgtaatctgtttctgaaagcccatttagttgattgtttgccagatagtttttatattttagaatagattgcatgcacacttttcctcatagagtcttatatttctgaagtattttggtgctttcaaataaccttatagtaataaatgtaaattacattgctatgattttccatatttattaatgataattagtattgttgcgttcatggtaacttgaaaattgccttagttcttctatttagttttcaaactgatggcagtttgcatgaacacaatttttcctaatgtctgtatttcagaagaatgcatgagtgtttgttttataaccagatttgtttctgttttttcagaagtcatattttaattcctgcaatttatttaatggaattatcaatatcttttgcatgtaagcctataggtttcattaaattcaaaaagcaattttgagatgtcatgtgctctttggttgctcaaggctgttttatgtttgttgctttaaaaatcacatgggatgcagctgatgctttacaaagtacaaccaagctaatcattttaaaatagctttgctgttttctttcctagagtagg

SEQ ID NO: 110710 - DNA, 1040 bp, Homo sapiens
ctgttccgttgaggattctgagaaagttttatagtcctttaccattactatttaaaaagtacagtctttctccttacagaactcgactttttttttacattttttattgagtttttatggtagagataaagaagtattcattcaacagacatgagaactaactatattctgtaattagatagtccctattcttaatcaacttagaagtttagtgggacagacaggaaaatcaacaaattagttatgaacacagtatagtggaagcacagggaagatggaaatatctggatagattcctaaaattaatatgtcatttttgcccatatgggccatcctattctctgtttcagttttattaatatttcatttattttagagtattttgagtctttttcttttctagaatttttaaagagactataggcatcatctagtctgacatgattattttctaggagttagaaccagagcctagagagatttagtgacttcagacgaagaaactaattgcttcttataaagtgtgatatccagaccagcagaatcagtatcacctgggaacttgttagaaatacatactctcaggttccactccagacctactgaatttgatgtgtttcagcagtctgtgtgtttaaccagccttccagatgattctgaagcatgttcaagtttaggaaccactgttacagctcattgattctttgtgcctccatcactaatcaaggtcactgttctagagagcagctgttattgatgcatgtgttttacctcaggggcctttcagtaaaaatcagtaaagagtactgatagagttaattggtgataaagctggaataagagcctccagtctagcattccttccgtcattcagtgttactttttacctttttaaatccctgacagcaacttagtctacagtactgattctgaacccctagctttaaaaaggctacaaccctaatttaaacatcaaagtaaagtaaataaatgaacatattcttagaaaagctttttaggtttttcttcagctttctaaa

SEQ ID NO: 110711 - DNA, 1976 bp, Homo sapiens
gcactcattattaaattcagactactatgtcagataacaaaatgtttgatagatgtttaaagtatggtgcaattatggaactaaaatatttcctcccaaatatttattttctatgtgccactatctgtcttcctaaatatgtgagaaaagttttgaaattaaccaaaaaatgctttctgtgtgtataagatttcaggaaactttatagagaaaagtaactatagaaattattttactgttttgcattagtattgccagtaaaattagattacttttgataaaagctttaagagataaatatactgaaaataatgtcctccaatgcaaggaacattgtagttcatgagatctttagttattggtatttttgtgggatacagattaattagtaataatcagaagtcctattttatgtaagagaatttagatagtgttttataatcgctttttgaaaaaactgcatagattataatgtcttttttcctcttctcttccaggatcgaagtagaatgtatgacagtttgaatatgcactctttggaaaattcccttatcgatattatgagagcagagcatgatcctcttaagggtaggtgactttttaaaaaaatatatgtttatattatacaccaatttgcttatcttactagtttttatatgaaagtgaaacctaagtagcacctatatccaatataaaactctcttacacatttattaatgagaatctttgtttttatgaaatgccatatttttcctttgttgcttaatgtgaactcacctcccttgacttacaatttaaggaaaatttactatttagagacatgcttcagttcaccagagaatgaaggatggatctaaaagtatacactagtcacttttctagaattctttcaagtacaaaaatactaaaaatatttcttggaatacttgtattcacaatttgcagtgattccagcctagaattatccctagttaacctcctttctctatttttcttctactgtcatagggttttgaaaggggggggagtattttatagtagcttctctgaggtgaaaaatagcttttcatagaagttgagacaaattagggaaaagaaccggcccacttaccctatagtagcagtcttcactaattgtttgtagtatttgaagaaatttcattagcatacttgtttttgtctgtacatattctgtgtataaaatgaaaaaaagcaattattatatatttttatacaatatatcacattgtcatttatatcagtggtgaaaatctaccaaattgtctatttgagtcatgacagttactatttatctattgctacataataaattatctcaaaacttagcagcttaaaaacagcaataaatatttattaccttaaacagtttctgtgagtcagaaattcaggagcagcttaactattttattctggctcaaaatctctcattgaatcaaaatcatggattactttgtaaattttcgccatttttaattctataaagccaagttagaattctctttcaagatttggcctaaaaactataaacttccttattggcagggaggtggtgatgtggggctaagttgataatactgaccacatatctaactatttttttctgtttatggatttttcttgtaaaaagaattccttgtctttttaattccttaattttaaggagcttgagaagctgaggggatattagtgattgttgattatgtgtgctaatagtaattcctcatacaaacttatagttgtatgtcaggtttttggggatgtttgtttgagtttcttttttttttttccttttaaccaaagttcagcttagttttttgagtatctttgtatagggtcttggtctttttcactgttatgctggcagtttcagtggtttgtcttagatccaccatttagaatagaagccagcagcttatgattaagaagtttcctgtttatctccttggcttctcaag

SEQ ID NO: 110712 - DNA, 1007 bp, Homo sapiens
ttagggctgcctgatgccgactgggtgtaacagggcacagttaacactgtcgagagtgtgctatcttttgctatggatcgtgaacagtgacacactgttaaatgctttctttagtatgaatggcactgacccgtctgctttatttattgtgtggtagtttctctccattaacatcctattttctggtgactatcttgattcttggcaaataatttgcttttcaaaggaagatcatggattctttaaatggttaaagtaaatcatgctttgccaagtactgttttgtagtttttcagttttagatttgcatacctattttaaataatttgtgattttttaatatatgtgtatatatattccccctttaacaaaagaacaagacagtgattattgttaagctcttttccttccctgcccccaacaatttgtaaaaaggcttactgtgtgagtatttttgccagaaattgcttgtatcatttcccaaagtatagggacaaacagaattacttaattgtagctcataaaagttgatttgaaaactctaggaagaaatgtagtttatgtaacggtttgggggaagatctgtgtcagtaagtcgtaatgcctttaccagtgtttcatgagcagttaaagggaattaaggaaaaagaatttagaatatgattttacaccaagaaatgtctagaagtggatgcctttaaaacttatttactaagtttttgtatatctagtgtcatttttattacctgattgctaaactcctattttttaagactcctgaagtaagaagctctgtttattttagggcatataagccctgagaaaataaggagttattcctgtaaggtgctgactgattatggtagtaccaaattgcttattttcttccacttttccctctctttctcttcagctgaccttaatataagattacaataccaagtcacaaaataacttgtataaatttctaaaagtctccattgtgagaacttatatttagaatttaa

SEQ ID NO: 110713 - DNA, 1258 bp, Homo sapiens
ttcctgccttcattttttaatttattaagctgtaccttcattggacccttttaattcagagatttatatcttcagttcttggaattttgggatattatttctttgataatttttttttttttttttttgagatgggagtcttgcactgttgtccaggctggagtgcagtggcgtgatcttggctcactgcaacctttgcctcccgggttcaagtgattctcctgcctcagcctcccaagtagctgggattacaggtgtccaccaccaggcctggctaatttttgtattttcagtagagacggggtttcactgtgtttggccaagctggtctcgaactcctgactttgtgatctgcccgcttcagccttccaaagtgctgggattacaggcatgagccaccatgcctgcctcccattttttaatattacctctttttggaattcctgttcctcaaatgttaaatgttgtatagtcatcatctgtttttcttttctgttttccattgttttgtctcttgttttgcatttcaagagcttatgtttatttttcaaatcttgagttttttgttttaaaaatttttgctaatttttaaaacctcctttaaaaaaattctcagaactttcaattacatcttattcttgttgtttgatcttatttctctggaggctattatagtgtttgaagattattttcccagttccttatattgtctgtgcttcttcaaagttcttttttatttgtttgtgttctctttttttctcatgttgggggcttcatcttttactgtctattcatatttaaaagtaagacacaaaaaatggggattggaagctcaatgtatatagttgaaattatcaactagtaatgattgtaataagtcaatcaggtgagaccctcaccatgcctgtgtctaggtcttttcttttgttctggcaaatgaacatggatgtgggtcttctagtcttctgcttgtgagctgtaggcctagctgctagacttcttagatgaacccaggagggttcttttaaaaactaacaagcaatcttaaaccttctgtttttagttgtacccgacttttacacacagttataaccagagcttctgatttctgaacctatccaggtgtgtactacagtaaatggagtgttacttgatggcattccccatgtatacacggcttaggtttgtgtttcagtgatttctggtctacaaagttagttaccattcaaccattcacatttacagttcccagaaattt

SEQ ID NO: 110714 - DNA, 1030 bp, Homo sapiens
tatcttctcagtcatctgtgtcttctagcactacttccatgcaggacttggtataatgtagattggatctgaacagctatttattggactatatatgccataccattctttataataagtagaaaaaataagcatttagttcaagttgtttccattcattgggaaaattatttgggatgctatttaccgcaaagtgttgtatatttctgtcttcattagctgaaacaaatacttgtgaattttaacacaaatgataatgaaatgtgtgtttcttgttaatttcagagttttatatgattcagatgatatatatttacctataaataaaagtcctttgtagaatggtaaaacatttaaatcttatatggtgacattgtcattgctcttaaaacaaagtagcactaattttcagatgcccacatagcttttcgtatcagaaatatttgtatatgtgggcttatttttagttctgacattttacaatttgtgctttgtttacatgcagcaaggagttatgggcgaagacgaggtaattcatttctgtttgctatggtataattgtttctaatggggtttactgatcaatgttgtaattaattactctagatttttcatgcaatatctgaaaactcacacaattgtattttgatttgagcacttgtcgaagtttttaattttaaatctcctaacctttgaactgtatttttatactaattgtggttatttaataaattttccccttttaaactgctgagatttaactctagtttttaaagttacttctgtatctcttaaaataaagctgctgtttatggtttgtctgcttaaatatgtttaatattagtgaagttagcatgaagtatgatttttctgctctctaaatgtgtaactgtcatatttatgatgtataatttacagctctagattgttagttttatgttgacccagttgaaaataacacacaccaaatagattatttttaacagtgatttatagaaatcatgttgcttatatttctctgttttctaag

SEQ ID NO: 110715 - DNA, 1463 bp, Homo sapiens
gagacagacactcaagacttaaaaaattgaagctgaacaacttttctaaaaacttagcaagctgagaaggggggagcagtttagaagtttagtacctattttcaaatctatggactagcttatttcactatgcaattttagtaatggagcttcagttctctgaaacacaacccacttaccagtctgtgatttttaggcattttgaaactatagagcaattcagaattcttgccttgttaaacatttttcatcttttacctgttgtgacttacatttagtctaatttcgtatgctctcatgtaaatatcatgacctaagaagttcttaggaacaaggtattaggaagtaatgttattatttgtcttcatctcagttcaataattgtagattatgattatattaagaaaaaacaaaatttttttccctgcttttatataggaaccagctatcattcctatatatctctatcccccgtaagccataaagacttattcggcttcagaactgccttcctgcattggaagaaggaagactctcacatggttttaaggcttctgataaaagcttccattacgacagaactgatggttggcatacatatttggcttagcataagggggagtgaatgcctgaattttcatctcaaattatatggccttagtaaattatgaacactagcagtctacttttaaaattttgattgtgagagtcacgtgaaaggcacactcattagaaataactactgagagattttatctgaattttaaagtacactgaaacggtaagtaatgcaatttttttaaaacctgcataccaaaggaatgactcagaaatggctagtcacctggttttcttcctattttttactgttttttcctattccatgctaggtataataaacctcagactgataaccttttaaccaccaaacacccccttttatatagcctcatgtgttagatttgatccatcaaagaaactgcatttatttagtaattattttgtgaaaaatgagttgcttatcttctgttcatgtcggatgtgtcacactgagttgatataatttttgctaaaaataagtcatggctcttctaccagtgcaataatgggtgaacagttattttcacaggacattctgactttgacttttgtagtcctgttcaggaagaactgtttttcttctttcagcccaggcacgaaactgttttcatttaaaagatttctcacttgactacagtcaaatcaagttactaccaaaatgactttatgtacttgaatttcttaataatgtcaataagaactttaaataaagctagctccagatattaatttatgaaatatactttaggaataatcaaaatgtaattatgctagtagtagttaagaaaagcagagatttctgtccctgctttttagttggaacctactatcactactgtgtatctctatcccctggtagccat

SEQ ID NO: 110716 - DNA, 2495 bp, Homo sapiens
atggaacattgttcttaatagttgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaactagcccctatattttaatgtaagagttactctgcaatctaagcaaagcacccaacaatggtaaatgttttttaaaaatgcagaactaagatttttgactctaaagagagaaaattacaagggtgttgccttatagcaaacccttgggacaatccttcatgtgagcaaagtgttgatcttaatattggttgtctgtggtgtgcttttttgtactgtaaaaatatgtggttcatgtctaactctgctgttttattgtggttgtggttcaagtttttaatgtttaaagttgatgctgttttcagaagagctttttactaatttatttgtcagtgttccctatttgttacttaaccatgatcctccagattttttggagtattcttttctaaccttaaccctgccaaaccttgatccattttgacatttgttatgcactatttttatatctctgtgagagatttttccaacagtcagctattttatggcacactttttttgactgatgacatctcctttgctatacctcaatttttggaatttagagaagaaatcagtagttttgcaatgttaattatttagatatttaatttcgcagatttttaaactttattttcataatttctgcttaatgtttaaaattgaagagccttttcatgtattaaataatgaacacaaattatataattaaaataattggagatgttgaaaatcattttcccttcttaaacagaaataaatatttggaatgaaggggaatgtactagaacaccctttttgccacgggtaaaaataacagaaatgtatggtttgttttaccttcatttctgtacaagtaaagcttattagtctaatgttttgttcctttcccacctcacccctacctcttttgttttgttttgtttttgccctttatgtactacattcttattttctaacttttaaacactgtattggaggtttttttttaatttacagatcatatttattttactatttttgtagaaaattattaattttgattgtatttttgtattttaaaagcttcttcacttgtgttccctaaatattcatattgctgcccaaaagtatgactgtggaggaaaaaaaaatactttaaaaatccacactttttgttaagaaggaaacatttagcatttatatatttgtgtatggaaaacacttgatattttatccctgttgcatctggctgcacagagcctctcctcaaagatgctacaaaacttgaatataacacattttggaaggctgactaacctcgattctgtgttgtgatgtgcaatactgtttctaatgtttgtataaaaaaaaacagtgtaaacctttttaatgcaaatttatttttttcattgcatattttgcagattttatccacagtgtcattttttactgtcagaaaagataccccttttgtcattgcaactattttttaaatccagaaatctttgtactgatgtaaatgattgtagttattttggatagtgttttgctaacaaaaggagagacttttttcatgcatatttctattttgtttttttgggttttattttattttaatagtagtaaaatacttggaataatttttcatattcttgtcattaatattattttgtatttttatgtggaaatatataattttatgacactaattgctaaagtttattttatgttgaattatttttggagctgaaatctttgtaatattaaagcaactagtttctaattcccagtttctgtatagaatcgcacaagtggtttatggagtgtttggattgtaattataaatggttctttgatatgcaaattaatattttcagttgattttattttatattcctaatggggtgttaaagccgttttttatttttttctaaataaaaagagaacccatgcttttatggacactaggtaaacaccttcagcttaaatttttcgttaaatattttagtttattttattgttatcttccaggtgtctaaatctccagtctgtctgttgtactggtaatttaactctgtaatggaatagtttgctgccaactatttatattaagtaatttttaaatatttgtaatattgttgactgactaataaactattaagttattggcatagttgtggaatcttattcttcggttcaaatcaagtaaaatattcaaaaacaccagtaagatcttatttagagagagagcttagtgacataaatatattatgatgcccaggccaaactacatttcagtacaaggatagaggagaagccttggagaccatg

SEQ ID NO: 110717 - DNA, 1046 bp, Homo sapiens
tttgagcacttggtgtatgacagcctctctaccaagctttcaaagcattctttcattcagtccttaccagcttgtgaactaggttctcttcttatttctgtttaacccacgagggaactgactttcagagcggttaagtcagttgtgtgaggtcacgcagcagaaggtggcagagcaggcagtctgatgcgggggcacaatctctcgatgggtacaccttgcagagggctgtaggagttactgggggcgtgtgcagcagggagtctcacacgcagtgggtgtacaagaaatagcctccatcccttttatcactattatttattccttctaaacaaacaaacagcaaccattcaacatggcgatgtgattttgaagggatgattttggtcctgcttgaggacatgtcttgtgtcttgactccacatcactaggacatgggcagtctgcacacagagacctcaggaatgtgacaccccggccccctacttctattgctttcagactgtcttgggttgaccttctttagtagcaggatgaccttcactctccatatctttatttcatggttcaggactcaaatgtgtaggttgtagaaattttacaaattccagacaggcttaccacatttaaaataccactgacaagtgtgtaatgcctacctttttaactccatgtaggtcagctacatagtactctcagggagtaagaactttcctaaagcaactcggaactgggccattttgcttacttgctggcggcctgataataccagggcttctcggtgttgctaagagtttccaaggagagagatttgcttctctcccattttccccttccagggcaccagaatgagctcgctgctggagcctagggcacgttcttcacttggtcaccatcaaaataaaattaccaagcacgcaggtactgacgaagcctgtcactacacaaaattaatcattttaaaaagtaaatgacccagtttcctgtggtgtgtgtttttggggcccagggagtgcccttcccccctcaagtgaattggagatgcc

SEQ ID NO: 110718 - DNA, 1021 bp, Homo sapiens
attagcttgcaactttgggcaagttcctttacctctctggatatttttccttaattgaaaaataggaataataatcattttctcttcctcatagggtcatgatgagtactgaggtgatatatgagtatgacctttttaaaaattataaatttctataaaatattattactgacaagtatcagtggatggctactttgtacagaaatgtgatcctggaggcagatttacaaaacaagggtaaagataagttccagcccatgaggaatttatcgtctatttggttatatgacaaaaatacataatacaattagtgatcaaaacaatatcaacttatgcatttattgaataatccatcaatctgtatcatcatccatccatccattccattaaacacagatatgatgaacactgaattgtgggttaaagttagaaaacagaagagtaattaatatggagggtagggcatgagggagccaatggatctcatctgtctccttttgaaattctaaactaatttagaaatacactggaatcagaaagggatccagatatcccttgcactaagggtaaaaccagacggcagaatgccacttgaacccaagaccagatggtttcctattccatttctcacgaattaggttccccatctagacataagctaagcggctctggtgtatttaccaggtggaatgccaagcagaccatgcaggccagtgaacaacctctccttggagacagctaagacaggacagctaggggccactgcttagctttgcaggtaacctggactaaggaacttgggctccagctgactctccagtcagacatgtccttccttctctcttgggaagcagccagtaggactggaagggtgggtagagaaggacagatggtttcctttcaatacttttgagaagcaaaatcttcctatcatacaagcagaaataggaaagtcaagaaagaagagttctactgacaggggcttgtcataaagcatcacagagcaaaggaagttagagaa

SEQ ID NO: 110719 - DNA, 1018 bp, Homo sapiens
aagtcagtcagcctccgagttcattaaaacgtgggagttaattaggatgtcattataagacttctcacagtcttggtttcaaacttctgctaatgttctaatgattgatttattctaatgattgatttattttaaaattatagctttttgtgcattttcatgtgttccctcaacttcacatattaagatattatacataaactattcccctgcactaagtaagcaattttcaaggcacaagtaccataccctataattttaattttgacatgaatgttcaaaatatgtgatgacacagcatgctttctaaaaggaaaatttgggcttgatttggtaatcttttatgagtggagtctaagtcttcagtgtcttggatacttcttgcaaatttgctgtgaagtgtcctttattaaaaaaatgctgaagtaatttgagctatttcatctagaataagtctaaattatagacatgtaaaaagttaaaactaccaccccctttaattactagagaatttctgtttggaatgatgaagaagctctgaaggtggatagtggtgatggttagacaacatagtaattgtatgtaatgccactgaatcatacacttaaaaatggttaaagtgataaacattacgttatgttatatatattttccacaatggaacaatttttaataaactaccacccctcccccaaaaaaaacctaagcttgtttcaaattttgatgccctaaccttttcctttcctcaattagcttgaattgctattgacttaaccaataactggcattttttggtggatgtctatacacatatgtacaataaaattaaagaccaatgggaggttgtttttttttttaactttctgattcaaattatctttaaaaataaggaatatttattaatactctgcatccattgaacattcacttactgtctgaaaatgttgagaaaaacttggtatcttggaaaaatgaactcgatctaactgctacaatatgctgctgtatttttagaata

SEQ ID NO: 110720 - DNA, 1742 bp, Homo sapiens
agagtgattaaaaacatgagctatatagtcacagtgacctgagtttgaacccctgctctccctcctactactaaggaaccttcagcaaatcataacacctctcgtagcctctaatttcttcatctgaaatacagggtaaatattatatgcgtaaagattagaaatgttatatgtaaggcacccagcactcttctcaatacataggaggtgcttataaatggtagctattttgtgtaaaaccttggagaataaacaggaacaacagctcctggaatcctggaacttccttgggtttccttataggagctgtcagcagcgcctagacaggagctgcagagacctcagcctcagctggcatgtgcctcttgcaaagaggggctccagtcaagaggtcacttagccagctctgatcctcaggaaggaagcagagaaccatgtgcattatagcctgtggccagctctgcaaagctggctttgttctttggctgtttcacacagccattaacatcagcttccagatacagtcacatctttgtttctgtttagtttctgggccagaatttatttggtccatgaacgtttctcctatgattcactgactctgttgctttcatcttacaggaagtgtttcttgcatatcatctccgtgaaaggtagagacatgagagaaggagtctcttgcttctcccctaaccccttcctcctccctatacctcctcctcttcttccaccttaatcactggcatcaacccaatagttaccattttaggacatctactaagtgctagagcagtgtcagggtgctttacacacacttccttattcaatcccttcaacaatccaaagaagtaggtatcattatccacattttacagatgatgaaacagagacttaaagaggtgaaatgatttgcccaagggcaaagagtggagccaggattcacacccagttctaactccagagtgaaagagataacccaggaactgcctaagcagctgtacacacccactgtcatgtgaagggagcaggctaataggagctcaagaggtttggaagagagagtaacccttccagctggagtagctgagtctctgggggaggtggacactggccccaagggatgggtaaaactgcaaccaactaggcagacaaggaagatgcagggaggcattccctctgcaggactggcccaagcaaatgtgaaggatgggagaccataggcatgtttgaggaactggtgggtgagcaaggtagagataaggcaggaaatgtaagggccagagcatggcttctcttccttggataagcagcagctagagtaagttttaacaatccatgcagtaggatctcgcccatttgggagaatttctagactatttccacccaccttcaaaggacaaggagtttttcaggggcgtgtgcaggaccatggggcagagttcgggaagtcgtctcacaattttgcagacctttctttttcttagagtcctgatcctgttctgtaatcattagcattttgggcctaagccttttcaagctggcagaacaaaagcgaccactgcggccaaggagaaaaggtcggaagaaggtgacagcccaaaacctgtctgatggagacataaagctgctggtgaacattgtgcgagcttacgacattccagtgaggaagccggcagtgaggtgagagccctcccaacagcccgagatgcagtgtgcagcatcccagccaagtcaatcgctcc

SEQ ID NO: 110721 - DNA, 1016 bp, Homo sapiens
aaaccaggagaataagttctatttttacagggttatgagaattacagagactcatacaggctcttactgatcttctccatgtgttaggtccataaactagctgcagttcaataggacagaagaggtatatttaagctgagatttatgatgtgcctcaacaacacctataacatgatgttaaactccaatccaaggtgaagtccctgtagaagtacgtattactggtgttccactctggttggttccacagcatgctgatgctaaaggctccttttgagccatgggatttagagatcacatctgtatttggaatctataaacatgaattaaagttaagttgcctaaattgtttcacattcatccaggctgacagtggtttaaagtttggtattatactcctagtgacagattacatgtggatttatggatgttatgttacctgtcttgtagctcagctgcagctgctttgtctgagcgctggtaaattagctcttcaggctatagaagagaaaatagttcagaaagtataaaaatcacctacagttaatttgaacatccttttaaaaatcttaaaaatcaatgaaatctcagacatcgagatatagaaaataatataatgcatgctgatgtacccatgacccaccaaaagtaaaacatcataatatagttctttcccaatttcatttttcttctctcttaccacagaagtaaccatgacctgaatttgttttaacaccccttcattcaacaagtactgattgcctgctgtgtgctaggcactttcataggtgagagggatagggatttggctatgaaaaaaaattcctgtcttcattaacacaatgtgtttatgattttattacagatacatgtacccctaaacaacattttattgtttcacatgttttctaaactttacgtaattgttttatgaacatgcaacttgtgctttctcccttaactttatatttagtggcagcaacaaacatatttttagagggcttactaagattcat

SEQ ID NO: 110722 - DNA, 3294 bp, Homo sapiens
ctgactttaaagaaaacatacaggaagtcctcaaatagtgtcatttcattataatgatgcaaacaaaacaactacctttgttatacgttattttgcttagagtcgcagtttctaagaacctatcgatgttaagtgaggacttaatggtatagacattttgaaatatttgagggagttgcagtttggaaaaattgtatagagtcttcatgtctcttcttatttctttaaaaaaatttagaatggaattttaatctgataaaatgataatcagatccattttggcaaaacccagtgaatctggcatttcatgatggacctaagggtcagagcaggagaatggcagtgaggcagggcttgtgtcttgaggagaggcactaggtgattggtagacaaaacagtgggcagtgtaaggggtgaggaaagacaagctaagaaggggaataatggggattgggtggtgcacagtgggtaaagctggcattatattcaaaggaaaaacttggttaaagattggcagtgggagaagaatttcagatcatagggttgcttctcagggcatttttaataagtattcaatatatactaaaacattttatcttgagtttgtgattaagatgattaacattgtttcttattttaagggaaaataattttaacaaaatgctgctttgtgaattttaaatatttaacatatttaacttctcatttaaagaccagaaaagattgttattttgattaaataaaaattggctttagtaattcaactttatatttaaaataattttaaacttcctgttatggaaaaatttaacatcgaataatacaacgaatcctcatgtaccatcagcttcagcagttataaacctgtgggcagtctcctttcatctataccattgctcattcccatatctactccgccattaagctaatcacaggtgtcatatcaacttaaaaattaatatgactgaaagcataagctgttgtagttccacatatttgcgtaatgtttattagtttctttcctaagactgtatgtcttaagaaatttgccctttgtattttgtatgtgccatttggggaatataaggaaaagttaaatttctggaaattaatgtgttctatgtgtttagttggaagtaattgttatggtagtattagcttacttgcttttttgttgttgttgttgcagccgagtgctgttttagaaaataaaaagtaaatttaaaatgtgtttttgagttaagctagatatcaccccagagtactgtgatttttcagttacaatccatttgatatattctgcagtaaaattatatttcatgtacagttttcattttgtattgttccttatatcacaattgcaagtattttggttgttcttgttgatatgtaaagaacaaattaactactccttatttgttcatggtatagacataatgaaagacttcaatatagttgaaacaatcttttccacatttgcctgcttttatgaaaatatcattcattcagagtacttgacatttgaatatgtgctgtgaaacttcttctttgatattttctaattctcagctatgttccctaatgggtcttgtatctagtgcctgggtagcatagtgtgactgggataaaatgtcagttattccacagatttttttttattctttgtaagtgaatgataatttttactatggctacagtttaattgatcactcattatatatttaattttggaaaataatttcatctaaccctaccatatatagatatttttggctacaaatactaaataaaaatatggcaaatatattaaatctttgtctatatagtttattttgctttaaaatttgaagataatatttattgtaattgctcaatactgacttctttagctgatcgattatagttagggctgttttttgcctttattacatttctagggaggatgttcagattataagaatctttttataagttagcttggcaatcttgcttctgtggattgtctcatttccattttggatttttatattgtaagttgttgctaaaaattatttttttcccttcttccacttaccttttggaccatgaaggatatattaattaaagtcaagctgctattgagttttgtgtctgaataatttcttatacacttatcatgagatttacttctatcatataagtactgctagtaaaaccaatgaatgtttaactccttcataagcaaaattatttttatgtgatctctaagaaattcctcctttcacatttttctgttttcatacaggtcctcatgctgataccgccagtggatgccagaatttgcagtgtggttttcgagcctgctgccgctctggcgaatgacccttgacttctgatctttgtctacttcatttagctgagcaggctttctttcatgcactttactcatagcacatttcttgtgttaaccatccctttttgagcgtgacttgttttggccccatttcttacaacttcagaaatcttaatttaccagtgaattgtaatgttgtttctcttgcaaattatacttttggtttagaaagggattaggtcttttcaaaagggtgagaacagtcttacatttttcttttaaatgaaatgctttaaagaatgttggtaatgccatgtcatttaaagtatttcatagataattttgagttttaaagtccatggaggtgattggttctctttacacattaacactgtaccaagctttgcagatcttttccgacacacatgtctgaagacttattttcaaagacagcacatttttggaaactaatctcttttccgtaatatttcctttatttcaatgattctcagaaggccaattcaaacaaacccacatttaaggttctttaggattatagaataaattggcttctgagtgttagctcagtgagctaggaaagcaccaatcgatatttgtttcctttagggatactttgttctcaccactgtccctatgtcatcaaatttgggagagattttttaaaataccacaatcatttgaagaaatgtataaataaaatctactttgaggactttaccaagtaatactgttgtgttgtgatttttattataaatctcaatccaggtttactttagtatagaataggactacatactttgtctttggacctcccatgaacttattaccctgacaaatagttttagacagatactgaattttattgagctgaattttctttttgaaatgagttattcagtagtcaaaatttgaatccgtaagtatatctactttgctttgtt

SEQ ID NO: 110723 - DNA, 3928 bp, Homo sapiens
ctttctaactgttatgaataatgctactatgaacattcatgtgcaagtttttgtgtaaacatggttttaattctcttgggtatatacctgggacaggaattgctggatcatatgctaggtgtatctataattttttttttagaaactgcccaactgcttattaggttttaagcttcagtaattttcttgataatttttacttactaatacagttgggtaggagaatgaacattacaactccagggttcagtacttcctctaagaattgagttaccatgatgttcttataaagaacagttttatagatttctttattgaatgttgttaggaaaaatgttgaacattttctgagttaaatgtatttctgcctaaggatgaggttagttatcagtgttttacagaaattcttaaattttctcattaccatattgaaaagtatgtaaaatagtggttcagtgaaccataggaatacaaacatttttatagattagtatcttctaattgtcaaattatttttcttacagggttttgactctgggaggagggctgccttatttggagcaccttaatctctctggttgtcttactataactggtgcaggcctgcaggatttggtttcagcatgtccttctctgaatgatgaatacttttactactgtgacaacattaacggtaatgccttttaacagtgcgataattttgaaggaattaatttaaaattttttttagcagttctaataatttttccatttagttttctagatttctaattcccagactatcttactttcagatttagttaaatttgataaaattttaaaattacattttcattaattaacatcttgaaaggtaagtttttcttgcagatgtatattctaaatatccattgtgtcagatttttgagggatgtaatagtgtaatcaaaaatggtaagttaatagaaatactaaaattcttgttaaaagttttaggtattcctctagagttttgtagcactcattaagaatttagaactatttatgttctagatacactgatttcttagggataatagagtcttatttcttgtaagacagctttatcaaatgtagaaaaatgaggactttggtaatgtggacttccagagtttctggatctgatgacaactcttagcaaagattgaggggagaggacagtatgtagtattgagaagagtctgagatgctttagacatgactagaattcctgtagtattttggaaattgattcctgaacctactttcaaaaatcacaagaaatacttcttgattttgttcttttaaacatattctaccctacagtggtcttattgaacatgctttttcaaagtatgttcagtgcctttttgcacatttgatagtcactggtagagactgaatttcccagaagcataaaaagctgctcttctgttattagtaagcaaatcaacctcctgtatttataactggagaaaattttagatggctcagactactatgtacctgtctttttatactgcgccctattgtctttgagtgcccagttcaccttaagatgacaggaaaatcaacaaaatttttctcaggcagaacaattgacaggagtcaggaagaccagagggagtaatgacataccgcaaaatggagaaaactgctatttctcgagattaggttttccttaaaatatataagaggaaactggagatggtagctctcttatttcaggaatcacattgttatgcaggagatgacctcccatgttcttgatatatcagcactaagttggacatttctttgttttctgttgccttctgtgtataatcaaggaatggccaaagtgaatgtcatcatagttggtgaaagtgaatgtcatcgtagttggtgaaagtgaatgtcattgtagttgcaacatgctaagcctatgaaaacaaagtttgattgatgcagtgaagctgttacttttgtggatgctgtggatttgagaacggagttttgttaacataaagttattttattgtaggtttagtgctatacttccacttcctaaggcttataggacatattatcaagagtaattaataagcaattgttttttatcagaaaaaattttatttgtatgttgcatttgaatttttcatattgatttcagcataggttatgctttggaataaatctcactattgaattcattatatttatttttggattcatagatgttattgggtagagggaggggactgggtttcagtttgtttttatgcttacttgttttatgtttgtatgtttttaaactttgaaataatttagatgatgggataaaatgaaataattaaaatcttttgcactttgtccttatgcatttcctctaaacttgttttgaatatatagtttcagaggagctattatattccttttgttgaatgtaaaagtttttttggataaatgattgattttttaaaataaatgaattgtgatgaagatatctgactttgaaagatttgaaaggaaatttcagtgcttgtataatccaatattaactctccttttatagcttattgaagcatgatttgggggaatggaaagcctttaaaatttacagggtgacttgttaaataacttgtgtctgagttccacataggttgttcttaaagcaatgctctctcatagtcttttccttaaaaggatatgtggacaacctagaaagtgttagaaagaagttgtgttgtatccagttttgcaagatgacacttgttccagtatctttcaaaacagctcagcttgtacagtagatatctagtgaatgctcaggggcatccttgttactatttttattatttctgaaagtagtgtgttttaatacgtggtattagagcaatggagaagtgtatttaggtgacaaattatatttcaaatatttgaaagtgacgtttagctaaaaatatattttttaaaagaaaacatatatagttaactatcaggttactaaatgtaaaagaagttaatactgataaacattagtcattaagtaatacatgataagtaaagcagaatgatctattttccaagcattagcagagattttggagataataagttagttatcatatattcaaacagtgcccagtacagtgcaagacactgtacataaagtgtcttgatataaaatgcaagtctagattcttctgaatgattctttatgacttttaaatttatttgataagatttgaaaagtcttcttagccataacattaaaaaatttctttaacatttaagaagtgttaaatggaatagcatagttgtagagctgtgaagaacatttgagcaatgatagcaaataaacttttttactgatttgcatttcaatgtatgtataatttataaattaagatagattagctcatagttttggaggtgacacagtctcagatgatgtgctcttttatgtttctaatttaagttaaagaggaattaaaggtaagtgaaggtaagtgcagatatacagcataagtaatatacttagaactcagtaaaaacaagttattcaataataaaagtctggagaaataatagctaaccttatacttcctatcatctgatacttaaaaatgctttcttataagattattctttaccacgcatttaaatattttaatgattattcaattatatttttctattttctttattattccttaatgtaatttaggctttatatatcttaaccatttgggttctgtgtcctacatcgagatggaagtttgctggtgataagtcaaatatttaaagggaactaccttgtgaattatcttcgtctgttaaagcatagctgtctacctggcaatccatcatatcttagtcatatttctttctagttttccctcaccttttctgttgtccatttattctgttgtccatttattcacttctc

SEQ ID NO: 110724 - DNA, 1725 bp, Homo sapiens
gccaccttcttcccagagtatatctccttgaccaccaattctctgtattattgctcactccctctttcccacccaactatttatatcagcaccttttttcctgctgcagaggaagaggtatactcttctcgggctaaagctaatgctccatcttcctagagcttgtttcttatggatcttcctcattaaccgtcggttattctctttctttcatgtgtttgcagccttacttctgctgactacttttaggataataaacttaagtcttccaatccttacgcctctcaaatcctacccttctgttaggttaggaatactttgacttccttattactctcattgagtttttgtatccctagcatcaagaatagtaccttaacaatagataattcactaaatacttaagtgattatattagatgtcaaatctttcttctggttttcatctacatgcatatagtcaaatgcttttgaaaaatttaacaatattcattaatagtcttgtcttttaattatagttggtcttggcttggttgctgccagagtcttcggcatcttgatctgtctggttgtgagaaaatcacagatgtggccctagagaagatttccagagctcttggaattctgacatctcatcaaagtggctttttgaaaacatctacaagcaaaattacttcaactgcgtggaaaaataaagacattaccatgcagtccaccaagcagtatgcctgtttgcacgatttaactaacaagggcattggagaagaaatagataatgaacacccctggactaagcctgtttcttctgagaatttcacttctccttatgtgtggatgttagatgctgaagatttggctgatattgaagatactgtggaatggagacatagaaatgttgaaagtctttgtgtaatggaaacagcatccaactttagttgttccacctctggttgttttagtaaggacattgttggactaaggactagtgtctgttggcagcagcattgtgcttctccagcctttgcgtattgtggtcactcattttgttgtacaggaacagctttaagaactatgtcatcactcccagaatcttctgcaatgtgtagaaaagcagcaaggactagattgcctaggggaaaagacttaatttactttgggagtgaaaaatctgatcaagagactggacgtgtacttctgtttctcagtttatctggatgttatcagatcacagaccatggtctcaggtgagttatcagttccagaatattaagaaatagacgtgttctcatttccaaatggaatataaaaattttgatctaagtcattcttttcagttgatttacttagcaaaaaggattaaccaagatctgccctacttcagagttttggagcagtgtaacttctgttatcagtatgaagtttcatttctgtcagttcaaatccattgtgatgtatggaagaacataaattctaaagtttaataaatacttagtaaatggctacatcacatattttaaggtactttagtggatgaagaaggtacaatttttactctcaagaacatgtaacaagaaaatatgcatattctgttgctgtgtattatttctgtatgttatagttttatactgagggttttggaaaacgtaggctgtccctggaagtcatttagtctgactacacggctgttaagtgtttacaaaagccaaagctgagctagagtttcata

SEQ ID NO: 110725 - DNA, 1040 bp, Homo sapiens
tgctcatttttagcttcttagaaattctaaagtaccttcctttgcttgattcattatgatcaggctaatttagttgagtttcaaatcttttctagctttgtgccctttttagttatgtggaatcagtgatagtacgttttactatggatcatttttcttttgatatcatattttcttttctcttgaaaacttttgctgttcttttcagttttcacatttttttccaaaaccttttcattgcctaaaaatgggatggtttacataagaaagtataaggatagcacaaagtatgtcatatttaacaatttggtgagcgcttgagtagcttaattattatcagtttatcaagttcttggacttttgaattcattttacagaagagtctgcggaggaatcaattgctatcagcattgcacaaatggaaaaacgtttactccatggcttaattcataacgttctaccatatgttggtacttctgtaaaaaccttagtattagcatacagctctgcagtttccagcaaaatggtatgtttaaattaacactagtttgggtattaagaaaaacagcatgataagagtttggtttgctcattcctgagtttaattaaggggaaacaaacccaaaaatgattattgagtgccttcctatgggtaggcatacactgctaggttacttattatttcattgcagttctcacaacaatctttgtagcataattatcattacctatatgttacagatgaggaaactgactagaagaggttaaacattttattcagtttcacagatgttaagtgataaagcccagttttatgtgattttttaaataatatgtaaggcatggtaagatgggcaaatgagatgaaatcactgttttataaaagtggatattacgacttcctacatcagaatcttgagtgttccttaaaaatgtaaaaatcctggtttagtctcataactgctaaaacagatacttgggcgggtgcggtggctcatgcctgtaatcccagcactttgggagaccgaggtgggtggatc

SEQ ID NO: 110726 - DNA, 1967 bp, Homo sapiens
gcacatatacaccatgtaatactatgcagccataaaaaatgatgagttcatgtcctttgcagggacatggatgaagctggaaaccatcagtcttagcaaactgtcacaaggacagaaaaccaaataccgcatgttctcactcatagttgggaattgaacaaagagaacacttggacacagggtggggaacgtcacacactaggtcctgtggtgggggtaggggactgggggagggatagcattaggagaaatacctgatgtaaatgatgagttgatgggtgcagcaaaccaacatggcacatatatacctatgtaacaaacttgcacgttgtgcacatgtaccgtagaacttaaaagtattaaaaaaaaacagttgcttattgcctagggctcagatgttttctctttgtagagatttttatcgtaaatagcttagtttttcataattgcaggcaatctgatattattttgaaccttttacttgtttattcattgagtaggtgactggtatagtggtcccgcaactgaacttgatactgaacctgatgatgaatgggtgaaaaataggaaagatgaaagtcgtgcttttcatgagtgggatgaagatgctgacattgatgaatctggtaagcttgtttggaattaaaattattacatagtgttttaataattgataattaagtacttataattattaggtattagatttatgtattttgtgttttctaaagaaactggtgtttctaagcctactactttttaaaatttgaaggaataataatgaaattttaaattaattgaagtactttaaagagtgcataggattatttctcgtttttatattaaaatcaaaaatcagaaaatggtaccttttttcttatgaaaataatgtacgtttattatagtgctttgtagtttacaatgtgattttagcaccacttcaagtgatcagttgcacagcatctattgagtcatctatggcttgagggaaataggatgaaactgttgagtcgacttactcgtttgtagatagtcttaatacttgcctaataaggttattgtagaattaagaagtaatatacataaatattgtttgtaaatggtaagggattacaaaaactaatgtagccattcattaaacactgtgggagagttcaaggatggataagacttcatcgctactccaaacaactcacaaatgagagagaatttagaaaacataatttttaatttaaagtatatgatggaaaaatgctgtcatacttgtgcagagagatgctatttggaagtgtgaggaggaaaacaaattctgtcttggatattctagataataattattaaaagatggtaaaatagtaaaaaatgaacagatgagacattcttctagttggtaaaactgaaactataggaaattttatttataaagttacttgcttaaagtaatttggtctggcgaaagaattaaatgtggaaaaaagacacgtggaaagtaacagtgtaagtataaagattgttgtatcagcagctaaagtagtttatttttatgaaacgcagatgtgccacattttgatgtaaagattcaaaatgtcctatataaggaaaaggtctattctagtttgatagatttggtgatgtgcttacctgtggcaggcattgttttaggtatgaaggatctaatggtgaacaaaatggaaaaaagcaaaacaaaactggcgcttgttgagcttaaaatttagagacaggaggcaaacaataaatacaggtaaaatatattccatattagatggtgacaagtgttgtagagaaaaataagacaaggaaaacatgccaagaagaatttaaaattgcagttttaaattgagcgattagttaaggtcctttgggaaatttgagtaaagacctgaaggagatgagatatttgctcagatgtcaacttaaggaagtctcagtttattcattctagaaaa

SEQ ID NO: 110727 - DNA, 1057 bp, Homo sapiens
catattggcatctagtaggtagaggccagggttgttgctaagcaccctataatccacaggacagcacccaaaaacagttacccagcccaaaatgtcagtattgtcaaggttgagaagccttaatttagatgtaatgttaagagttcagtaaattggccaggcacggtggctcacgcctgtaatctcctagcactttgggaggcaaaggcaggcagattgcctgagctcaggagttcgagatcaccccgggcaacaaggtgaaacgctctgtctactaaaatacaaatacaaataaattagccaggtgtggaggtgcattcctgttatcccagctacttggaggctgaggcacaagaatcacttcagtccaggaggcagagtttgcagtgagcggagactgtgccattgcactccagcctgggcggcagagtgagactctgtctccagaaaaatgagttcagtaaattgattccgcataatctctcatttcatgatcatataatttagttgcagtacattctccaggatctataaatttatagtttagctttacattaatctttccctttgcttctgttcccatctacttctgaactgctgactggttgactacagagtagacaatcctgcttccttttagttattagctgttatcataatgaggctattgtgggaaccagtgtgaaatgacagcaggggaaattgtttgctcatcgtgatttctaaaattttatgcaagacttgataatcattaagcttatttctataaaaaagttgaaaaactttttgtatagaaagtagatacatagcaggtacatagcagactctgtacatttttgtagttattattctgtttccatagtttgaaagagaaagatttactttgggaaaatatgaactttggttaattgattattatcgttaatcgaacccacctgtcatagttcttctcagtgtgtctgaaatggaatcctttgcttatttcagtgtaactttttttaaccataattaaatatttctaaaaaattgcccattgcctgggcaaaaactggaagca

SEQ ID NO: 110728 - DNA, 2920 bp, Homo sapiens
tatgttgatcaggttggtctcgaactcccgacctcaggtgacctacccgccttggcttcccaaagttctgggattacaggtgttagccaccgcgcctggccaggatcttcttggtgtactcttctctgcaatttttagataaactaactcagtggtgacagctaaaatttttatctttttgagatatatggtcataatacgacattcgagccattaataatttaaaagggtttagagtaaatcaacacgaatgaagcatctttcctcgtgaatattttgtttaatttaggtttttcagcccatgttaatggaatattttacctatgaagagcttaaggatattaaaaagaaagtgattgcacaacactgctctcagaaggatactgcagaactccttagaggtcttagcctatggaatcatgctgaagagcgacagaagttttttaaatattccgtggatgaaaagtcagataaaggtgagattcatatatataaagaacaatttattagttgtaaggtcattgacatcttactgatatgaactgtagattttggttgaggaataattcaagttaggcctgcactgtggtcagttaaaggcattattttcatgtatcaatttaattgaagacgatggttctcattttagaatttagtgttgtgcatgataatttaacatatacttgggacatattcagtgtagtgtttcttgaataaatttatatatgaatgaatcaaaattattgaaaaccaccagtacagagcactggcctgctcaaaatcgatcagtcaaaattgttgaaaactaccattacacagagcacttttgcgatatcatcctgcttcctgagctttattgaccatagtggctgcttttctctttccttgtgtttttttcattggttttcaaaattagttatgtttatagtttattttcatcctttcctatgtattattttttcagcttgtatccagtaatattcagaggaatgagtactagaggcagagtttttctgtattgttactctgagaatacaaatgagaaatgcaaataaaacgtgctgcctttttttttttttttaaaaaaactagttcctcagtaattatttatgttcagtagctttgcttcttcaagattagtggcagcagtgggatttctgttaaaatagcttggagttttttgaaattggtccttttatttttatttaacaaagtaggtgaaatgcatgttgaaactaaaataattttacaagttaagctataattaatcccgtaaagcttatatgccttactatgaaatgtagcttgtgctttagataccaagctaagacttgttatgtctggtttaattgtaattataacatgggatttaaaagcatcacacttattacattttattttcccactccttcaaagcaaattgtagctgtattatatttaaaatatttggcagtttaaaagtggtagtttaaagaatgtgatcatagcatttctatatttaagttgctttgtgaaacaaatcagatatataaagtactcaaattcttcataggactttagtgatgaatcttttatattttttattgtaacacttcattttcatttttattttggaaattattactgaaataatacattataggtttatacatccataagtacttcctgcaatagttgctgacaaaagtttcattatcaatgtgaaagaacatcagaaatatctacattttgtcgtctcacctgcaacataaataactgaagtagtttaaagcatctctaggttaaggcagtcagatttcgcagacctcttgtatgaaatgtgaaaatcaaagagggaatacaagcaagattattgacaggagtcataatgcataaatggaaaaggtcatgagatttgtgtgtgtcattaaaaatgccttggagatctcataatctggctgactctatacttgttgatttaaagctgtataacctgttttgttcctttttcaagtgatgctgcttaatgctacaaagtgagtattgttttttctgtgatgcctttgtaagaggaagttaattctgtgttcattattgtagctcccactgatgaagtatgatttgggccatgatagtttaaccctactggttcttcacaagtttaacatccccatgttacctctaatacatgttatttcattttcacatcttgcaagcaggaaggaattgacttcaggcactggattttgtttatagaaatgtaattgtaatttcttattgcatatgctctttagcctttactggtaaagtttttcttttttatttcagaagcagaagtgtcagaacactccacaggtataacccatcttcctcctgaggtaatgctgtcaattttcagctatcttaatcctcaagagttatgtcgatgcagtcaagtaagcatgaaatggtctcagctgacaaaaacgggatcgctttggaaacatctttaccctgttcattgggccagaggtaggtaaatgggtttttaaaatattttcatgtatttttctagatgaatattcatttacattaatgagcaaggccagagagagaaactctgagaggtcaatcaaaaagtagattttatagttagatgatgttttggtggtatatatttttggaaaactagcagtgatgaaattcatgggtaaattataatgatgtctgtaattaaaaaaaattaggaaaatatatttgtgggaggggatgcaaaaagattgacaaaattgataattattgaagataagtgatagatacatggggattcattatactagttctgcttttgactgtttttcagaattaaaagttaaaaattcaattagtaagctttcaaaactgctttaaataattatgtttaataataattatatgaatatttttaaaatacagaataaat

SEQ ID NO: 110729 - DNA, 1050 bp, Homo sapiens
tggtgttagtagcttttcccctttcatctacccgtctgttgtatttaacctaatcaagtttccctctttaaaatttctgcctgcctgtatttagcatacatatagagtaatgaaattttaggtttagaaggggcctggtttaatctcttctctttaaagaaaccgtgatttgtgcacatatcatttttctgtgtcaccaggccctccagaatgcaaaccaacatcttcctggcctagtgcactttttattataccattataacttgttaatttatgaatttcttttatttgtactttaaccaagtgtaagggaagtatgctgtgtgcaaaagtgaatagggatgtatttgaatattttttatttgtgcatatttgcacgtatttattacacttttctttttaaatttttattcagctttctaaaaccaatttttccaacaacaacgatttccgtgctcttctgcagtctttgtatgctactttcaaggagttcaaaatgcatgagcagattgaaaatgaatacattattggtttgcttcaacaacgcagccagaccatttataatgtacattctgacaataaactctccgagatgcttagcctctttgaaaagggactgaagaatgttaaggtaagttgcaaaaatggatattcaactgtcaaaacttgtgccatcttctggtatatcattggcaaaacttgtcactgttttatagtaaatgatgtaatgttgaaaaaaattattttgtcacttgttaaagatggcaaggaagactatttaaaaagaactactgcagtggggagtttgcagtagtggagagagatcagtcccgacggtgaatacagtaaggacaagtagggatttatatccaaggggcaaagtgggaagagtggatggaaaactactgaggaaacatcaaggccaaggggattcttgctagactaactataaaattcttgctgaaggcaagaggatagtaacatattgaaggatcagtagtttgattagatgtagatgcagatcagatactaaggctgagagatttttca

SEQ ID NO: 110730 - DNA, 1070 bp, Homo sapiens
tactttttgccattaaaaaaataatatctagaagctggaaaccatcattctcagcaaactgtcgcaaggacaaaaaaaccaaacaccgcatgttctcactcatagtgggaattgaacaatgagaacaacatggacgtgggaaggggaacatcacacaccggggcctgttgtggggtggggggagggggagggatagcattgggagatatacctaatgttagatgacgggttaatgggtgcagcacaccaacatggcacatgtatacatatgtaacaaacctgcacgttgtgcacatgtacctaaaacttaaagtataataataataataataaaaaatatttagcattaatggtttcttttgattttgtaccctgcttctactaaggctatttttaagtttgcctttttttttttttccaaaaaatgatacatgatagtgtttgcagagattagccaccaatagattttattgtaatcttgtggggcatttcttatgatttaaaaaaaaatctataatatgtatttaaccaagtatgtcctgcctgtgttttttgtgtggcttaagagccaagcatcacttttacatttttaaatagttggaaaaaatcaaaagaagaatagtattttgtgacatgtgaaaaattatatgaaatttgaatttcagtgtttataaagttttatggaaatacagctacagtcattcatttacatgttgtctatgactacttttgtgctacaactgctgaggtaaataattgctacagaccacatggcctgcaaaagttaaaatatttattacctgtccttttatagaaaagttgccaattcttgctctagattatttacttatgtattgcagttaactgttcattgtcttatttaccttcactgaaatggaaactccataaaggcaagaaatctttgttttgttcattgatatatcccaggtaccaaagaacagtgcctgcctcatcatagctactcagtaaatatttgtatagagtaaaaaatgtatgaatttataaaaaatgaatatttaattttcaaaatgataatagctaatgtttat

SEQ ID NO: 110731 - DNA, 1059 bp, Homo sapiens
ctggattgcactatatttcatactgaaggtcatggttaacagtatttgaaaaacagttttctagagcaacatttcttaaccaaagcattattgacattttgaggcagatgatttcttttttatgggggctgtcctgtgcgttgtaggatgtttagccacatccctgggttttatccactaggtgtcagtagtacatttccggtggtgacaaccaaaactgcctccagatcttgccttttatctctgggggatgggtagtggggtggcaaaattactgccttggtgagagctgttgctttagagcaagtgttctttctgacaatttactctcttgtatctgaaaagatagctttattaatgggactaacattgtgtatgtagaaaagtcatagatgttagagttttagggacttggtctcggttttgttgttcactagttgtatgatgtggggtaaattttcttcctgagactctgtttgttagtctgtaaaatgaggattttgatatctactttttaggttgttttaagaattaaatatataaaaacactagggtaatttctcacacatcattggcttccttccgtatgtcctagaaccattagtgtccaggttttttttctccataaagtctatatgtgaaggcaaacaattttaaaaactatttatataaacagatttcaaaaaagttaaattgtgtatattctgtttattcttttctttctttctttttttttttttttttttgagacgtagtcttgccctgtctccaggctggagtgcagtggtgtgatcttggctcactgcaacctctgcctcccgggttcaagcaattcttctgcctcagcctcctgagtagctgggtctacaggcgtgtgctaaccacgcccaactaatttttgtagttttagtagaggttagcagagatggggtttcaccatgttggcctagatctcttaaccttgtgatccgcctgcctcggcctcccaaagtgctgggattacaggcgtgaaccactgtgcccggccctggttattcttttaactgctaaatttactaa

SEQ ID NO: 110732 - DNA, 1856 bp, Homo sapiens
gagttatgtaaagacaaggtatttctgttttatagctggggacttagaggcctagattagctaggccaaggttacataagcagctagtggtagattcagatggaaacccaagtcattgttaggattcctagtttaattttctttatattaaatcatagtagtttcttacttttttgggaacaatctgctaagaaatctcctgctaattcactgacctttcagactgggatgatgttagtaaatatttatattgaatgacatcctttttccattttacttcaatttctcagtcttttctccagttctccaaggttaactccattaattctgtcagtgagcattggagtttctaccgtctactctgtagtagcttgtactacagaaagacgttggcaatgtgacatgtggtctctagtctcaaaaagtttacagtccagtatgtaataacatctatgctaggatggaaatccaaatagggtatagtgggagcaaagggagttacacggtcagctccacattaaagtgtcaggagtggtctctttgaattgatttctgagagaagagtaggctgtggttgtcaggatgtggttagttcagagattcccaggcttatatataaaccagttattaaaaactcaagtggtggaggccttaaggtgtgcccaaatttttcaggtaagggtattaaaagtgctgtttacttttatgaaagaatttatttatacatttatttatacagataggacattttatgacccaaaactcttaagtgggaagaagcttagagtaatttgaatatatccttttttaaaaaatgagtgagtatagctttattgtcagttttccttcccccctccgccatttttctgcatacctgtaacaatttattgactggcatttgagaagattggcttagtggagaaaatattgaattgagacctgtggaagaaggaaaagggaatttaatgagttcttactacatgtctacattgtttcttttaatcttcacgaactacttaagccaaatattatccttcatttaaagttgaggaaacagtcttagtggttaagtaacttacccaactcattcaattagtaattagtagagcctgaattttaatcttaggattttttttccccttcggaagcccatgggttttgcattaccttactagttctgctacttattggtagctctatgattttatgcaaaacagtttacctgtgggtcatcattttttccatctgtaaatttgatcagctacttactaaggtttcttcactgagtataagtctcccttgattaaattaaagcattgtctgagtgagtagacaaagtaaaaatgtatttgggggaataatatatgtgtttttgttatgccgttttcttatctatttttgaatgtactgtatcgtctttaagtgacataccacttttgagaatcagtttgaaaccaggctgtaatacttgatttatcactgtagaatgtctgagacagaaagtcagttataggttgggtgcagtggctcatgcctgtatcccagcactttgggaggccgaggcaggtggatcatgaggtcaggagttcaagaccagcctggccaagatggtgaaacctcatctctactaaaaatacaaaaattagctgggcatggtggcggggtcctgtaatcccagctactcaggaggctaaggcagaattgctggaattggcgattgcactccagcctgggcgacagagtgagactctgtctcaaaaaaaaaaaaaaaaaaaaaaaagaaagtcagttataaatccttttaaaatgtggaagatatcatgttactatttgttaattatgtgcgtccttttata

SEQ ID NO: 110733 - DNA, 1053 bp, Homo sapiens
tccactttagactgtggagaggtagcctaggatcacctgaaattatatggaaaattttgtgcgtgtgtccattttcctagggtgtttgtagctttcatcgatttccagatgattgtgacctcccaaaataaagaatcacaatttaatttacttgcagactaaggctaagcagccttattttaaaattttcaagaagttagtcgctctttttctgtctcttcctggtggttgagagtatttgaacaaattttgaaaatgcagttgcttttttacaagatatctgagccaagagtcttttcagtaatgttcccacttgcataactagtttaataaagcattttcaatttgacatggtgtaagtcaaaattattactaattctgaattaattagatatagttaatgagattgttgtatacgtttatcacgaagattaaaagtccaattttctgaactgaaactgaggcgatttagggaaaaaaaaatgcataggaattttacatctggatttcttcttgatactgatagccaatggaaatctctcttaggatgtcctttgggagctagagtggaaaataagtattttgtaatggttcagtaatcttaaaggaattaaaggaagagtaccttgtttgtttttatccatttatcatctcacgttttgccatcctttggttgtatagaccaaggatatccaaccaaacagtttacaataaaactatataaaatgagaactagtttttatgctcagactaaaaaggtacaaaatagttatttcactgtacaaatttgggctctgaatgcccagttattatcaagaagtcagttactattttcaatattgaacttctcaagtagaatgtattttagaagcatccatttatttactagcatcaagtaaaccacttatatgcttaagccagttagtataatgtattccaaagttatgttagtctacttattttttaggtataaaggtgaataggatgagaaaataaattttcaaaagctgacagatgtatgtcttagaccattttaaatattgctgtacaata

SEQ ID NO: 110734 - DNA, 1145 bp, Homo sapiens
gcccgccccgtcggcgcgcgcgcccggtcggcttggccggcggggacgcgggggcgcgcaggccgccgccatgcgatccctgcggcccacgtgaccgggcgcgcgcagaggctcgcggcttctgcctcccgcccccactcttttcgttttttgtcgtcttcataagccgcagaaggaacccaaaccttttccctgtttctttcactacatgaaagcacagtagctgagggtaggggaaagtcgttgcagtggcgctctcggcgcttctcccgttgctgccctgcccaccacggccttgaggagaggcagccaagcacaatggccgcggtcagggccgcgagctctgcttgtgcccacgccccgacgcctgcttggcctgggtgaccaatgcttctggccaggacctccggagctgcccttcgcctccctgcgattggcccgtgccagatttttcctggggccgagcgcagaccaccccggccgccactcaaaggccgggcctggctcccacccagcggttggtgaaccagagctgcgggctctgagagcttcggtcccgggcggcagcccacagcgggcgcggggcctgggtgcgaggggcggggcagagaccgcgagagagagttctcgtgaaattcgggagactcaacgtgggggaaaaacagtatctggggatccaggtgcggaaatgcacctcaagtgcaggaacgcgggtcagggataggcccgacgggccttgggggtggggagaagggtgaataatggaaggttggtgcgggaaagaaccttggtacaaatcccgccattttaagcggaggttcggagagaaaacaaggtcactaacccaggaaaatgtctgcctctttcccataaatcgcctggccctggccacagacctcctggagactctgttctctgctcacgccggtcagtcttagattggttggctggagtactgctggacagatagagaaataggagaaaacagggaagcctgagaaccttgggaggaattgttatttgcttaatggccagaacctccaggagggcaagaaccagatatgctgtgttcacccttgttctctattatctatcacagttgcaagacaacatggggatcagtaaatagtcaacaaataatggag

SEQ ID NO: 110735 - DNA, 1015 bp, Homo sapiens
tggagagcttttctgtaaaatgaaatcgagaaataaagccatagctagaggatgctgggcagtcaggagagaatattttgttctaagttgagattatcacagtatgtttgtaggatgctgggatgacccagtaggcaggcgacaattggcaattgctccagtaatttcccttgacctgctgagctcaagcgatcatcctgcctcagtctcccgagtagctgggactacaggcacgcaccaccatgggcctggttaattttttgcagttatttatttatttatttttgtagaggcagggtttcaccatgttgcccaagctggtcttgaactcctggactcatatattggtgagaggtatccgaagcacaggtgagagtgtgggtaggagctccaccacctcacagaagaaagatggaaaacacagctttgggggttgggaggttcatggatttggtgatgatgatgtggatgtacttttctgctgcttttcagtgaaatgagaagaaaaggtcatcttctgagagttggtggggtgctggtagacctggaaggagaccaggagagcaaatggactgtgggttctcagggtatcatcaagtggtcaggaattttttaaaaggtcggttagtaggttgcgttcttttgcccagccactccccactgtttaaacagaagggtgaaagtgagcagagttggatttgacagggttggggtttgctgtgtgtatttgtgttctagggttgccataacaaagtgccacaatggggtggcttaagcaacagaaatgtattgactcacaggtctggaggctagaagtccaagatcaaggcgtcaccaggctgatttcttctgaggcctctctccttggcttgtaagtggctgtcttctcactctgtctgcacgtggtcttcccggtgaactcctctgtgtccaattttcctgtttttataagaacaccagtcatagtgaatttgagctcactttaattaccccattttaacttaattaccttttt

SEQ ID NO: 110736 - DNA, 1034 bp, Homo sapiens
ccctgagcccagcccctcgccgggctgcagcccaccctcggcgcgctcagcccgcttcaccgcttcagggacggaatagaactcgcagatgcagggtgtcgctgacattttcaactttttctgcggtttccgcccgctgtctctgacccgaaagtgcccccggacggttacagaggacacttaagtggtttgcaaagcctgtggtaggggaggagggtgtagaagggccaaaccacggaacttagttttattcatttatataaagcagcactccgattctttttgcgcggcctgaaatgcatgtgaccagagaagtaattaacaaaacaatgtcaacttctaaaaccgagacattacttagatgataaggcgcagcaactcggtgaatctgtacaaaccttggaaaaaaaacacattagtctatgggaccttccagttttctcatgctcctttccagctactaacctctcctaaagggaacaaccactttttggatttgattcccaggcctcgctttcaccgggaaattatcgttgcttgtaaaacagaagaagccgggaaggcaggcagggggagctgctactttacactctgtgctttgggatagcaaaatcccgcatttaagcaatccgaggaaacgagcaaatagacctccctcgcctctccgagcacactcaacagttccggttgcaaaatgtttgcctcctgggcttcccagcgtcccgttagttgttctatttacacataattagatacttaatggagagagaaactagaagttgaggcgttcctccaggctgtattgtaaagtatgaagtgaaatccaaaatgaaatggtaatgttagaaagcaacctcattaaaaaaaaaaaaagtaacactggtcttgaagatctttcaatgtgagtacataaagatctatctcatttcttttgacagcccatagtatttcataaactagatgtaaccatttcctattgacaggaaattagcttgtttccaatttttcaatcccattcattcatccaacaagta

SEQ ID NO: 110737 - DNA, 1020 bp, Homo sapiens
acagagatgtcccccagggagcacatcaaaggcaaagagaccaccccctctagcctagcagtgacccagaccatggccaccaaagctcccgagtgtgtggaggacccagatatggcaaaccagaggaagactgccctggagttctgtggagagacttggagctctctctgcacattcttcctcagcatagtgcaggacacgtcatgctaatgaggtcaaaagagaacgggttcccttaagagatgtcatgtcgtaagtccctctgtatactttaaagctctctacagtccccccaaaatatgaacttttgtgcttagtgagtgcaacgaaatatttaaacaagttttgtattttttgcttttgtgttttggaatttgccttatttttcttggatgcgatgttcagaggctgtttcctgcagcatgtatttccatggcccacacagctatgtgtttgagcagcgaagagtctttgagctgaatgagccagagtgataatttcagtgcaacgaactttctgctgaattaatggtaataaaactctgggtgtttttcagaaatacattcaaacattgcttggttttctctgtgtctggtcccaaataaactcattaagtagtccccatatatcaatggaaaaacaatctaaacaggaacttccagttccccacccttcgcaagttatctctttctggaatccttctttataattgtatccattggtcagtggtgtttggtgtttattgaagtataataactaggatccctgttttcaggtgggacacctggtatataatgtgattaaatcatttgtcagggactcatagatggtaagagggccggtaggattggaacccaggagctctgacagctgagtctacagggttgaggaacctccgctactgattcatgtcagagctgcccattccctcccccacccgaaagaccccggccttgcaaagctcaattctggagaagaaatgagtttcattccttcattcttcattcttggagaagaaag

SEQ ID NO: 110738 - DNA, 1245 bp, Homo sapiens
ggtttttagaaagatgaaatgaatcctaacaatgtgcgtagcacttcacacagtgcctggtccacatgacattctcaaattgttttaaagaacaaaatgacaactcatttttaaaaattccaaaaaaaaaaaaaaaaaaaaaaaatcccccaaacaactgtttttcccatttcttatcttcaaacatttaattcttctgatttttttttcctagaatttgttttggtttggcataggaaaagctactgtatttttacttccggctctaatttttgcggtaaaactggctaagtactatcgtcgaatggattcggaggacgtgtacgatgagtaagtatgtgggcttccacagacgtgggggtcattttctaggtggtgctgtcttcaaagagttgctaaagatgagttctgatgaggttaaagttgatttctttttttttttttttttagtagtagttgggtcacttctgttcaggtgaatttttttttcttggtactgatttttctatacttgttttaactacttttttcctcttgcttaatcctctcagcttccctaaccagcctttttatttcttgtttgcagttcctctctctcggggacctggcatttcactttatgataactgtttttacactttccattttggctctgtagtctgcccctcattctgtgtctggtgaatgtgtatgccttgtttttcacttcacttatctttcaacatgggtctttcctgagtttgcactgtcagtatccgtgttagagtaaatatttgggggatgtagttgctgagctttcataataattaaaaaaattaattttatctcccttttttgtattttatagtgttgaaactatacccatgaaaaagtaagcctttttaaaaaaactatattcctagatgggatgggggaggttgatattattatgtaatggactttaaaaattaagttattaacatcttaaaattatgtagaaacagcagatctgtacaggcaaaaataaattgcaatggtcttaaaaagagggttggcacatagagggtgctcaagaaatacttgatgaattaatgaaattttatatgttaagtttattaatctataaagtagtcctttggtctttgaagtttaaaaggagcaaaatgtcaattactcatttgtcttttttttagatttaacaaattgttacatacttttcatgaccattacattgtctttgtaatccatgatgtaaatacttcatct

SEQ ID NO: 110739 - DNA, 1003 bp, Homo sapiens
ggttgatcccgccagctatattctcaatcccattcctttccctgatcctgataaaatggatcatcccctttcttttccatgtctttattctcttcctgtctccttgactttcactcaatacttaaccaggctctgttctctcccttcttcagaaataaaagcagaaactctttacccacactgcctcttccctatagctctccttcccccacacaggctctcagaggagtgatctgcgcttgctgcctgtgccctcctctcctgctgactctccggtccactccgatgtggtttcctcccccatgactgcacttgtttcaagttggcagtgacctctctgtgcaatgcagacagcacattggttggtgacagccgaccattccttcctcctgcaaacactccttttgtcccctaggtggcatcacacccacatagttaccttcctacttctctgcctcatcatcttggtctggtttgctggcccctccttccaccacccatctttgtaaatgttgaagtcttccagacccagccctaggctgtttctctctccaagccagccctggggataaatgaccatggctaagctgctggctccctaaggtacatccgaaacccagatatctgagctccaaacatactgactcctacacagtctttccattcagtgtctctggcaacaagaccaacatccagcccatcttctctttccttccagagcatcagcgctccctggcactgcccttggagcccttccttgcctctacctctcgtgttcagcgctttccgagtcctgctgcctcctatattatgcctcctgtgtctcctatattacatctccatcatccaccaactctccaccaatcctgcccccttaggccaccctcatgggccatgataacagcctctgcaatgatgtcccatccacgttggcacctgtccagtctatcctttacactgtgccaagagtgcttgcgttcagagagaagtcgggttgtgctcc

SEQ ID NO: 110740 - DNA, 1046 bp, Homo sapiens
cacagtagtgatattatgttcttggacatcatgtgggaggcatatgatgttcgtcccagtattggtaggagctagagaacttcaaatccatatataatactgtaagtggaaaaacgattccagattactcactaatataaccactgactacattgcttttaaaagtgactttaaaaaggttgtttacaattttattggaccatctttagtatttgaagttgtgaagtcatatatattacatttgtgttacatttctttgcctcttttttttagctggttacagcaagagacctccagacatcaaaaaattagtgcttgtcaaggagggtctgagctgtgtttttccgaaataaaactctattgttcaaaagaaactgcgattgtaccctgtagtatagatgctttgggacttggaatatacaatgacttctttcttcatgaggaattgttttgaaggtaacaaccttgtcttatattttgttttataaattttcagcttccacccgtggatgcagaacttgacaacgttaataacgttcttaggacagatttggatggcctggtccaacaggtatgcttttggaaaaaatacaatcactgattttatatcattttaaagggtggactagtacataagaaaataggaaatagcaaaaaagcagtgaaattctagagaaaggttgccaagaagggtgatagctattaccttccaggcaattgtgttcatccttccagttcccagaatttttgttaagcatctatgatgtgtgaagtggcatgctaagaccatgagagatcaagaagaacatgacctctgctttcctaggcctcagaatttagtgggtgtgatgttgaaccccacactgattctgatacaaaatgctgtccccctctgccagtgagtcagctatactggttttctttttgctcttacccaccttcacgcatttgcacatgctcttccctctgcttggcactctcttcttttcccctctccaagtagctagctacttagttgtttttttgttttgttttgttttgttttt

SEQ ID NO: 110741 - DNA, 1092 bp, Homo sapiens
acacatgcatatgttcacacaggagggtgtgtacacacattcacatgaggacaggaatgggactggatcatgcatgctgccttataacctttttgcacctatttcctccacaatttgttgtgaacattgttccattgacgagagtcattttgaacagaatggaaatttgcctcctctgagaggactgagtcctgttttgtagcccctacgtgggtggtggtttgactgtgggatggcggtgggaaggatgtgggaggagagggcagcgggagaggaaaggccagtccttctgcgggctcctccctgactcctgctctgctgcctggacctggacaaagaaccatggaccacacagtaaatgctctttcttctctctgccttttcctgcagcattggcatcttctatggttttgtggcaaatcaccaggtaagaacccggatcaaaaggagtcggaaactggcagatagcaatttcaaggacttgcgaactctcttgaatgaaactccagaggtaaaaaccatcatctctatgtaccgcgatgctttatatttttggttttttggagttcctgtgtatatttggaatctcaatcaaaccttctagaaacacagtgaatcagcgtagactggtgttatctgttaatgtcctggatgaataaataaagccctggaaagtgattttcaagagtacaaaagccgaatttcagaattggtgtttttattttattgagatataacttaacattacagtacatattatagaaggacttaacacttttaaggttcttatgattttttaaaaaaatgaaagtttttgggccttattatcctttctttttggcagtatagttaactttccatcacttgtacaaagttactcttgtaatgaaaccatccagctttataaacatccatttgctaatgtctgcatagatatatcgaattccttgggaaggacacacaagcagtctctatcacacacacacacatacacacacacacgtacacatactcacggacacacaaattgtctttagagaagggcaatgggatggttgaaggttggggatgggagaggaagtaccctttctt

SEQ ID NO: 110742 - DNA, 1669 bp, Homo sapiens
cctggcagggtctttgtgcttgacttggtattagatttggcactcccataaccttggtttatacccctggctcctgctctctttccttgcctttgcaaatgaataaaaactctgggtgggggtgcagtggagagaagatgcagaactgagcccacatgaatgagctgattcctactctagatgtggaactggaccatgctttctaccattatccaaagaaagaggttaattaaacaaaggcaccaaaggatccaggccacatctagaggagggctttctgactagatttagtctgataaaggctgagtgtgttgggttggttccccctgaagcagaccctacaccaatgactccagggcaagtcgtttatttgggaggctcagggaacacagattcctggtcttacccatatcttctgactcatgtgctgtagcagaggagcccaggagtcaatgtttttctttaacacacactgtgaggtgcttctttgtgtctggtgagcttgggagcttgtgccctggttggtaacaagcctgcgtgccccttccccaagaaagggagaccgggatcatttaaaatgccctgtgtgaccccagaggcaggtatatctgaactgccccccagtcccagtattttggatgcctcatttaaaagtgattcccatcacaaatggtgttccctcagagctgtgaagatctgccagctgaggcaatagtttctacacttttagatttcctggaccagaatatttcaaaaaagtgatctagaaaatgacatagagccacctaattttattttgccacgaaaggacatttaaaatcaaacattgagatgtttggaataaaaatggtgggaatccgttgatcgctttaagcatgggaataacaccatcagatttttattttagaaaagggcacttgggaagatgctgccgttggttctggagttctcagatctgattctctattttatgaagatcacatggttagtgtgttaagcatttgtaacttcccctctaattctcctttgcgtaaccgattagcatacggattaagaaccttttgggaaatccaaatgtaaatgcaaatgtaaatttcagaactcagagcaacttaaaacactgtttcttgaattcacactcaagttttatattcctttctcatgtttatccttctatcacccaatttcctccttgtgggatatgaatgttcttggttatggttgatcactcataactttttctgtctgttttcttgatgcatgctgcctctgccaaaattcctcacctgcgttgacttctacagccagaaactgtaatcttaggtctaaaggtaaagtccttgtctgctatttcaagttgctcttggaaagcctttctgttcttcactgtcatcctcactgtgaagatttttaaatgatccgtttcatttctgtttttaccatcacttttaaccttctctttgaagaaagatatctctgtaatatttacatgttgatcttcaacacaatcaacaaagcactggaagatcttggtgtatcaaaaaacagtttaagtagtgacaggccttcgtctagtcggcctagaagtgaactcttgaaatgccgtatcttgttcctgatactgcctgatatttagtcagtaacattagaaaggctgtgttatcaaatg

SEQ ID NO: 110743 - DNA, 1046 bp, Homo sapiens
cccatctcagcctcccaagtagctgggattacaggcatgcgccaccacgcctggctaatttttgtatttttagtagagacggagtttcaccatgttgagcaggctggtcttgaactcctggcctcgggtgatccacctgcctctgtgtcccaaagtgctgggattacgggtgtgagccacggcatcctgccgggttgagttaattttaagattcctttcatccattcctttgtaaaatattaatatcaggcaaatgtggaattattgaacaataaatttcatttgtgtttccagacaattaagaattagcaatttcagcaaaatttttataaatgattattaataagctgtatgcggtttgctggtaaatattaaggtgtattatgataaattactaacttaaaaatgacaactctctaattctgtcactgacaaaatagtaaatcagaagtatttgtcttctattcttggcttctggctagaggtcattaattatttacctacattaagaaataagaataaaattataagaataatagaaatataggtataataatttttaagcatataaagatctttttctaaatatgcattttataattttactgaaaaaataatattgctattttgtggctttttttccagatactttgagaaaattcttacagaaggcatatgaatccaaaattgattatgacaaggtaatttttcattggtgtatttattattaaaaatacgaagtatgagaaaaattttggctgacttgaaagtaaatctttaaataaccagttattcaatctgcaattttagtaatcttttttgactaagaactttcatggaatattgaaccaccttacaaatcccatttgaaccatagcagaaagttcaaaagcggcatttgaagaaaacctttcaagttgtatgttacttaaaaattaaaaactaaggccgggtgtggtggctcacgcctgtaatcccagcactttggtaggctgaggcgggcagatcaccaggtcaggagtctgagaccagcctggccaatatgg

SEQ ID NO: 110744 - DNA, 1071 bp, Homo sapiens
gatctttctgcagttgggtgatggcattgtttgtgtgatacgagcaatgtaatgtacccttccataaagttgaacaaacagatgattagcctctaagttttattataaatgatggctgcttatacaacatgctatttggttatcatttgctttatcggaaagcatggataatgggcacttttttcagcaccactgtattggtaagtttgtatttattaataattggagaaaagtctttctctaatttaatggatctattttatcacaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagacatgatga

SEQ ID NO: 110745 - DNA, 1131 bp, Homo sapiens
atttgtattgaatgccttaaaatattcatattctttgacccagaaattttatttctgtagtcataggtatctaggtatcctaaggaaatacagatttaatgtgttttcttaatcagaaactttttagtagaagcaaaatattgaaaataatctaaatatccagaaataggagttgtttggggctttgttatttgataacccatatagtgatgttataaggccatttaaaataatgtcactgaggaacattaactgatatggaacaaattcatgatacagtgttatataaataacaacaataataacaaaattgcttgccatttctgtgtgccaagcactgctctaagcaccttacctgttgctctcctttccagattagctgattaagtagcttgcccaggtgcacacaggttctaagcagtggactcaggactccacacagacacacttcaccccagagtccatgctctgcctcctgactccactcgcctactgccttgtaaaatagaccatttctatacagcaagaaagtacaaatagaggtgtactcagagaaagcgacggaaagataacatactaaatgtcacagtgattatcataagggtgtggaatcatgtaattttattatgttcttttttgttcaactgcatgtgctaaatgtatttgttgtgtaataaaagaataaatgttataatatttaataccaggaaaaatttctaaatggtataatttcttacaagagaactaaggaggccaggcatggtggctcacacctgtaatcccagcactttgggaggccgaggcaggtggatcacaaggtcaggagtttgagaccatcctggccaacatggtgaaaccctgtctctactaaaaatacaaaaatagccgggggtggtggcggatgcctgtaatcccagctacttgggaggctgaggccaagaattgcatgaacccaggaggcggaggttgcagtgagccaagattgtgccactgcactccagcctgggtgacagagtgagactctgtctcaaaaaaaaaaaaaaaaaaaaagagaactaaggaattccgaagtttttctttgtgacaaggaggcctcagaaaactcaagatttgtgtaagttcctctaaatc

SEQ ID NO: 110746 - DNA, 1067 bp, Homo sapiens
actgtgacacggttgagggcttccattgtcacttttctcatagtgagagtttattgaacatatgacaagccattgccccagctcttcccaattgttcttttattaaaagcatttttaaatgtctttttaaatgtgtaccattatgatgtttatttaagataccctaatagactttggataacttgacattactagataagacgacttctccctaattctctatttctcttttaacatatgggcatagcagcacttgtaacatgtggacattttactttaactgattccaccagatttattcagcagacttccaaggataatgcttttattcctttatttctgtgaaagaagtaagaaaatggatagttaactgtatccaaaagagagaactgtttcaatgtttaattaattttttaatagtgtttagtttttctaaatacaaaacttttaaggttccatttttcctgtgttccctgtgagttactgggggttcataaaagagtcaaagaagaaaggacggagggcaaaaaaagcaggaataaggaaacacccaccaaataattctagctttggtgtggacacgtgtagcaagatgaaatcatttgtactttgcagaataatattttataaaaatcagctgctttgcatccctgtgaggtataagtgtgacattcatgacctaagtatagggccgaacttagagagtccacaggagtcaaactgttgcactagccacaggcatcccagatttgcttgaaccaatccaaatgtaccacagaaggtttcacaagcaggcagattttgatacaaatcaacaaatctgccttcttggatttttagacaaaggccatagatatatgcctaaaatgttaaagtcagcatggagaaatctttttaagtattaactaataactctgtggttgtgtgttctgtttgtgtgtttttgttgttttggtttgtttctggctagctcatcagagttgtaacaagctcaattaaagtgcaaggaatcctgtcttatgcctgtgtcatactcttctattttgggtaagattattcttgaatat

SEQ ID NO: 110747 - DNA, 1098 bp, Homo sapiens
aactattcatttaatttaaaatttcaaaattattttatatacattacactacttaaaatagtcacttttccccaaattctaaactctcaggatcatagtcgttggatatttattcccctttaaagaaaaacctttagaagatctatgaatgttaacagttcggtggaattgaggttacattttacctttactgtaggaaaacaaataagaaattatgcccagatgtcagcttggttattagcacttgttcctggttaattattaaatgtttttattaataaagttgcagtctttccacattatatatttttactgtattacttgatatttcattcttgtttgtttttaggtctacagtgaatatagagccagtcttgcttttgaccttgttagcagccgacagaaaaatgtgagcatttatcaagggcgtagtctgaaattaacaaaggcatagtctgaaattaactgaataatgattaatttagcatgaaatattaactaaaggaaagctacataaactgcctactgatctctattctcaacactaaataaacatttacaaattaagaataatagtaatacttaacattaagtagtatatgctctttgcagcattttaagttattcaactttgtatttaagacttgtgaacatttggatttccacatcattttataagtgccaggttctgttcttgctccatagcctcacctgtttagaacatttgctggtaataagtgaatagtacttttaaaatgctgtttaaatcccataaatctgaatcttttgcttctttctctgttcaggcatacactgattacagtgactctgtagcacggaggatgggctttattcctctcccactagctgttttagtaagtgcatactttttaatgttttttgtaacaaagtagccatcattatagaatattaataaatggattattaatatgattgtttcaaaaggacttgatataaaaattaagggtaaataacttggaagaaaattttgttttaaattatagcagtagcttatatatccaaatatctattggttgagccatccaatagatgagtgacgcttagctgttttatgta

SEQ ID NO: 110748 - DNA, 1523 bp, Homo sapiens
aatccaggtaactcactcttaacaaaacagtgtcttataattttacttctaagccaaaatcattcttttacatggaataaaatgaatattgcagaaaactccaaaagactttggctgttttactgtttgggtattggtgaaacaatcatctgtcacttaatgaccttcagtcaacaatagaccacatatacgatggtggtcccataagattctaatggacctgaaaaattcctgtcacctggtctcctagtgtccttttctgtgtttagacatgtttagatacacttaccattgtgtcacagtttgcctgcagtattcagtatggtaacgtgctgtacaggttttgtagcctaggagcaataggttataccatatagtctgggtgtgtggttataccatctaggtttgtgtaagtaccctctatgatgttaacacagtgacaaaattggctagcaacacatttctcagaatgtatccctgttgctgagcgacacatgactgtacctgtttcagtagaatggattgggtatgttttctgtggtgtagtgggatgctgtcattttccataaactcctcagtgtctctggagctgtacactcagtaggtgagtgcgccctgttatgcctggcagctctgagcctttcggtttttaactgtagtgtactttagttacctaaatccagaaagattgttttcatcttaggggttaaccaggagaacctttgctcttccctaacattatcttttacccattgattagcattttaaatagggataaattaaatataaagtaaggtggaaattttgctacttaggtgcgtctctgaattcaggctgacaggaaattgtcaagactccatgaattttcattatccattcagttagcagacattcactgagcatatgctagtttctaggcacaaggacaggcactgtggcaatgtaaaaaatactacgacatttgtaggacttaacaggctaattaaggggaagtgggtaattataatgctaagtgagctaagtgggaaatgatcaatttctcaggtatctcaagtaatttagagtttttgtttgaatgtctgacgtttttgttggaatctcattcttaaaggatgcaaccatgttttggatttcatttattactcccagtattatatatgttataggcatttattaacttcttaatttattttaattcattggtaattttcaagtaactgtgaaaaatcaaaaacatataaaatgagagatacggtcttggagatacattttcagaagtttttttcatagagaaaccataagattaaatgacatctcacagcagctcgagcaggctacctggcttgtggtggaaaagcctcttcctccacacacacagctagattctttgtgtacccaaatttgttttagtgaatggtggtatatttctttataactaagtcacctaacagggtgtccatgaagggcagagggggtatgtgtcactggttccggtagagtacatgtaagatcagcaattccca

SEQ ID NO: 110749 - DNA, 1050 bp, Homo sapiens
tctcctgcctcagcctcccgagtagctgggactacaggcgcctgccaccacgcccggctaattttttgtatttttagtagagacggcgtttcactgtgttagccaggatggtctcaatctcctgacctcgtgatccgcccacctcggcctcccaaagtgctgggattacaggcatgagccaccgtgcccggccagatgtgcccaccccttttatttttgccactatttaagactttctttgttacaaacatagctaattagtctaactgaaattctatacatattttagccgttactatttgttaaagaataaagaaatgtgagtgaataagtaaacaaagatcctcactcctctttagcttgccttctactaggatttaaaacacagatctccaggatttgagctatatctcaattttagttatatatttaaatggaatattaagaaacatcttacaaataatttttttttttaggtagctgatcgtctgttttcatcttttggacaagacatattagatgctctctattggacagcaacagagcctaaagaaagaaaaagagcccacattggggtgattcctcactttttcatggctgttctctatgtctgtatccttatagacctactggaaatttccgacagttaatgcatagtctaccttattttatttggttagccattttatagatttaaagatatatagataatgtatgtatcctgaagattaatgtgaaatatttgtgttctgttgagaaattgattgtcataataactaactaatttaagagcctcatgtaggcattactctttgagctgctggaaaacagttctgtttgcagtgtaactgattataaggaagacttttataataaaaaggcagtgtatctttatacatacctgatatagatctatataatttttcgtacttatgttagaatttttcttgaagttatctttaaatccaggaattcttttttatgggcttaaaatgcatggaatttatctaaaagtgtaatgtgaaattggttgggaggagttttggtggt

SEQ ID NO: 110750 - DNA, 1048 bp, Homo sapiens
tgtgcctgtgtccaaatttcctcttttataaggactccagtcacactggattagggcccaccctaatgacctaaacttaaattacctctttaaagaccctatgtccaagcacggttacattctaaggtaccaacataggaacttaaattacctctttaaagaccctatgtccaagcacggttacattctgaggttccaacataggaacttgatagagaggacacagttcagcctgtaactatgaattttaatctgtggaggcagggcaatttattgactaaagatacatggatgctgtggtgagggcatatgtatcataccataattgtgtgtcagacatacagaaagttgccactcttaaaatgagtagctgagtttgttagcctagtggtggctacttggccaagtcctcgaaagacttcaccctctttctgtgaaatatagtcctaaacttaacaagtaagagtgtctaatgataccacaaaaagaaagggtatggcaagtactcaagaaaggaggagaaatataaacactaggaggctggtcctggaattaagaataaggccttctgagtgcagcaagtttcagtgcacatgaaattgtgttaaagttagtgatcagtttgcatatttttaacataaacaatattgtaactcaatatatattccagtctttcccatcaatgaagcattctaataaacaggaatagcaaaattatgaggaataaagattttccataatatctagagcttgaggaagtactcagaaagccgcatcagatgatgtgccattaactatggtcaagggcaacttgtttttgagtaatttcttttgtgagtcgtaaaccaaaggctctgaggaagcacagactcactctttgaagagaagaactgttaatttgttattcccagggctaagttttaagaaattaattttttataatgtttagaaattctggttgtttggaattttcatctacaagtatttttaaaatactttttttttttcttctctccttgttaaaattcagctgatggtttttggaatc

SEQ ID NO: 110751 - DNA, 1035 bp, Homo sapiens
ctagagtatagactttctggggcatgaattttttaattcggatgattaaaatgattttattgtagggatgaccttgaatctgcagtaattgctttcaaagtcagtcatttatagttttcttattgatatcctgttccccttaacattctgctgattgttgatccctatatgtgagtttattgagaacatcttcattctcagcagagatttatcaaaatgtacatgtttcaaaataacctaatcatcttcaggtacctctttaaaataaaagagctataagtgaaaacagtcaaaagacaaggataccttggaacctaagaatgaaaatttgagctccttagcaatgaactgaacgtgatttttatgcctcttgcataatgattatatcctaacctcaccactaggaggctactcacattgtacctgtgcatgctctttccttggtttgaaattcggtcctctttactgcctggcaaaatctagtgcctgtcttctctcctctgtgggacatctctgctatctcttgcacctccttccctgtggtgtgcatgccactctcacctgcccccaaatacacacgctttacagacccaggctcttcacctgtgtttccagagcacatcattcatctggcacttagcatgcggtttgtgtcaagctcactgggttgtgaattccctggagaggatgtctttcctcccagtgcagtattaagcaagatatggtctctgcttttacaggagtagacccagagctttagcacaagctttataaaagtgagactaagcctctttactcctactttctaacaccctagaccagcgatcctcgactagcaggtggtatttggtggttgtggtggaggagatggtattcagaatttccagaagatggttagtgtaattcaaggagatatattgcaaaatcattatgcttctttcattttagccataacattttgtttattttgaaatttcaaatggtgctaaaagaagggcaggagatttttgtcataaagggacacgtagatttttt

SEQ ID NO: 110752 - DNA, 1057 bp, Homo sapiens
ttatatattcttgacacctactgattttccttccatgtctgtcagtccaggtactgtatcacctgtaagaaccaagactgagctcttgaaaaatacttttctgactattctagcccttaataattattcctttccatattcctgtggcattttcaggttataccacaaagaagaatacttttctcaaaaatacttgctgatcattgtgtgcagttctaggcatagaattatagataacatttattttggtctctttgttttatatgtatattacctgtggccccagctagcgtggaagttccttgataaatactgttctttttgttttctgtcattttcttttctgtagagctttcattgttgaggttcctcagtgctgaactaacaagagggtacttccttgaacataatgaggccaagtatacagaaagaagagaaagagtatacacttgtttgcgaataccaagagaattggaaaaggtactattttttcttcattaccagacatcattttgaaagttatgtcaaagtattaattatgcaaaaaaatggtcaacagctagagttgagttttttaaataattgaaataatgttattgggggagtagaaatttccttacaggaagaagctttaaagttacattttttagtgtaagacccagtgataggatattaatagatctatcaaaatctgaacttttctgcctatcattatcattgtgtgctacatcaaaataacttttgtaaggaattaatctctacttctgtacccttttagttcccttcagttctcttttactagaaacaggttttttttcccccattcagcatgataaattatttaatttcagcctttttaaaggtttcagtttctcagaaagcccacatgtttataaacatacaggacagtctcttcaaagaaaaagatggtttgtttaatctttatcacaggaagcatcacattacagggtgagtgtagtaacagcagcactacatcttcacgtgtcttattccttggctgtgccttatcctatcaagaccaataaaataggctggg

SEQ ID NO: 110753 - DNA, 1045 bp, Homo sapiens
cagtggccccaaacttaaccaaatggatgattaaagggtgactgattctaaaattatgatctagagccaattaatttgttcacaaagaaaaataaaaataataaaaccgggaaattacttggagtaaccacaaaccagatacaaagtaaaattagctacttctgacaaactattgctttgcttttaaaattctcacttgctttacttaattagtatatatagaccaaacgaacaatgaaaagttacttattttggtttttgatcagttcagtgtcttggcttttgacagtttttaactttaacttagtttacgctctgaaattcaatcctagcagctcatttgtgctccaatttggggactacttgcataaaagaagtctctggaaagcctatatagcattgactgtcaaattaatgatattctattctcatttgtaatcctttgctttataaccttatgaccttggaaaaagtcactcctttgtttatacctgttttccatctatacatgtgtaaatattctactctttactcctctaaatgagactataaacattttttcaaacatcttaaaaacttgaatatactgtgtgaaatggttctttacttaatgtttgacttaggaaggcagaattgctgttgtatgattgagtcccagaaaagctgattactaattggcctggtacaagagtgtgtctctgttcaataagcttatttaatattttagtgtaaccttaataaagtttactaaagttttatgttatttaagactatggagatatgcatgtttcatattttcctaacagttaaccagtattactttccaaatttttaaatgctcaatgctattttaagaaagatatatttagacatattactgaacatataaatatatttatgattactcattacttttaattaatactttttaatctttggttcttatttctaaaataagctttcttagaagataattaaacattgtgttttttcttttaggggtgaagaaaaagcaatttatactatgctttttctgaatttaagt

SEQ ID NO: 110754 - DNA, 1046 bp, Homo sapiens
agttccctttatcatttctcacaaggaatttagggctcctacaggtaagacatttgttgatcagtcccaacagcctagaattccctaaatgaatgtacatattaggtacttatccaaactctttccatctgaataaaataaaacgtggtgtctgaggttcattttttgttttatatctctccttgttgatttatatgtttagaaactagatatgtatatttgtctgtatgaatagctgtatatgctctatattgtattatactaaacatgtgtctccattaagtctaagctttcttttcctcatcacttcgttctcagaactcccgttctgacttatatttagcctggcaataggctgacgcatgtctcagatgcgagtacttacaccttttaacatagttagaattgggaatcccactcatcattcctgtttttatttgctctctcagaatggtcattgtgtatttccttgttgcatatgtggttactggccttgaactctggatgtagtggttatcaagaactgcagattgatctcttctgtattttcttcctgtccttgaaaatactaccaacttctgttgttccttttgacataaaaccaaataatcaatgttatgtttttgtgcttgttccccacttgattcatctgcagaagtcctaggtaggagagtttctgtatagccatatttttatttaggaatctaagtacagcaaatcaactttggactaagcattaggaaatctgtgtttttggcttggttgggttgttgaattgctttgtaaactctgtgcttgcttagactgcttgcctaatcagtttggttctgtttcataatgccactactagatagttcagtatctgaagcatctaggttgcttctagtcaccatggagacttaacagaaggcttggtgtaaataagggtagcacctgtgagggtagcacaggtgaaacagtacctgtgtaatgcaggtgttggagatgcatggggataggtattgcttgtaaaacaagaaagcctgaagtcgggtataggtgaacat

SEQ ID NO: 110755 - DNA, 1034 bp, Homo sapiens
ccagtacagaaatatttaacactccataaaatgttgcatctgaacttttcctgaactgaaacttatgccaaaaaaattactagatgagaaaatgtgtacttatgaatcctacattcaatgaccagttttaaacgtattgttacaatgttacagtttctataagctgtaggtttttattctcattttaaaagaatttttaaaacttgcatttgtattcatattgcagttacagattagttttaaatgaaaaaaggttttgagatggatgtcttcttgaatatagagtgaacccaacgttttaattctcaagctgtaaacagcaactgaaccataactccattaaatttcttccaactaaaaaattacttctgttgtccaaaaggggctgtgttagccgttatttcctgaagttcatgcaaataactaagttgtgaggctgattacatcattgattgtacttgagtactgaaattttaaaactacttaaggggcataaagttgatcagatgcgattctaattgatttgctgattcccagaactggacgtaggttctatttgaagcagtctatatttttggaaaattacagacggtcttgtttggtctttttcaattaaccacttaaaaattctcaaccatactttatttggtttagttctcagttaaacatttgctttcaagagtatttactttcttcattggcaggatctcagtaagacaaaatagcaaatctctcaactgtctgtttacttacttagacttgaatattaaaagcactctgttgtaaatagagatagatgtagccaggcttcactatactttctttaaaacatttctcagttgcaggaaagccaccattttaaaagcctttttttgttgtttgcgtggagaggaaatgaagttgtttgaagcctattgatgagcacagatcttgagcttgcagtatcacttaacacttcttccctggctttttctgggactggatacctggacttccatggacttcattataccacgtatccattcttcaccaac

SEQ ID NO: 110756 - DNA, 1312 bp, Homo sapiens
tgctaattctatgatcttgagaaaataacgacctcactcctccgttttctcatctgaaaaatgggaatgaaagtaatgcttttttagggtggttgtgaggattaataaaataatccctagtacctgggtaagcactccaagaatgctattgtaactggtttatattattttccacaactgcctttacacttgctctgggtatggccgttttaagacaactaaagcctgaatgctttccatggggtccactcagacatgcttgctcattcaaactctgcgagtcctgaacgcttacccctctgctggcccaaatcctcaccagccgtctcaaatagcttcagccagctttgcacccttggaattctccaggctagagaaaggcaccagtctcatggagtgatacatcaaaatccgctctcggtagacgtcttcccttcgagatctgctttgagggctgccctaacttggcataagaggacaaaccctcggctttctctcgcgtgcgcggtgtggtggcagcaggcggagcctcgaaatgcagaacaacgccggcgagttcgtggacctgtaagttccgcggaaatgctccgctagcaaccgcatcatcggtgccaaggaccacgcatccatccagatgaacgtggccgaggctgacaaggtcacgggcaggtttaatggccagtttaaaacttatgctatctgcggggcgataggatgggtgagtcagatgattcgattctccgattggccaaggccgacagcatcgtctcaaagaagttttgactagagagaatcacggatgtggaatatttgtcataaataaatagtgaaaacctaaaaaaaaaaaaaaaaaagacaaaccctcttttcatcccacagagtgaggagtcaagaaatgtcaaaacgctggtacacctataaatcccctttaaggcaccttctcaagccctctcttacatagttgaagggggttgacggagttgatagccacaggttctgtattgtaatttctcagtaagtcctaaaaatgtgtccaatgtcactatttataatgtagagaacttgtacattataatcagctttgagcttcagccacaattccaagaaacaagaaacatcttgatgtggtttggctctgtgtccccacccaaatctcatgttaaattgtaactcccagtgttggaggaggggcctcgtaggaggtgactgaattacaggacagacttccctcttactcttctcataatagagttctcatgagatctggttgtttgaaagtgtgtagcactttctcctttgttctctctctctc

SEQ ID NO: 110757 - DNA, 1049 bp, Homo sapiens
catttacatatttttggattatgtcctttggatggagtcccagaaatagaattactgagtcaaagggcatgaatatttcttaatgcttttaattcacagcatatatttatttaaaacattaaagtgaataaagattctggaaagttcctggtactctatgatgtggttgtaatcagctgggctgtgccagctctgaaccttggtatggctgccctgtgggagttcaagagggagattaatgtgtctccttgatagatttatcttttgtctttggtagtttgtctaacacattttttgtattcatttattcaggcagtcatttttaaccacctattatatgccaggcttcagagcaaagcaggcaataggatcttatattcccaatgaacacaattttttgtatgtaagaagacaaacaaacaaaattgaatgatcaaggaaaaatatagactgatgtgatagcaagtaggcttctgtagattggatgacccaaagatgacaaggatgctgagatttgaatgaggagaaagagaaaaccacaccaaagagaggaaaggcatccactggtggtggacgcagctggttcaaagggccctgtggtgtagtggagtgcagccctgggcccgaaggaaggtccccaaggtaagaacctagatctgcgggctgtgctgagagtgcagtgaaccaacagcaaagaagaagagaaagtcccatccacacaggagagtgagctccctacacagcaatgacgaaccatagaaaagttttagctgggagggtcacaatctaatgggtattgttaaaagatcctccaggcttctttgcagagcacaggttacaggggaacaggagtgggggctgagagatgagttaggaaaaagtcattgttgtccaggctgaagttactggaggcacagagaaggggtggcagtggaaggaaagaaacatgggtggatttccattcatgtgttggaggtaagttcatgggatttgctgacagattggaggtgtggagttagggtaagacaggaatcaagagtatgttctca

SEQ ID NO: 110758 - DNA, 1039 bp, Homo sapiens
gtgtctaaaaaccaaaggacggtggtctgccctccctcaaatggacatcccaaagtggcgaatggtagtgtcttacattctacgtgttgagcagtacttttattcctaaatttgcctgcctctgtggaatttgagtatagtatcactttgcagtgccgcacagtaacttgtgttgtgatgtggtgtttataaatagatgtaaatagttaacacttctttgaaaacgaatcaaatcctcacttatagcctttatcaaccagctggttcttgtaagcatcttcccggtctgtgtgcaaacattacttttaagtgatcagctggcataattaggtaagattgtacactagaagcacaattcagttttctcttcatcttggctggaagaagaaacaaacatcaggggtgatgatatgatggtaagttagatgtgggagatttttcctgcagctgcagtaccttgctaatcatcagagctagttatttatttatttctttttctgtttcagttcaaaggtatggctttgtggaacctcaggcagagaggtaattacgaagcctggtactatgggtgcaggcatcatcactggcacagaaagcagcttggctgtggttaagctttgtgttttattttctatctggatgttttcgcatttagtgctttctccttttaaaaaaaaatgtacttaaaactctcattgaagacttaaatcaggttcagggaaattgaatttaagacctggccagggatgggattggatgctgtgacttcagagacaagatgttgttaaatgggtaagaagatgttgagcaagaaaaccaacaaaacaaacttgatgaagtcaaaagaaagtgacttcttatctcgggataagaagaccaacattcaaacgttggctttggccattgggcaggtcactaaacctcctcacttgacttcatactctgatctgtaaaatgaggctttgtaaatcatccccagatgtattgactgcctgttgtgaatcaaattctatggtgacagtactgatgtgattcttac

SEQ ID NO: 110759 - DNA, 1788 bp, Homo sapiens
atgtaaatagcaccctcagtgccagaggctctaggttgtcctgctgtatgtttgcgttttcctggccaagggggactgggcacctgttgttagaaaggagcgacatgaatgacgtgcttatctgtgtccattgcagggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttgtttaggtatcagttcctcaagcccctctagttagtaagcatgtgttcatcgagcacccactatgggccaggtgctgccctcggctctggggtcacggtgaggacaaagatgggatccctgcccacagggagcaggggtgccgagagggtcaaggtgacagcctgacccagtagtgcctctgtgtaaactgctttgacgactgtttataagagatgtttgtgaagttagcagtgtgcttctggcctgatgtcacaatctcatttaaattaaatcgggagaaatttgggacttgcgttttatgtttgaaatgtgtacttacagaacactttttatgtcccagtcaccattctaagcacttcataactcttatttaatgctcatagcaaactctgagggaggagctgtcatttttatttaaggcttagagacttggagggatggcaggggctaagtcactcgcctaaggtcacacagcacagccgggatctgacacaagtggtgtggctgcagaacctatggtcttaactggtgtgctgacagttatttctgtctatgccaggaatcatgcttcatgcttgatttgcaggaaaaaaattgaagttgtagaggaaatcaagctttgaattgtgtttgtgtttgaatttctttttaaaggccgacactcccaccacacttgagatactgatctaagacctactctagatggaacatctgggatcttgtgtctgaactcgtgctgagccacagacccacagaggacgggctgtcacaggcccccttttgttctagagatcacatccacccatttgtggtatttgaaaactctcagaaaagctggcataaagtttgctttgagatgtctgtgagcacatccttcctctaccatccctggttagaatggcgttctcactcacctatccacgctgcagatgagggtgaagaagtaaaaccatttaaaacat

SEQ ID NO: 110760 - DNA, 1005 bp, Homo sapiens
tcccgggagttgcccagcgctccgcccacgcccgcttgcagaactcgccccgcctccgccccacccatcgtgtgacgtcaccatatcggtcccgcccctctacttcgcgttgctcccgggactgtcaaccgcgtccggaagccccgccttttcgcccccgcccgcatgcgcgggcgcacacgaatgcgggcgcacacgaatgcgggcgcacacgaatgcgggcgcacccttgagtcccctccacaaccgcggtttgatcccagcggtccagtcggccggtgctgcccatccgtcccgccccctagacgcacgtccgctcgcccggcgcccgagccagtccgcgcgcacgccgtctgcgccccgaaagccccgccccaaggcgcgcccgcccaccgctctccacgtgctcgctggagggcggtgcgaggggccgagccgacaagatgttcttgctgcctcttccggctgcggggcgagtagtcgtccgacgtctggccgtgagacgtttcgggagccggagtctctccaccgcagacatgacgaaggtgagaggcggcggctcgctcatggtccgccgctggggccctgcccgtgggctactggggctgcggggctggtcgaagccgcggtgtcctgggcgcccaagccaagttgcaaaaatcagtttaaaagaaaaattctctccttgcggggatcggcctaggccgctgaggaccccagcggtcgtattgagggcgcgattcccctgctcggggctagggggtgatggttgtagccgccctttacccggctccactcggccgcgcacttgctccagtcgtcacccgcggtcctggcagtaacccggggaaagacgcggcggtggggctcccatccgagcttggaggaagcccgagtttgccaaggtgaaagggtttctgaggtcccagagtcacagggctccttcccccgcggaagtgaaaggtcagggagttaagtagcttggaagggtttctagaggaaaag

SEQ ID NO: 110761 - DNA, 1301 bp, Homo sapiens
cgatttgctgtcaaaaactactgcctatcttatattcctcaatctgaaggctttctttatccggttgtggctctggcttacacagaattatttgcaagagtatcctcacttactctgcctctcaaacctataagttatacaattttgccaggacacaaaggttttaagaaaaaaaagccacaaccaaatttcaccgtgcgtttagccctgttgctgcagttaaagtaattgtgtgggagctcagtgagtctccacatgtagaattccttgctggaaatgaatgcttgaaagaaataaagtggttgatttggtgtatctgtgggacaggacttccccagcgtggtgctagttggcctcggcaaaaaggcagctggaatcgacgaacaggaaaactggcatgaaggcaaagaaaacatcagagctgctgttgcaggttatttcactttttaagtttaaagaatcctgaggatccactctttttgatgacctctctttcccctttttgtccttttaccagttgccaccccttaccacgttcacacagaaataattcatcttaacaaaaattcagttcctcttgctgaatatggttggccttatgataaatacagaaggttagctaatggaattttatttttaatatatctatatctcatttgggtgttttactaccatttgttcgctcttgtcatattagagctgtgttttcccagaacctgtagtgtatagattttttgtaatgccaccctgatgcctcccgacttttaaataacacagagtcatcagattttacaaataaagagactaaggaagcaaagcgtggcgtgcttgtttatcactagccaaaggtgtgtgcctgtcccagtatgtcccaggcaggggccattgagtcacttagcattaagcagcaggacgggcctaataccgtcaagagccatgattaaagatgctttgtaaaacatttctgaaacagtgataattggcttgattactatttaggcctgtgtatattataaatgctcattaactttacttcaaatatcattgaagtggttatttaataacttttgagagtttttgctgacctgatcttaataaaatgctgtgttaataatggactttgctcagttctttggatataatttcagcgtcatcatttccctgtcatttttaatcagagaagctcttggcaattgggaagcttcatcaggaaatcatagtgtttcagaaataatcctaggaataattgccacttcctgagagcctgtacggctctgggaggagctattcattctctccat

SEQ ID NO: 110762 - DNA, 1037 bp, Homo sapiens
tgattcctctgtcttttcaagcggggtgcaggcagattcaagacctggagctctcgtctgtggaggtggatccctgtggagacgctcaggctgctgcggagggagcggtgcttggtctctatgaatacgatgacctaaagcaaaaaaagaagatggctgtgtcggcaaagctctatggaaggtgatggaagcaaattaggaggagggtggtgctccctggcgttctgacagcctggcttttgggatatgagctgcctgcttttcagcgccacccacagctgcgtggcttggctgtgacctccccattgcctcagccattttaataatgtggtcaaaattaagcccaagctctgctcctggctctcggcatatgtctgattcccccatgactccctgacccctccctgctctgattacaaggaagccataaccaggtagctcttacctgagagggaggaatgacatgacagacatatcccacaggtttcaacccagataatgttcattcatttacctggcacctgctggccttgtgctaaatgcaagcaccacacagatgaagagatcctctggatgcttggtccttgcccttgtgggctagtggggtccctgccatcaggaataaataagatgagaccttcagcagatggtgccaagcacagtgggggccctggcactggccaagggttggcagctgtggggagtgggggagagtgcgggctctgcagccagtcagcatgggcttaagtcctggcttcaccacttactcgttgggggaccttgctggttacgtggctgaaatctctgtgcttcattttctgcatttgtttactagagttgtaataccgatttcatggggtttgtatcatcatccaaaagagcacatcaagtagggggcatgtggcaggccttctaggccatctactgttactcacccacctctgtgctgccataggaagagccagggttgtgaaacacgtgcctgtatcctttctcttctaaagctggtcctgcttacgaatgggttggaatttgga

SEQ ID NO: 110763 - DNA, 1166 bp, Homo sapiens
gtagagacggggtttctacatgttggccaggctggtctcgaactcctgacctcaggtgatcccacccgtgatgggattacaggcgtgagccagcatgcccggcccaaaaagaaatttttaattagctgggtgtggcagcatgtacctgtaattccagctactcaggaggctgaggcggaaggatcacttgagcccaggagtttgaggctgcatacagtgagctctgatcataccactacactgcagcctgggtgagtgagacctttctcaaaaaaaaaaaaaaaaaaaaaaggtttagatgtctggaaggaaatttcaaaaataggttaacagttatccctaaaatgaaattattggtcaaattcagtaggttccttttttgcatttcctaataatttaagtgaattctggcctgaaaaacataaaaatatgttaagtatgtacaggaaagatttcctaagcttatctatttttgaaaatgaggaagccattaaatagggtacatgctaaggtttccatctgggtggcggaggagcccattttgcctggagagactgcacgtgacctgagggcttgtgtcttacaggtgccatggatgtagctttgggatcaggtgccactggggtctttaccaattcatcctggctctggaacaaactcttcgaggtaggaataatatttgtatatctaaattgtagagatggtgaataaattattctagccttagaaggatagacttcttcaaccctgtgttaaagtgatttttatgccgcaggtttgcctttgaattgaaaatgaaccacagcaatagattgagttcagtggcattgggttttccacaaatgctcctaaaggaggggatgatgccccctgctcccctccggtagcctcagcgtcctgtgaaaatatctcacgaacactgtggtcatagttttagaatccctgaggtagaaatggttttgaagatggctttgtggagcagcgtttgtgactgcgtgtcgtgagtcatataagggagttcaccctgcatcgatgaggatgtcttcagaccgctgtgctctgtgcctccctccatgcccttcacagccagcctcttcccagcagtcaccctcacttccacacacacacacacacacacacacacacaccctcacttactgccattg

SEQ ID NO: 110764 - DNA, 1669 bp, Homo sapiens
cctgtaattgtagtttgatgattttagcaaaatgccctacagatttgtgaaattgcttcacagcattcccggtttctttttattttttatttatttatttatttttgagacggagcctcgctctgtcgccaggctggagtgccgtggcactccgttggctccctgcaacctccccgtcctgggttcaagcaattctcctgcctcagcctccggagtagctgggactacaggcgcgcaccaccacgcccagctaattttttgcatttttagtagagacagcgtttcaccatgttggccaggatggtctcgatttcttgacctcgtgatccacccgcctcggcctcccaaagtgctgggattataggcgtgagccactgtccccagcctcctggtttcttttatagttctaaaataaatcttttaatgagtggacacaattctgaaacctattttctagtttcatgttttagagtaacaggttagaacaactcttccttcatgcattgagcatgttaatgccatgaatttcccacaacctgcctcatccactcttccacctgtcatacctgttctctaggccagcattgaaacaggggaccgtgtctggaggatgcctctcttcgaacattatacaagacaggttgtagattgccagcttgctgatgttaacaacattggaaaatacaggtatgtaagctaagctaaatgtacatttatacaatcatccttgattgccaaaatagctattttcaattttatccccttatataaaaggtttaactatttaatttccttttggtgtagtgcttgtaagatttttaatgtcttgaattttcaagtatttcttcaaccagatttcaaaatttgcatatttctaatctaatggtaattttcaataaatggtaagggaaagagatggaaaatatgggaattcattaccatagcaaaaaggaatatagaatttatcctttactgcttaaagcaatatctgaaaataaatattctgaaactgatatgtgggttagcatcttaataggtcttacaagcttgactcttgttctttggttatagaatgtacttagcaaaaatgtgggatctcagtgcacatttacatggggttgtaaagtgctttttgtctttctcttcagatctgcaggagcatgtacagctgcagcattcctgaaagaattcgtaactcatcctaagtgggcacatttagacatagcaggcgtgatgaccaacaaagatgaagttccctatctacggaaaggcatgactgggaggcccacaaggactctcattgagttcttacttcgtttcagtcaagacaatgcttagttcagatactcaaaaatgtcttcactctgtcttaaattggacagttgaacttaaaaggtttttgaataaatggatgaaaatcttttaacggagacaaaggatggtatttaaaaatgtagaacacaatgaaatttgtatgccttgatttttttttcatttcacacaaagatttataaaggtaaagttaatatcttacttgataaggatttttaagatactctataaatgattaaaatttttagaacttcctaatcacttttcagagtatatgtttttcattgagaagcaaaattgtaactcagatttgtgatgctaggaacatgagcaaact

SEQ ID NO: 110765 - DNA, 1974 bp, Homo sapiens
ttgaaatcctgacctcaagtgatccacccacctcggcctcccaaagtgctgggattacaggtgtgagccattgcacccagccaaaaatactattttttaagagcctttaggattttgtgatagtagataattgaatgtgaatatgctcattgtgaaaaattccaaaaatatgtacagaaatagttaagaagtggaagattcttactcttctccctcccatcacctagatagagctattcttaatactgacacacatttattctagaaaatttggaaaatacaaaatcccataaaaaataaaaatcacacataatccgcccagccatagatataaacaagtgggttttttttttccaatgaatatttttctgagcgtacaccagcccttaaataacctgtggttacctttaagaaaaacgaaaccaatggaattgtataatgcattaaaaccattagaaccaatttaccttcatggaaggggtcaaatatcccgggtgaggattgaaagagaaagaccgattccggtgggacatggcactggggaatgctgcgtagtgaaatcttctctcttcctagaaaaccaatacaactgagtctaaatgagcctaaccacacagcactgggtttgacttgaaggaagatggctgtgagggcagaatagagaaggaaagtccaggggaggaaggggaagtcagtgggaataaagctgccaggcactgaagcttttgaggaagcacctttgctttttttatgtccccagcccctcttgtaaagaaaagggcaagctgatgccttaggaaattgaaaattcaactgttcttagcatgtgaaggtaacctaatgcagaaagttagtaattaaggcaaagaaagaaaacccccaggtatgcaaaggattttgccgcctttcttcctctgtcttgtttgacatttgtgttgcctaacatatacaaacatagggagagtaatgaaatccatccccactttacctataataactatatggccgatcttgtttgtgtgtatcattttccacttttttctctcctgctgtattattactaaattccagttattacataatttttctctgtaaaaacatcagtatgtatttcttagaaataaggattactttaaaaaaaaaaaaacccatgatacctttgttcacacgtagcaaatgagcaataattccatatcaatgtcacctaattttcaaagcacagagagatacagaagtgaggcaggtgagcaggagcagaaatgaccagcaggccttggttggatactgaatcagagggagctgggttctttccaaggggcttagggagtggctttgctaagtagaaaacaggtggtcatttttacaaaaagaagatcaacaataaaaacactaattctactacaattcaaacctaagccattatagattttctcaaattctgtaagttaaaaaaccaatattaacatggggcaaatgctgttggacttgggagtaaagtgatttttttttgcctcctattttcctgtattaattttttagtgagtatgtcttctttaataatagaaaagaaaggagtttttctttgagacagtcttgctctgtcgcccagactggagtgcagtggcgctatgctggctcactgcaacctctgtctctcgggttcaagtgattctcctgcctcagccttcctagaagctggaattacagatgcccacaaccacacccagctaatttttgtatttttagtagagacagggtttcaacatggctaggctggtcccgaactcctgacctcaagtgatccacccgcctccgcctcccaaagtgctgggattacaggcttgagccaccgcgcacggcaagaaaggattctttgtaagatattagggcacctagagaaatgctgggtgcaagtgaacgcccctcccgggggagcccgcagtgcccggccaggtgcgtgggtgaggcgccccc

SEQ ID NO: 110766 - DNA, 1323 bp, Homo sapiens
gatgaggaagaggaagatggtggccttttaaattatttgtttacttttctcttaaaggtactatgaaaatgatagctttggggagggattttagaaaattttgccactttaaaagagtcgtgggagtttgtatgtttttgacaatgaaatatctagtgattgaaaaaacctgaatgagtctacctttcataggaaatattagaattatcattatgattaaaaagtggactttaactccagcattaaatttttaatgacctctttaaaccagttctcctttgtttattttaaatgagttctgtattttagaagcctctacaaagaggactatgtaacttagcaaagacttctttcagactgttcattttgagactgtataaaatatatatatttgctatacatatggaccaaggtagcattataggttctcttcaggaaatgaattgttgttgtaacttcttgcattccgaatgtatagagttcagataatattgattatttgggagtggtatgtgactatgaataaattttgatttgtttctgttttagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatggtgtgtgtagtttcctaaatcttttttcagatttgttgattttgttaaattctcagtatttgaaattttttattatggtctatacatttgaagagtataggtaattaatatatgattccgattaaacaaaaaaaacctaagtagcaaccacccagcttaaaaaaaaaagtcagtacttgcatcctatcccagttgcatccctgtccctcagaagtaactattaaatcctcagtttggggttaattagtctcttgcttaaattaaaaaaaatttttttgcataaatcacatatgtctatcttaatgttttcctgtcattttgtgtaaatcatgctgtatgtatatatttagcagccaattatatttctatataatacctgttactgtgttttgcccattttttcattgggtttttaatttaaaatactattttaaaaaattcatttgcattctttatatattttgaaaagaaatccttgggttatatgaattgtagatctcttcctgttttaggtggctcattggggtatcattgtttcactccct

SEQ ID NO: 110767 - DNA, 1246 bp, Homo sapiens
gtccgttgactaattcccccttgtgtctttagaagggaagttggtggcctgcgcagcagtgactcaggcctgtaatctcagcactttggctccaacctgggcaacatagtgagaccttgtctccaaaaaaaagaaaaagaaggaagttggtgggaaaaaaacttcaactaaaatatgtgagactaaaaaaatgacattactttctattacagatgggttctcactcgggctggattgcagaggtgtggcctcaaactcctgggcttaagtgatccttccacctcagcctcctaagtaactggaagcgccactaccatgcctagctaattttttattttaaaattattttgtagagacaggggtctttctatattgctcaggctggtcttgaactcttggcttcaagctctccacctaccttggcctcccaaagtgctggttataggcagtagccatcatgcccagcctatctttatcacattaaaggcattttaaaatatcaaaatgtgtgttattttatgactgtagttaaataaataatttcatcagtactaaaatgtattgctttatttttagcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggtaaataagttcaatgtcttgtgttggcatattcttaaaggacaaggagccattttcttaaagtgcctttgaaaaatacttggcatgtaataatttcttcagttgaggttttatggagaacacaggtaatttaggtagaatcttactgtattaagtatgttaccaggtattaatttcttttggagattctgggtaattttctaagatggtgatattcttatgaaatctataaattgtgttgaggttaatgaccatctttataaattatttttaaggttttagctgaaaaggttcatatgagagctatgtccattgctcagagagtaatgctccttcaacaaggtcttaatgacagatcaggtaagataaacaactttatatatacaaaactttagtagattttgaggtcagacttaacaaggtttaagaaacgagtgtcaaatcaggtcaagtaagcctgccagtcccatgaacctggtgaaatttatcttgatgtattatatagaaaacacagggctaaagat

SEQ ID NO: 110768 - DNA, 1404 bp, Homo sapiens
cagtgacttttgcagtatcatggtacttctttttttttacctttaatatgcttagttggctgggcgctatggctcacacctgtaatctcagcacttttggaggccgaggcaggcggatcacgaggtcaagagattgagaccatcctggccaacatggtgaaacaaaaattagctgggcgtggtggcgcatgcctgtagtcccagctactcgggaggctgaggcaggagaatcgcttgaatctggtaggtggaggttgcagtgaaccaagatcgtgccactgcactccagcctggtgacagagcgagactctgtctcaaaaaatatatatatacatgcttagttgtgcctcttaacctctactatttctattgtaaatactgactttgttaattaaaacagacaaaatacaagagatggaagctagagggagcctttgttcacctatgtttcaaatgactcaatagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggtacataaaggattcattctttgaaatgtagtactgattaacttgtgcaattaatttgttttttttcctccccatagcttaagattatattaatacctttaatcttaactctcttttgttttcttttagtctgatgaatatccttttatccttcctttttcccctcctggtgtaagaactcataactttatcatagactatctactttagctatgcttttccccccttcagtttcttactttgatttttgaattagcctaccatgagaaaatccagcaacatgcacccctagtatatgtttgcttatttggttcttttttgttctaagtttcttcattcctttttgtgtggatacattaatgactctaattaaaaggatagtgtagtggttttaaagcaaatcttattattctcatttttgtactcttcaattcttaatgataaaaagatcatgctttctctcacactctttcttttaaatgaaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgaggtaaattttttttcttttagtttggagagtgattgtgttgctgcatgtgtcaatctcccagtccccttcctcaaagtcatgtttgattgtgaatatgttaaaaatcctttt

SEQ ID NO: 110769 - DNA, 1003 bp, Homo sapiens
attgttactgttggtgttaataacgatccagctgatgtaagaaagaaagaactcaaggtaagtctcttttaaatgaaagaagtgcttgagtgtaatgtagctgggcaagtctattctttcctcttgctgtgcagttctgaaatgtttctcacataatcaaattattgtttaattgttaaactataagaatatttaaaatgttaccacatatgtcagtctcagagatatgcagatctctgtgtcaggaaaactacaagtttgcatatgcctgactcattaaattctgggcagttgagatattaaataatactcctgagttgctacagatattcatattaacagtttttgttcagtgttgaaacaatttatatcttcccttagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaaggtacaggtaacttttttcatactaaatctcaggtgttattaatcatctcaactaaatcttattttctctaacttctagaattgccaaaatatatttactttgagcactttgtaatagtgacatgaattaaaatgaaaaaagtttttccctgtttctatttttggactttgaaaggccttaattaactttaattattggaggtaggactttatttgcttccttgtcatgctaatctctagaatccgaagtctttcttaccagggaagctagctttccagtggttcacatctgagttttctgttttttgtcttgaatggtttaaaaaaggaaaatacatccattttcctcttatttgtggaggatcaatgacctttcttttttattgctagcaaaataatttctatggtaacgtgcatttttttaaagctaaattacttttgtg

SEQ ID NO: 110770 - DNA, 1160 bp, Homo sapiens
cgttttttaaaaaattagtttgttaaagtactctcttaaatggagtatgtctttccttctgaaagaaattttttgttaatggtatcgataccattctgtcttacaacaaatgataaatatgtaaacataagataggtatcaattaatatttgatattaactttaatttcttttgggatcttgccttttgtaatgaacatcatttattgttgtacttttgggatgtgctgattattctcataaaaagaatgctaaataggagactcttttatataggagagtttcatgagttatgtttctgatctctttagccatagacatcccaactccaacacccaccttcccagagtgtatgcctgaattttattttgatagctggtggcttcttttatttgacgaagtctgtgggccattataggctattaaatttggaaagcaaatttaaagcaaaaactgaaaatatcatctgaaaaatgacaaactttaggtcaaaattataaaattagcaaaagtagtctatcatggttaatatcgtctgtttaacttgacttgctttgaccatttatgtgtctatttgtcctgttcgagggctacaaatctgttaaaatgcaactacaacagagcataataaatgctatggtcagggaagtatagaggttttatggagaggtttctagtgctggtagagtattgttggcttccccagaggaagacatgttttatcctgagattagaataaaaataacaatataatctaacagtcagaggatactttttctgtggtagtcacagcattaattacttcacaaatgtgaattcattcttttcttcctataggcctatgaggttggtactattattatcttcattttacaaagggcaagtaacttgcccaaaatcacacagatagtaaatggtggaggcaggatttaaacccaagaagtggctctagacttgtgcttttaactcactctgtgctgtctctcctcaatgaattatggaaggaatgttgtagacagatggagcaacatctgtgatggtccagaagttaaagaatgcctattatgttttaaaacttcaggtccatgtgactagagaattgatggggagaagcaggagaaaaatctggggaaaaattaagggctaggtcatgtaaggctt

SEQ ID NO: 110771 - DNA, 1063 bp, Homo sapiens
tttttgaggtgataattaggcaagatgaagattagacttttttttttttttttttgagacaacgtctccctctgttgcccaggctggagtgcagtggcatgatctcagctcactgcaacctccacctcccgtgttcaagccattctcgtgcctcggcctcccaagtagctgggaccacaggtgtgcaccaccacactaatttttgtgtttttagtagagatgaagttttgccatgttgaccaggctggtcctaaattcctgaccttaagtgatttacctgccttggccccccaaagtgctaggattacaggcgtgagtcgttgcgcctggctgaagttgccaattttaaaatcctgcctctaccatttactatctgtgtgatagctgtaagatcacctacagagtctatatagagtgacagtatgccctacacaaagccctgagaaagcaaacatttaaaggatggggagaagatattactaatgctgaatattttgtcttcattttagaatgatgctgaaacattgcagaaatgtcttattttatgctatgaactgttgaagcagatgtccatttcaacaggcttaagtgcaaccatgaatggaatcatcgaatctttggtatgttgatggcctcttgggctttattttagtccactcctttcttattttgtaagtgatatgttctttagaaatcaaaataatgaaaagattactgtcttaaatatctgataagtataaatgataaaatatatatatatagcagctacttcatattgtgaggattaaataagatgtctgtaaaggacctgatatgtaaattacagtcttttacatattttaaaaaatgattttatactggaaagagatacagaatatcttcattttttgaatagtaagagaggagatactgaaacataccaagaatatttaagtactggaattgtgctacgtaatgagactgagacaatcacattttatgccctgggaaaggaatttatttattatatttaaagggcttttaaaataaccctttgtaggtaattcccatagggacacaagta

SEQ ID NO: 110772 - DNA, 1073 bp, Homo sapiens
atttcttattaaaatgtctttgtagaaaaagatgaaacgccaattatgtaagatattcttttaattattcacatagcaaatacttattgagtgcgtattatgtgccagcaactgttctagacttagaagaaataaagtaggtaggtagtgaataaaacaagataaaatgtgttgtcttaatggagcttacattctagaaggggaaacacacagtgaaaaataagtatacaatgtatcagatagagaaaaataaagcagagaaggggattaagcagtgggaaggaggagagggaactgtttggttgagaaagacctcactaataagttgacatttgagcaaataccagaaggaagtacaagagcgaaccacgtggttatttgggtttccaaggagaggcaagaataagggaataggcactggggtgtaggactttgggtgtgttcaaggaataagagaacacatggctaggaaagattgagcaaagggaagaataataggaaaaagggtttgctggcagcaggatgtccatgtcttctaggaccttatagactgtaaagatgtcagttttcactataaatgagatggaaaggaattcgagggctttgagtagaagattgttatgatctgactgggcataaagtggtgtagaccagggagggtttggcaaaccttttgtgtacagggccagagagtaaatatttttagatttttgtgggccatatgatctgtctgaactcctcagctttgcttttgtagtgtgaagacagctgtagataatacataaatgaattagtatggctgtagtccagtaaaactttatggacactgaaatttgaatttcatgtaattttcacatgtaatacatttttttaaaccatttgaaaatgcaaaacttcctaacttgcaggctatgcaaaaacaggtggttgaatggatttgagctgtttgcagatccctagtattaagtaggggtacaagtatggaagcagggatactaataaggagggtatttgataatctaggaaagcgatggcgatggtttggacgagggttgtggttactgaggttgtga

SEQ ID NO: 110773 - DNA, 1377 bp, Homo sapiens
tctggatcttaaaaaaataaaatcatagttgaaggcattgttgattcttttttaaataaaaggaacaaataatataattcagcctgactccaactccagaaatttttattgactgtgaagattaactttgtcttaaagtatatagctctattatatgttatggttcaaataaataaaaataacatttttttaaattgaaattttaactgtatttttgaaaagtgatgttttctttagactagacactgtcattaaaatttgactaagaaaaaaacaagatacatattaattttatgtaaacagaaacaaaacagtttactgaatttactttttttggtggggaatatcttgatttaggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtaagaaataatccagtcctgtgattatgaaatgtcattttcagcatgtatttgtttattattattattttttaaatttattatagtttaagtcctgtgatacatgtgcagaacatacaggtttgttacataggtatacatgtgccatggtggtttgctgcacccatcaacccatctacattaggtatttctcctaacgctatccctcccctacccccctatcccctgataggtcccagtgtgtgatgttcctctcccctatgctctttatatcttatttttcctactggattttaaatttggatagacattttttattttactttttaaatatcttaattaaatcctaactttcactatcatacctaatttctcactatcaaattgtatatgcaaagaaatgaagtataaacaaaaatgaagtgattaaagtgggttgttattttttatttctttatgttgtatttgtgatatagagactctaagatttatccccaagacttttaagaaatagtttagaataattttatattgggtgggtagaagatgtaagatagggtatgggattggatctcttttaagtactcttgaactactatttttgtagcacacatgtaaaccaactgattaaaaattttttatactgattgtagtttttcattgagttagaagtgatataacaaaacttaattttatttttttgagatagggtcttgctctgtcatcaggctggagtgcagtggcgtgatcatagtccactgacccctcacctgctgggttcaagcaatcctcctg

SEQ ID NO: 110774 - DNA, 4213 bp, Homo sapiens
ataaatttcttctaatgaatgtcatctttgttaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggtattgagtcatactgataaatcaaaaatctgacttgacatcaaattcaagtcccccatgaattatatctataatgatattttgttgttgatactttttctgtctttagtagataaatgatgaaatgacaagaacgatacagattttatctatctgaatttttggctctttcctagatgaaaatgcacttaatgagtgaatttcctacatagtagttttgaatttcatactttttctctcatcaaataatgttctgccaacatactttgaatttgtttctcaataggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggtgagtgactgtggtaactgcatgcagatcactgttttggtaaaataatctctctcaaagatcccttgaaatactgaggaactgcattttggtctttagacttctgtctcaagcatataccacaaagcacgaaagaaacatgaccttgggaaatgtggagaaatcatatgaaaacagaagtaatcaatgctaacatttttgctactgaaaagaaattactaaaaatccaccacccacaccatgcccacctagtactgactgttaatctgaagtaataacctatgttatctaggactcacagagtcttcaaatgttggcttacctgctatgcttctggcacaagaaaggagaattcaaagactagaactcacctcaagcttttttggcttttaattcaaagaagataaatcaattgcacactgactcacagactgaacttaagctgggttgttttaatcctttaatggcatttggtcaaacttgttaccatttttgaaatttaatgtattagtgatttcagatgctaacagattaagttgaaagtattactctattttatttgatatttagtgataagctactctgttcaattcatatgttgtatattattggaaagataagattacaaaggatattaggcaaaattaggtaagggtcagtaatagagctattaagcacttcatgacttgagacaagggcaagagtcatgtggtaggaatgatgagtacagcattagttttaaaactcattgaccaaaattcagttaggccttgttggtatttggggagtggtttgggtagaggaaggatgttttagtaaaggtgatatatgtagatggttatgcaaatattggggaactgtagaaagatgactttggctaaggatcctgaataggactgttagggcacaacactgggggtagattatagattgctttaaaggccaatgtagggaatttggagttggccttatgtgcaatggataattatgcagggcttatgatgaaagggttaatgtcatgaaaaccacttattggaaagattaatttggtggtcagtggtggttatatgagatgaattggtgagcagaaagaaaagaatattaataaagaaagcagctgaaaatctgtataattcgcttgtagaaaaagtactagaaagtaatagtagaaagaatagaaattgacctaataaagaattatgggtacaagaatctaaaagaaagagcttgagaggcaagggagatggaggagtccaggaaaactctaagtatgtgtaacagcagacttcaaaggagctgttgacatagtttaattggggagtactctcatgatcagtgtcttggaagagtaagggaaaagtagattggggcatagccctaagttcaactactgctatgcaaacaaaggccccagccaatcccatagggagttccggaactgggatgttcctttgagttgtccagaatggagacaagctgaaacactgtacttgtgcacgggccagtcattggatttggacaaatctttgggagaagaggtatgatcttggacaaggtccaccaaagtccaccattgtcagcctggatcagtactgcagctgggaacttttaccctccaaaacatgcagcaactgggggatgagtgcatctttcctaaagggagtggaactgggccctatatcacaacatccacaacaagaagtcaagaaggggagcttattttgggggtagggaggatgttaaatttggttttagacattttatatttgggattatggcaagaaaattagttggaaatatttgttagatgtgtaagactatataataatcataatcatcttcaatttacagagaattttctcttaattttttaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggaggtaaagtagtttctcattactctaaattagtttgtgtttatatttatacatgtagaatttacatggttgtattagattatacatatgttagcatattgtgacttatttgaagtattttcttcataaatttcatataatttagtgtttttaaacaacttgatatgtattggtactattttcaaagattagggaatgcggtgtttacaaaatgttaataatgttttcttttatagcaagtaaaagataggacatgtctgagagctttggagaaaatcaagattcagttagaaaaaggaaataaagaatttggtgaccaagctgaagcagcacaggatgccaccttgactacaactactttccaaaatgaagatggtaatcacatactgaacagaatatttataaggttctgtttttttttttccatctttactgagacatatttttttctactctaacatgtttggttggacatcagaaatgaatgaaattttttttctaattaatcctcttgggaaagagcattactgataaatgtttattctgcttttcaagtgttttttggcatgcatttctcaacatatgaccatctttttaagagttttgcttctttttccaatattcaaattttcgaaagggtgatttataacttttcactagctgctagaaggactttgtcatttcagttttataaaaactggtcttaaaaagacaatttaaaatatttcatgaggttatcttatttatattgttgtattattccctttaatagaaaagaataaagaagtatatatgactccactcaggggtgtaaaagcaacccaagcatcaaagtctactcagctaaagactaacagaggtagtgtgtggattgaccatctttatgataaaagttttaaattttatcttccaatgaaaaatacttgttttgcaagttttcttatctttgtttccttagggataaagattttttttaaaatgtctttggtatcctttctttttaattctttctgtggatgtcagtttttgccttgtgtctaaagattataaaatcagtgttgctcttggtgctttagattgaaagaagtatgatgcaaaagatattacaaaagacaatttgggttaaattaagatttggttaaatgatggttttatattagttatttgtgttctatccttcctgtaactaagcatttttaaaaaatccctgtagtatttttctgggctttgttttccttctattcccatcttatttcatattttcccaacttatttcccaagggctatccaacaataggggatctgttggcaaagtaaatgctgactattagggggtcacttggaaaaaaatctgaaattcaagatctttttattgttttattatttcctcattacaaaagcaatgcatgcttattacagaagaatcagaaagtacatccagacaaactactataaggaacactaataatcccacccatgagccaaccatgattttgattttag

SEQ ID NO: 110775 - DNA, 1057 bp, Homo sapiens
atataaaggttctagtttttacattgaaatatattttagaacacatttgaattggtcatgtatgttattttacaagaagccattattaccttactatgttttatcaccttccaagaaaaaaaaaagttgtttctttagcacctgtttatgcacctaacctacctttctaacccttaattttcatgagtctccacagactttgtgctatagcaataatagaggtacttcattataacacatttttcatatactgtcctcaaatacattgaactaaaatttgccttcttttaacttgcttgaaatttccttattttcccttactcattattagtgcttacaaaataaattaagttttaatcttgcttgggttcctttttctgtggcagtgataactggtaccaagatggctagaacaagtaggagatacatgtgttgaaaggattgttgtgttgaagacaaaggatttagttagcctagaaactagattaaaaacaaaaagcaactgataataaatcctgataatgaattatactatcttcaaggacagagaaaagtgacagtttcagctaggacgaacaggaggtgtcagactgctgaagccgactctgaaaggtatgtcatgcatgtctagaatatatggaggcctatcttcactttttatttctacaagtagaaaaaaactaattttcttgcgaatgagagagaatatataacaagatagtgaaaactataaatagctgtcttaggtatatagtctaaaattccatcatcaagagcatttgacttcttacggcgtgtttgcttttgcctattagctggcatggtctttagtactatctttaatatgttgtttcaatttttaattacatgatgtgactcctctttgatcttcagttagcaaactcttgattttgataatatttgggttctctacacttacatactgatagaataattctgtctataatttgggtatattgtgtggtagagtgttttatttttggcttctgtcagtcaagccactgttagagctgaaagttggtagctgtcttgtatt

SEQ ID NO: 110776 - DNA, 1019 bp, Homo sapiens
attgtgtgtattttcagtacatagttttacactgttgattaaatttgtcttttttggggggaaacttgttttttactatgtttttggaatttattgcttaaatcaagagagagaacttaatttttttgtcacttcttgagtttcaaagaaatctcttttggacagttatggtcctcgtttaattacaagcttcattacaagtttgtggctttttttcctgtataacaccaggttctgttatagtatataaaatcattagctagattttccctgattcactttgctagatagccaagtcagtgtttttttgacattgagattttagttttaagctaagtcaatggaatcaggctatcaattaaacactgatagaatgtgagtcagaaacaaaaaagttttatttataaataaactggttttaaagcttgtatctaaattcgtgtattttcaacatctatttagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaatcagaacaaacctgatgtctttctgaagattttctgctgtgcgcttccacgttactttggcctgtattaaagcagtagagcagcatcagttattatagtccagaaaaagtgtgcatcagtcagtcacacagatttatcacaatctgaggtgggcctaggaatctcatttttaaatagtctctccaagtgattcttatgaactctttatgtttaaaatcatgtcattatggaaaacttacaagtgtaactagctagtagcttgcatttgagaagcttatgacttagatgggcagaatcaacaaagatgaaaccgcctgaggacacatttaacaagtaacatttctagggaaaatg

SEQ ID NO: 110777 - DNA, 2306 bp, Homo sapiens
aaacttgtactatatgaaattggtcctcttttctgcaatacccaacgaaacaccttttctctttattattcagaaatgtcctaacatggatctgtttgttttaataattgtgctttttttaggcttatcatctactagaggccatttacttaaggtgaaattttaagatggagctaaagtaagatcactggtttttagaaccaaattgctatacatatgtgcctcatagaacttataaaaggagtcaaagtttcaaagcaagatagttattaagcaaaaggaaaaatggtaatgatagaaagtcagttaaaaatagatgattgttcttcattctgtttgttggctctgtgttctcctgtgcttcagattccttatgtgttgttgttttaaagacaatttgcagggggttgggagaaggactgaaaaggtacattaagtgtgctgtaaggaaaagtcttagaaacataataagctaaaatcccattcacacatggccaggctatccaaaaagaaaggagccatgttctcatgtggtttaccataccaaagcttgctttctctggcatgggaaaaataaatttaagcaccaaacctttagtattctgagtattcagtttttagacatagtcatgtagccattgctgaaactgtgctttgcactattaaaggtagggaatgtcctgcttttaaaagtcatccctttaactttaaaataaaaggctaaggtacaataaaacagatgtaaatccatttaccatttttcattcaaaactggtaacttacagaaaccacatagtatttttctctatcaagaggcacagatttgctgaacagtaaacatgcaattgtgccattgctcttaaagcccacagacttagatttaaaatacagagaaagaactgataagctcacattttcctgtgaatgggaaacatgctacttgacaaaaagctatgatcaactttttttcttctgtacatatataacgttgaaggagatttacttctaagagatacctttgccttttctttcaccaatttgcttcgaggtagttggtatccacctgttttacaactgctcatgggtcaggttatcatcacaaatctttacaatactagctttataaatcacaatgtgttatatattaaaactttgtgcacagaaataaaactagggacaattacgtatttaaacttagggcataaaaaattcacataataccactaaaagagaaacatcaaaatccgtttacaaaattccacaatgatctgatgtaaaacatgtaaaaaaaacatataaagaatataatcaaaatgattaatgctaatgatttaatataaagacaaatcacaggactagaaatacttcaagatcaattgataaatgcttattgttcagaaggaatactgacatacaaaataaagatagtgcaagaagaactgcaatctatttctcttcgcttttgagattttggttatgaactgtacagctcgttagagatgctgttgtcaaattcagattccattcaatgggacgattaaggcacatcttaatggggctcaaagggcaacttgctgtattctcatcagacacattcagtttctcatcagttttcacttgtagcatgctggaagaaaaagtgtaaggcattttagttttactttaatttcaaagtaattatcaaccttgtaaaagaacatttagttgtagtagtgtttggacctctaaattttagcatacataaagcatttatcctgaaaatacaacagttttctctcccgcctacttactgaactaaatacaatgaataatgccatgtaacctgtgtaacttgagaagttacatatgactgaaaaagtaacattgcatatatggattacatcagtatacatcagaaattatttaaccttgtgagcctggtaggattcaacccttttaacttgcccttttgtggatcagaatgagagccactttgagaaaaaaaagggatcaacatttgttgaatgcctattacgttctagccaccttcacatgtattgtctcatctgaattttgcaaaagccaagtaaggttggtatgcttatcctcatagtaaacaataaaatcaagactctgagagttaagtacaaatatgcctgaggtcatacagtcacctgcctggaactggaatacagccctttctcttttccttatgcttgtctactaagctctctgatgaggctggaaaaacatcaggaattaaacttatggccagctcatcagaggagcatgcggcatccacaggatactctggttgttttttctgt

SEQ ID NO: 110778 - DNA, 1004 bp, Homo sapiens
acaacaggctttttataaatgtttattgaatttttgagtaattactgtgtatttagcactgtgcttatcttcacagagaaaagaatgttaccatcctttccttctgatctagagggggttatcagactattagacatgaaacaatagtggagaaccccaaatagttcacaatccaatgcaatgttttactgagagcaagttcagagatgtgagattggattaggcatgggtaaaggtttggttaagcagagtggtgagcaaggttccctatgtgggaacatttaggaacagacaggactgtgctcatgaacttgtggaataagacaccagtccagaacagagggtgtatattaaagaataatgttgaagagatctgaccaacctaatgtaaagccaaataagccaactttcccatcaatgtaaaaaattcttggaaatttttttcaacagaaaaaacaaccagagtatcctgtggatgccgcatgctcctctgatgagctggccataagtttaattcctgatgtttttccagcctcatcagagagcttagtagacaagcataaggaaaagagaaagggctgtattccagttccaggcaggtgactgtatgacctcaggcatatttgtacttaactctcagagtcttgattttattgtttactatgaggataagcataccaaccttacttggcttttgcaaaattcagatgagacaatacatgtgaaggtggctagaacgtaataggcattcaacaaatgttgatcccttttttttctcaaagtggctctcattctgatccacaaaagggcaagttaaaagggttgaatcctaccaggctcacaaggttaaataatttctgatgtatactgatgtaatccatatatgcaatgttactttttcagtcatatgtaacttctcaagttacacaggttacatggcattattcattgtatttagttcagtaagtaggcgggagagaaaactgttgtattttcaggataaa

SEQ ID NO: 110779 - DNA, 1679 bp, Homo sapiens
ctctatacaaatacaaagccttagttttgccgcatgttttggtgaaaagagaaagaagtgggaggagaagtgcttatcataagtaaggcctcttctctatcaaactaggaaactaatgcaggtgagggttgaacaagggcaagaggaatctgaaatggttacgtaggcatctaagcctattttcaatactttggtaatcccatggaccccaagatagagtccatctccaccatctgaatggaagtttacagagtatgtgcatttgcaaagtgtgaaagatggaaatcttttgggagtcatagaaatccaaataattatttgtgatttaaattaatgattattgataagtctaatcttcacaaaagtaaaattgtatctagctctaataatttaaacttgcattactggagatatgcaatgttcatttctgtcatagggacaataaacttgaatgttacctagccgactcttacaggaatcaaattttggtgcaaccaagacaggtctgaaaatatcacttacagaacagtagctacgtaccaggcagtgtgctaaaagcttgatttttttttttttttttttttttaacaatacaacattcagtcctaacaactattcactgaagctcacagaagtaaaatgacttacccaagccacataactagtaaatggaagtctccagggcctatgatctatcaccttgtactgcatactaactcttggattgttctaattctgtcatgattctccatgttaatacccatttttctattcttcagaaggcttaacatgtgagattagtggacaagtgtatggtttataggtttcaaacagaaagatatgcctaaggctatagttgtaaccccatccaggagagttaaatatttaatgcatgaagtttcctcatggcattaactaaataagtagcagctactcatatccttcaattcctgaaagaggagaataatgttcgggcatagactgacatgtttttgagagctaacagagtattctttaggtcaagagtttcagggaacaccaagttcatcttttcaaagggagaagtcagctgtatcacagataaactgggctctggtacaggatttggacttggaatagttaatgtacttgacactgtcaaatctgaactcatctatttaactccaaattctggatgacagcttactttcttctggaatggtgtcttctaaatattactagagtaaaaatttactgactagctattacagctcagctctgtcctgcaaattgatgtctccacaaatctatccaaatatcacgataggtttgttaagtgcacgaacctagatgagagaaccttcatgaaggtcacttatcctttcttctaaccctcaagcagtacttacttaacatattaggagtatttaaaaaaagtgatggtatctatctttcaggggtttgcggcttggtaaggaggcagagtgagaaagtattcataaattaccagaataaaacagcagcatgcaataaatataaaggagtaactaaggactaagggattacagagaagggaaagattaatcccagcagagcagggagacaaggggaagaaatatttgataacggtctttagggataaggatgttggtaagctggggcagaaggaagatttgtagagctcgagttctgatcctgag

SEQ ID NO: 110780 - DNA, 1414 bp, Homo sapiens
gttcaatgcagaaacaaatcatacacatatttgccatattttatccccagtgaaaacacggatatctttgattgtcttatgttttgctaatagtactaacattaactcacatttattgtgtccttattatgtgtccagtcaaaatgccaggcattttatgtgcattctattctctgtgccaagtgctttacataaattcttttaacaatcccattacccataaaaggtagtgactttcattatcttcactgaagcttagaaagattaagaaatgtgcatttagctggccagtgattggactcaggatcagaactcgagctctacaaatcttccttctgccccagcttaccaacatccttatccctaaagaccgttatcaaatatttcttccccttgtctccctgctctgctgggattaatctttcccttctctgtaatcccttagtccttagttactcctttatatttattgcatgctgctgttttattctggtaatttatgaatactttctcactctgcctccttaccaagccgcaaacccctgaaagatagataccatcactttttttaaatactcctaatatgttaagtaagtactgcttgagggttagaagaaaggataagtgaccttcatgaaggttctctcatctaggttcgtgcacttaacaaacctatcgtgatatttggatagatttgtggagacatcaatttgcaggacagagctgagctgtaatagctagtcagtaaatttttactctagtaatatttagaagacaccattccagaagaaagtaagctgtcatccagaatttggagttaaatagatgagttcagatttgacagtgtcaagtacattaactattccaagtccaaatcctgtaccagagcccagtttatctgtgatacagctgacttctccctttgaaaagatgaacttggtgttccctgaaactcttgacctaaagaatactctgttagctctcaaaaacatgtcagtctatgcccgaacattattctcctctttcaggaattgaaggatatgagtagctgctacttatttagttaatgccatgaggaaacttcatgcattaaatatttaactctcctggatggggttacaactatagccttaggcatatctttctgtttgaaacctataaaccatacacttgtccactaatctcacatgttaagccttctgaagaatagaaaaatgggtattaacatggagaatcatgacagaattagaacaatccaagagttagtatgcagtacaaggtgatagatcataggccctggagacttccatttactagttatgtggcttgggtaagtcattttacttctgtgagcttcagtgaatagttgttaggactgaatgttgtattgttaaaaaaaaaaaaaaaaaaaaaa

SEQ ID NO: 110781 - DNA, 2777 bp, Homo sapiens
ttttttcctctccttattttaattctgcatattactatttctgtgtttttaagttcactaatcatttctttggcattgtttaatctgctattaataccatctaggatattttttatttcgtaagtggtatgtcaactctggaagttcaaattcagtattctttatatctaccatatttgtccacgtcgtgctcatgctttcttcaacttcttgaacttatgaagtgtatttaaaatatctccattaacatcctcatgtaccaatttcacaatctgtgttatttatttatctatttctttaatgacttttccccttattatggatcatatatgttttttgcatgcatgcatgcatggtaattttcagtgggatgccagacattgtgaattttatattattgtgagctgggatttttgcaatgttaaatgttcttgggctctgttctgggacactgttaacttattgagaaatatcttgattctttcatgtcttaagcattgttggccagagccagaacaccctttaatctcagacagtagtttacaaccagggatgattttgtctcagaggatatttgggcatatacagagacattttgtgctcttacatttagaaggtgctattggcatctagtggataaagtctagggattctactaaaaattctacaatgtctagcacagccccccaaaacaaagaattatctggtcccaaatgtagggatgctactaaaaattctacagtgtctagcacagccccccaaaacaattatctggtcccaaatgttagtgaagctgatgttaagaagccctgtggtagggctaagttgacctcactatagaggcaatccagtacccacctgcggactttaccaaatgctccatgtgtcagaaggtcaattatatccagctatatatagcctccagaaaattattacctggttcttttcattgattcttttcacagacttgggaaatacttatccactgatcagtatttatctttaacccaaggaaaatcctctgcagatctgtctgtctccttctctctcctttctccccccacccccatgtctctcctatactctaacccacagattctagtcacctgggacttcgtgaactccagtcactgtctccccaactcaggaatatttccaagctctgttggggttctctccgtatcatgcagcctgaaaactctccaggcagtaagccacgtatctggtccctgctaccctgttacttcatcatggccagaagcagaaatcatattttttctttcagcaaatatttgtccagtttctatgtgccgagtactgcagataaaatgctgaacaagaacaacgaggatctctattctcaccagtctgtattttagtaagagagaaaaacaaacatagaaaacaaagcagtgataaattgtgttaatgaaattggatgatagaaaggagtttctagggggagctactttaggttgagttgtctgggaaatcctttctgaataagtaatgcataacctatgaatggagttgagacatctaggctatcattgatgactgaaactgtgagtagggatgaggacccccaaagagactgtgtagaataaaggagaaaagaaagactaggactcatccttgagaaattcgaacttttattatccaagtaaagtaggatgacttgggatggaagaggcaaaaggaaagtgtgttttgtctcaaaagccaaaagaaattagtttcatgaaagagggtgctttagtctccttgggctaccacaacaaaataacatagatggcatggcttaaaccacagaaaattattttctcaaagttttggaggctggaaggtccaagatcaaggtccagcaggtttggtttgcaagctgatagatagcttgcagatagccaccttcttgctgtgtcctcacatggcagagaggaccctctggtaccccttcctcctcttacaggaacaccagcgtcatcagattagagcttcactcttacgaccttaattacctcctaaaggtcctatccccaaatacagtcaccttcagggttagagcttcgacatatgaatttaggagaaactcaagtccatagcagaagaaatggtcagcaatattgaatgctgccaagggggcaaaaactaaaattcattggaattatcaatgtgtcattcatggctttactaagtgctattttaatggagtaaaagcactagaagccatactggaatcgtttaaggaatgaggagctaaggaaatcgtgatagcaagtataagataactgcttaaagtaatctagttataaaactgttatcttgaggaaaacgaaagattgagtaaagtcttattttttaaagaatgagagaccttgtacttttttaagcatcatggtgaggatccaattgagaagaggtggtttatttattgccacaataatgctatattacaaactaccccaacatttattagcttaaataaatgagcagtttttatttcattcatgagtctgtggttggcagataggctaggatgttcttctgatcttggctgggctccctcatatgtcctggtgttagctgactgacaggtgggacatttatctctgctccatgtgtccctcacactaactcagcaggtttgcccaagcaatttttctcaagcttcagcttccatcatatttgctaagatcctgttggccagagcaaatcacgtgggtaaggcagaatgggaagacactgcaaaattatagggcaaagaaagtaaatttaag

SEQ ID NO: 110782 - DNA, 1034 bp, Homo sapiens
gagacaaaacacactttccttttgcctcttccatcccaagtcatcctactttacttggataataaaagttcgaatttctcaaggatgagtcctagtctttcttttctcctttattctacacagtctctttgggggtcctcatccctactcacagtttcagtcatcaatgatagcctagatgtctcaactccattcataggttatgcattacttattcagaaaggatttcccagacaactcaacctaaagtagctccccctagaaactcctttctatcatccaatttcattaacacaatttatcactgctttgttttctatgtttgtttttctctcttactaaaatacagactggtgagaatagagatcctcgttgttcttgttcagcattttatctgcagtactcggcacatagaaactggacaaatatttgctgaaagaaaaaatatgatttctgcttctggccatgatgaagtaacagggtagcagggaccagatacgtggcttactgcctggagagttttcaggctgcatgatacggagagaaccccaacagagcttggaaatattcctgagttggggagacagtgactggagttcacgaagtcccaggtgactagaatctgtgggttagagtataggagagacatgggggtggggggagaaaggagagagaaggagacagacagatctgcagaggattttccttgggttaaagataaatactgatcagtggataagtatttcccaagtctgtgaaaagaatcaatgaaaagaaccaggtaataattttctggaggctatatatagctggatataattgaccttctgacacatggagcatttggtaaagtccgcaggtgggtactggattgcctctatagtgaggtcaacttagccctaccacagggcttcttaacatcagcttcactaacatttgggaccagataattgttttggggggctgtgctagacactgtagaatttttagtagcatccctacatttgggaccagataattctttgttttggggg

SEQ ID NO: 110783 - DNA, 1437 bp, Homo sapiens
ttcacaatgtctggcatcccactgaaaattaccatgcatgcatgcatgcaaaaaacatatatgatccataataaggggaaaagtcattaaagaaatagataaataaataacacagattgtgaaattggtacatgaggatgttaatggagatattttaaatacacttcataagttcaagaagttgaagaaagcatgagcacgacgtggacaaatatggtagatataaagaatactgaatttgaacttccagagttgacataccacttacgaaataaaaaatatcctagatggtattaatagcagattaaacaatgccaaagaaatgattagtgaacttaaaaacacagaaatagtaatatgcagaattaaaataaggagaggaaaaaaaaaaactaaacaaaagtgaatcgcgtatcagtgacctgtgggataaatacatgtgatttatattccagaaggagaggagagaggagagggacagaaatacatttaaagaaattggccaggtgcagtggcttatgcctgtaatcccagctctttgagaggccgaggcaggtggatcacctgaggtcaggagttcgagaccagcctaacgtggagaaaccctgtctttactaaaaaaaaaaaaatacaaaattagccaggcatggtggggcatgcctgtaatcccagctacttgggaggctgaggcaggagaattgcttgaaccagggaggtggaggttgcggtgagccaagatcgcgccattgccctccagcctaggcaacaagagtgaaactccatctcaaataataataataataataataataatagctaaaaaatgtctaaatgtgattaaaaatataaactgacatattcaaagagttcaacaaactccaagcagagaaaacataaaggcaaccatgccaagccctttcataatcaaactgttgataaccagtgataaagagaaaatcttaaaagcatctggtggaaaaaagaacatacagaggagcaaatataagaatgccatacccatcttctgaaacaatacaagcaagaagcaagtagaacaatatctgtaaagtacagtctctggcttaggatgatttaacttagagtttttcaactttacagtggtgtgaaagtgataggcatttagcagaaaccatgctttgagtacccatacaaccattttgtttttcaatgtcagtattccgtaagttacatgagatagtcaacattttattgtaaaataggctttgtgtttaacggttttgcctagctgtagggtaatgtaaatgttctgagaatatttagggtaggtgaggctaggctacgatgttagataggttaagtgtattaaatgaacttttgacttacagtattttcaacttacaagggtttattgggaagcagccccatcataagttgaggagcatcagtactaagaga

SEQ ID NO: 110784 - DNA, 1044 bp, Homo sapiens
gcccaggctggtcttgaattcctgggctcaagtaatcttcctgcctcagcctcccaaagtgttggaattacaggcgtgagtactgcgcccagccaacatgtctctaaataatccatgggctaaagaaaaaatcacaagagaaattagaaaatattttgaatttaattaaaatgaaaacacagcagagcaaaatttgtgatatagctgaagaagtgtttaaagggaaacttataacattatgttcatattagtaaataatcttccttctaccactataacacttacactctattaccagtggttctcaaagtgtacttccaggtccagaagcataagcataagtatcacttgggccccaccccatactcaatcaaactctgtaggtggatccgcacaatcattttaacaagacttgctggtgattctgatgcacactaaagtttgtgaatcacaatggtctaagtgtggttaggtgtcttgccctacacccttccttcttcacaatgcaaccagggagatcttctagaaagcaaaatctgattatgtcatatcttccctgtccacttccaatttaaatctccgccctaagtgcaatggggagccactgaaagtagacaaacttcttggcatggctcataagaacttgtatagtctgttcctttgcttccttctcaatcctccctacatctgacatcatctccttctttcttgactagacacactggccatgacttacacctctaacctgccaagaatcccacacctcagcattttttccacatccaaatccttcttcctaccctactggttctccaccacttggcctagttaattcctcctcacccttcacagcttagcttaatggccatttgctcagggaactcttccttcacttggtaaaacctcccaaaattaaattcctatagcaccacatactgagaatgtaacagatttgtgtatttactcaatgtctgcctctccaaataaacttgaaccgtgagggtaggaaccatatctggttttgcccccactattttgcatgtg

SEQ ID NO: 110785 - DNA, 1115 bp, Homo sapiens
tacctggcactttgcagaaaagtttgccgactctgttcgtatcactacaattttgatatggtgtggcttgaaaaaaataaaaaataagttgttggcttttaaaaaatatattaaggtcatcctatcttgttcgtccccaacaccccatccacttcttcctcaacactcgctccctcaacacaatacaatgtatttgacatgttagctgttctgttttgtttgatctttacgggtcaatatctgtctttatccagcagagtggtgctgggggagccatgaacaccagttgtattctgttttgtaaatctttattctctccctgcagcctccagacctgctttctctatctgaggtaagttcaagggtcacccttttcttctttaaccagctgctaccacctgctagaaggagattggtttcaatgcctcacaccatgataaattcctgcctcaaggtctaaatgttctctttctccttttttcttccttctttatttcttaagaattcaaaattcttagttcagctctcctaactaccattttttcttctcgtttttcctgggcagtaacagttttcttgtcatggagctgagcattctgtgattatcgtaacgttaagcctagtgaattcacctatagtttaattacaaacaaaaaaggcaagggtaggtgtctgaatgatttcatcttgccacttttttttttcttgtttgtgtttgttttatttaaaccagaccttggcttctttttccttctcccagttccaggcaacctggaaaatgcatttatttgctactttttttctgtgttatgcaaacatagaaagctagattttaaaagcctgtacctataaactctttttatttattcaaaagtgtttgtcttctgcgtgctaggcagtatgttagacacatgcaaaatagtgggggcaaaaccagatatggttcctaccctcacggttcaagtttatttggagaggcagacattgagtaaatacacaaatctgttacattctcagtatgtggtgctataggaatttaattttgggaggttttaccaagtgaaggaagagttccctgagcaaatggccattaagctaagctgtgaagggtgagg

SEQ ID NO: 110786 - DNA, 1041 bp, Homo sapiens
agaagacaaacacttttgaataaataaaaagagtttataggtacaggcttttaaaatctagctttctatgtttgcataacacagaaaaaaagtagcaaataaatgcattttccaggttgcctggaactgggagaaggaaaaagaagccaaggtctggtttaaataaaacaaacacaaacaagaaaaaaaaaagtggcaagatgaaatcattcagacacctacccttgccttttttgtttgtaattaaactataggtgaattcactaggcttaacgttacgataatcacagaatgctcagctccatgacaagaaaactgttactgcccaggaaaaacgagaagaaaaaatggtagttaggagagctgaactaagaattttgaattcttaagaaataaagaaggaagaaaaaaggagaaagagaacatttagaccttgaggcaggaatttatcatggtgtgaggcattgaaaccaatctccttctagcaggtggtagcagctggttaaagaagaaaagggtgacccttgaacttacctcagatagagaaagcaggtctggaggctgcagggagagaataaagatttacaaaacagaatacaactggtgttcatggctcccccagcaccactctgctggataaagacagatattgacccgtaaagatcaaacaaaacagaacagctaacatgtcaaatacattgtattgtgttgagggagcgagtgttgaggaagaagtggatggggtgttggggacgaacaagataggatgaccttaatatattttttaaaagccaacaacttattttttatttttttcaagccacaccatatcaaaattgtagtgatacgaacagagtcggcaaacttttctgcaaagtgccaggtagtaaatattttagactctgtaggctttatggtgtcttgttgcaactattcagcttctgcagcacaaaaatagcaataggcaatatacgagtgaatgaacatggcagtgttccaataaaactttatttacaaaataggccatgggccagacttccc

SEQ ID NO: 110787 - DNA, 1837 bp, Homo sapiens
aaaacaatgaagctactgagggaagcatagcccatattgtgaggtcagcatcaaataatgaaacaaaaaatgttttaagccctaatagtagcagtaattgaaaagaatagatttgagatctataaagtaaaatcaatgtcttaaagattagaagaaaaaagggagaacatccaggtttttgccttgaacatctgggtagaggatagtaagatctactaagatagaatgctctttagatgtgagaaatttgaggtgttcagtgggatatccaagaaaggatgttaggaagcagttatggatatgcttcctaaacatacggatctgtttcccaagaaaaaggcctgagctgaaataaggatttgtgaatcaacaaataactgaaaccatgagagtggaagagattacaatgagattactcattgtaagattgaaagagcctagggagtcggagcctcaaagatttaggaaaaaggaaggatgtatacaaaaggagacagatgacagtagttgagaggtaagaggaaagcctggagaatgtggtgaatggaaatgtgttgtaagaagggagaaggcaatgtaaactgttgataagaagtcaactaagatgagccctgaaacggttccattgaatatagcaacaagagtttatcttagttgttgggaaagagtagctttggtggactaacagagccacaagtcatattcaaggctagatgagttaaatgaaggaagagaaagaaaattagcacagaaaactataattgaccatgaatggagagaatatacaaaggttagctagattaagctggggttgaagacaggtttaaaagatatatatttacatgctaatggaaaaaagccaatagggaataaacaattgaagataaagaaatgagatggcaaccaatggaaatggagtgaagcccctgtgtagattattgggtataggatctaggacatggttagagagattggtcttagccaaaagggtcacttttctctaaaaaaaaaaaaaaaaaaaggtagtgggaacaatatgtgggaaggcaaatcggtaatttgtgggcagaatcctgagatattagagtccattttctgtgaatcaagaggtaatcaagagtagtatgtgggattgggtaattggggaatatggacaaggtttgaaatagctgtctcaagaaatataggatagaacaactggttttatctcagctgccagaatgtaagcctggagaaaggtgggcccttagatttagtaatagtcaagttcaccacgtggggatgacaggacaaagagatcgagccaagaatatatctgttctgtgaatagtgagaagctatatgatcaaagcagagttctagagaatcttttctaatagtagcacaaatatagatccagggggtggaggatgggaaatgtgatgtgtgaaaggtcagttgcaggagatgatttttgagatggtaatggcctaaaaatggagtgcgactgttggaaataatatagacctttttaatgtcagtatcttttgagttcccaaagcaggtgtatatcttttcctaattgataaacatctcgatataaataagctgactctggacacctctgagtaaacttttaagaatcaaataacctaatgtggtcttgaagctcctgtaataatagtagccatcctaaaacattaaattttcccataaaaattttgaattcagttgacactttgaatcgaattctgagatgactgaaaaaaaaaagtttgtcagcttcttctattttgccatctgtcgtcaaaaataactgaatttacatttttcccattcagaattctggttttcacac

SEQ ID NO: 110788 - DNA, 1116 bp, Homo sapiens
aaaatcatctcctgcaactgacctttcacacatcacatttcccatcctccaccccctggatctatatttgtgctactattagaaaagattctctagaactctgctttgatcatatagcttctcactattcacagaacagatatattcttggctcgatctctttgtcctgtcatccccacgtggtgaacttgactattactaaatctaagggcccacctttctccaggcttacattctggcagctgagataaaaccagttgttctatcctatatttcttgagacagctatttcaaaccttgtccatattccccaattacccaatcccacatactactcttgattacctcttgattcacagaaaatggactctaatatctcaggattctgcccacaaattaccgatttgccttcccacatattgttcccactacctttttttttttttttttttagagaaaagtgacccttttggctaagaccaatctctctaaccatgtcctagatcctatacccaataatctacacaggggcttcactccatttccattggttgccatctcatttctttatcttcaattgtttattccctattggcttttttccattagcatgtaaatatatatcttttaaacctgtcttcaaccccagcttaatctagctaacctttgtatattctctccattcatggtcaattatagttttctgtgctaattttctttctcttccttcatttaactcatctagccttgaatatgacttgtggctctgttagtccaccaaagctactctttcccaacaactaagataaactcttgttgctatattcaatggaaccgtttcagggctcatcttagttgacttcttatcaacagtttacattgccttctcccttcttacaacacatttccattcaccacattctccaggctttcctcttacctctcaactactgtcatctgtctccttttgtatacatccttcctttttcctaaatctttgaggctccgactccctaggctctttcaatcttacaatgagtaatctcattgtaatctcttccactctcatggtttcagttatttgttgattcacaaatccttatttcagctcaggcc

SEQ ID NO: 110789 - DNA, 1085 bp, Homo sapiens
tgttagtgttagtgtattttatgtgtggcccaagacaattcttccagtgtggccgagggaagccaaaatattagacacccctgctaaaacctagtaaaaataatataggaacactatagttgccagtgtagccatttccagctcttcttattgataagtactggacaatgagggatattgaggagtatggaagtacttattgattacttgcttaacatgaaagaaattttacatttggaaatttaaagatattatatagttgcatcattatatattttaggggtgtttttgggggggttggggaagtattggctttatttttactactctttttaaaacttgtttaaaagctaaaataggtagtatcaggtcttatattaaaatagtaaaagcagtaaattcttgatttttaataagttaatgattttatgacccccaagattcagttattcaactatataactttaaaacctatttcagaaagtagtgattaaaatttcaaatatctaacatgcaatgattaaaattttaaaggttggccaaagtagattctccattataaacgatgaatcaaaactttaaaaagtgccctgtttcttgttcttaggataactaaaaatatcaaatgccatgtcaggaaaaagagaggcaaaaaaacctgatagtggttttttttttattataattcatctgaaaatatacacacataattcttaaagactgtcatgaatggagaataaaatgtaaagcttcatttttaattctttatatcatcctcatatcatgctgttacagttaaccagaagtaaatgcattaattcattttacaacagaaccgtattttgtccttttagcttcttaatcattgtatcttcctaagaaataaatatcaagcttattttaatgtgattatttacccccactaaatatgaaatcatcctagaaaaaataagatggaagatgcctagtgactactttttcaaattaatttcaaaatccttttgggcagttttaaaatttttagtatcatttgaagagctgtttttgatctttctcatttttaaaattactaatactatttcctg

SEQ ID NO: 110790 - DNA, 2354 bp, Homo sapiens
tccatcttttaaaagaaaaccaggtagaccaaaaaaaataggtccccaagttgtgaaacagattaagcgaccaattggaagaccaccaaagcctaaaattgatcaaacaaacatcactgtttgccagaatgagccctttagtgctggaaggaaaagcccagaatgtctcatatcagaagtaaaagaaggtatttataaaaagagtattacagtaactgttatttacggaaggtcaagaagaactaaaaggcatgtttctgaaggaagggtaaacataagcaaccttatgtctttaaacaataatgctggtgattttccaactgaatataatagtcccagaaatattagtgaagacaaaattgacttgggtgaaagaataagtgctgtagcaagcttgactactgaaagtgagatcttggggtctggctttgaatatgtgagacccatcaagaacaaatctgtgatacctcagccttccaagaacattattcgaccaaatcagaagcctttggcaataagtaggaagcctggtagaccggcaaaagtgaaaatctctggcatatctgtgactattaatagaacttcacctcaggaaagagaagtaagtattagcagctgcttgcctcctttagaacaggataatacgtcaggaaaaaatctgcctgaagaaaagtatgaccaacagtgcactcaaatggataaaataaggcacactgaagctgatatatttaaaaatggatcaaaacgtatgattgctactgtacctttgagacattctattagggatagaaaaccatctctgcatttcttacattcattagcatcttctagctcacttatttatagaaacgctctgctccataaatcatataaactgcatttgcagaaaaataaaagtcagaaggaaaaacataggcactcaaagatgaaaatagcttacaaagataccccaagaaacagactttcgcggaatgcaaaaaagtgtttggaagataataaattagtacctatttctgaagtatccttggatcctataatttcatcaaaccctttgctcaggtggtgggctacttctgcttcaaatgattccttattagaggaattaaacaatagatttgagcaaataacaaatgcttgggtgcaagtaagtggagatgaagctgaaaattgtattcataaaaaaagagaacacattgaaaatgatcatttcaaagtagcaagccctttggaaacttgtcttttagaacttgaagtttcacctgtaaaaatgctttttcagaaaaagtatgatttgaatgaactctgtacttggtttatgcaaacaacagaaacacagtctctttcactagttagaaaagcaaatgcccgaaaccctttggaagtaataaataccaggggaatcaaattagggaccaaatattctgactttaatgccagccccttcagaaagcactttaaaaaatttgcactctcttctccttcaaaatcagcagagaaattgcatatactgcataaagtggctaactctccactcttaaatgtgaaaagtaatttagcaatagctagattaaaaaggactgagtttaagaggttgcatcatgaaaggtggaaaagagagggaaagctgcacaaccatggaacagttgactggaactctaaaaggagaaacttaagatttttctgccagaaccaatttttaaataagactgagggagaaacaaatgctgacatcccactccaaggaaaaagcatagtagataatcagtgtgttttgccacctgagatcaggggtgacttgcagcagagggtagtaatgcctgacttcaaaatacatgctagttttgagaataaatttaagtcagaagcaaaagagaatggaacaaattgcagccaaaaagactttcaaaagggaccaagactagaaaatgtatgtcctaatagttggaggtcaaaaaccttaaaagactgtagaatatttttgaggaagctcaactgtcttgaacacagaaatacttttaagctaaatacaatcatttactctcctgaatctactgacagtggaaatactcatcagactcatatggaagaatcaaagcgctttactttaagatctcattctgctaggcaaaattcttttaaaaagcaatctaaagaaatagaaaatgctaacacaaataatccttcagctgatgaatttgctgaccatcttggcaatagtaaattaagcaaatgtgttaactttgacaagaatcctgatagttttgaagttcttagcaatttgaacaaaagaaaaagaccaccatggaagatcacagaaatgtcaacaaaaagacataaacgacagtcttgcaaca

SEQ ID NO: 110791 - DNA, 2207 bp, Homo sapiens
aactccttctgaagcactttccattaaatattcttaatacattaaaaacagacaatatataaatgtaatcatatgtataatcatcagcttttatattgcaaaaatagggctttgctttgacttatactttgtcataggaaattaattatcagtgcttcattatatttttgctaaacaataatcaaaatgccattattgcagctctctaggagtcaggagtccagcaataccaaaatatcttttttcaaacactgttaaaattataactccttatagtggtatttttgctgcaattcattttttgtttgatttttatttttagttcaactgttgatgcaaaatcagaggaagctactaaaatggaaaaaagaaaatcagcattaaacaaagttttggaatctttgtgcatacatcaccagcaacaagttttggctatgttgaaatttctagtccaagagcagaatgctgcttctctttgctgttgtaatacatcatgtgttgtgtcttcagaatctcaaaagcccttaatcgaagatgatttatgtggtctgttctgtagttgtgaatataggctggcagaaagaggttgtttacaaaacgaaaaacaaagccctggtttagaacctctgccagtctgtattaaagatttacattgtttatcttgccaaactgtaactgttgaacacgttaagccagtagtgaatagaggaattgcagacagttataattctcacaggtgctgttctggactgttaccaaacattcactctacaaaatcagcctttcgtagtcctcttttgtcaaaggaagtatgtgatctttcagtcactcttaaagatgcctgtagatctcgaagtccctcacccccaccattatcacctatagaaactgaaggatttgaaaaattgaaagacgtcatctcagagatttcagccttagaaaataacaaacttgaagcaaacattaaccagcctccatctctcacaccagcagaaatcagcagcaataagagtgatcatcaagataaaatacttaaaactaaaaaatccagtaactcttattctttactctcaaatgacagcaataattctactacaaatcatgaaaaaggtgaaactgctgtaatttttcaagatttaatggatcgcattaatgaaaaactaaaatcaatagaaaccacggatatgacaagccttgtaaaattatctagcagtgattataatacatataatgatttaaaattgggagatttcataacatctctcttgcataatgcaaaagccagtgattatagttttatggaattattgagtcaacatgataaaaaggtagaaaataaaattattcagacaagatttcgaaagcgtcaagaaactttatttgcaatgcgcaactcctctgattcacccatgtttagaaggcagtctttacagataaaaagagaacttgctagtcttgatgaaaattttacaagaaaaaaatacaccgaaaaaagttcaaggaaattgacacaaaacaatgagatatcttcatcagacaaaggagaattctatcatgaccaagggccttctttacaaaattctaaaagacttcaaggtaaaaatcatgctgaaacatcattttcaccaaattatgcattacagtcactgcaactacctcttcatagttcagaaactaacttgtcttttaatgaattttcagaaagctttaaaacaacttcccctgagaaaatgagcataagaaagccacaggagaaatctgcagatggaaaacaatttttgcaaaatgataggaaaaatccaaagttaggtaatactcaaactcttttgagaaatgatgtttctggacttttgagcagaactaaacgaaatattgtgcctccagggtggtattctgtatatgtaacaaataattatgtttttaaaaaatcccctaaagccaaaaaagtatccgaatccacaacaaaaaacgatccagtgaaaaatattcacattgaaagctcacacaatatagacctaaacaaaattgcaatgaattctaatttacaagtggttgtgaagcgtttggaagatacaataagtatagccaaaaaatcctggaataatcagccattatcagaaggatataaagcatccaagaaattgatagaaattgatggtaaagaccaacatgctgacagaaatatgactcttactctaaatagaatg

SEQ ID NO: 110792 - DNA, 1165 bp, Homo sapiens
ttttctgaaaaatcccgtttcagcagacttaatgaaggtgaaagcaacccttatgtgctttctacttatttgaatgttcctcaagtattttatattaaaaaaaaaaagaaggaaaagagaaaacagtgcctctgtttttagaaaactactgctcagtaaagttgtttaaaccatttctggtagctaatgacaattttatattaaattgtatactaactttagtgagactgatttttttagttgtttacagtacaaatacttgtatttgttttttaattgcagtatttccaatgtcgcagtaatttagtaaaactctgtggctgccttgattttgacagattttgttaatataaactgattgttaggcaattagttatatttatgcataaatcaattgcactataattcatgaattatttattacaatattttctaatgaattcatgtatctgtcttgtgttgtaaatgtactgtaattctgttcctactttgtgttgttatatatctaaatctgattgtatgaattttaattgttcagttaacgtgtttctaggttgtaatttgtagtaaagcacttcaatgcttttgcacttaaatttacaacactgttggtgtgtgattgatttactcattcagtaaaagaaaaaaagaaaagaaaagaaaaaaactgactacactgacttgtttgatttactttaggaagcagttttattaaatatagtattctaatttactttttctgaagaaatattccaacaagtttctagtgggcaaaatggatagtaacatactaaaaataggcagtatgtttggtttataaatcaaacaggaaaaggttagaaaactttaaaagcaaaggatctacaaaaaaaatacaattttagaaccttatataatcacctgagaataaattctagactggatatttatatgtgtgttcaactattatttactcattactaggtttttctttaagatcctaacatgcaagaaatatgggggagaatgtttgaagccaaataagcatattgtgaagttctgtaatttgagatcttagtttctgatatctgatacataagatagaatctaatatctgaatatctaatttataccttttttaagctgttcttatagcattagatgggaattactggctaccatagta

SEQ ID NO: 110793 - DNA, 1364 bp, Homo sapiens
aagttggaatgcaacttagagcatgtttataatgtgcacagaaaaagcttgagaatgataattttggtttaaatgtgctggttagttgatgttatgactactttaaattttaaggattgtgacacactcctactattgaaaaacctcagtgtaactttaatatatttgctgctgtgacatttcaaaacattttcagtttatcaaaatgaattgcagatttcattttggtgggcgatacattatcattttgctaataaccaaatttgcagtttgttcagggtcttgaatagatttacaaatatttaacactgaagctgttttgaactttcagtaatgtaaactctctactaattgggtagttagaagctgggcagtgcattttaacttttactagactcataagagagactggtcatttttacctagcagttttaaaatatgggtcaaagtatccttgttggatttatggagtatgcaactgtagtggtaaaatgttataaagcatatgccttcatataaagaatagggatttgctttatgtattcaaaattctctgagtgccccctttctctgttaaaattcaggttctgatcatttttctaagccagttttcctaagtccaaaaggaatacttttagctgaatttaaaaaataagtgcaccttgtcaaatgcttgtgtttttacacttgtgtttgtgtgtatttaataatcatatatacgtgtaatactaaagagattttcagctattaaattttaaaactgcttacatgtttaaagaaactgaagagtgagaaactacacaaccaagcagttatttggtctctgagatctatacttaaccctcttcagctattaatgttacctgcacactagggtatgaatcctcttttttttttttttcaccccaagaaaatatacataatagattacagaacagcagatgtcagggtcatctttctttttaaagaattaagccatattttgtgagggccagaacttgcattatttagtatatttcccccttcccccaatggaaagcaaagttaaaggtaaagtacatatttcaaaacaattttattgacctctttatacagaattttacttggaaaactttgggggctttgaatgcattacataatatttatattgtattgagcttttttattcctcacactatatttacattaataaattgattgagaagtttatagtaaagggaaacttacagaacacttttgtatcatttaaaagatgacctgaccaaaaactttacaggattcataaatcagggatcattttgctattgacttcacagtaatcagtagttttataggtaatattatagttaatttgcagcatttta

SEQ ID NO: 110794 - DNA, 1561 bp, Homo sapiens
tccatgatagttattcatataaggacagtaaagaaacttgtgcagtgctgcaaaaagtagccttgtgggcaagagctcaagcagagcgcacagaaaaaagtaaactcaatctacttgaaacctcagaaataaaattcccaacagcttccacttacctccatcagctaactctacagaaaatggtcactcagtttaaagaaaaaaatgaaagcctccaatatgaaacttcaaatcctactgtacagttaaaaattcctcagctacgagtaagttctgtctcaaaatcacaacctgatggttctggtctgttggatgttatgtatcaagtttccaaaacctcttcagtcctagaaggatcagctctccaaaaactgaaaaatatactccctaaacagaacaaaatagaatgttctgggcctgtaactcactcaagtgttgactcttactttctacatggggacctctctcctttgtgtcttaattctaaaaatggaacagttgatggaacctctgaaaatactgaagatggattagatcgaaaagacagtaagcagcccaggaaaaaacgtggccgctatcggcaatatgatcatgaaataatggaagaagctattgcaatggtaatgagcggaaaaatgagtgtttccaaagcacaaggaatttatggggtacctcacagcactttagaatacaaggtaaaagaaagatctggaacactgaagactcctccgaagaagaaactacgattaccagacactgggttatataatatgacagattcagggactggcagctgcaaaaacagcagcaagcctgtgtagattacttgttaggaaaatgtttgtgagtgtgtgtgtgtgtgtgtgtttgcgtgtgtgtgtatgtgcacaggtgtgtatttgtgtgtctatatacacacgtgggaattacaaatgctcactctgacaggagacatgaaattttacagttcaaaaaccacttacatgccttttgaaaaaaagttttattcagggttttcactgtggacagaattatatagttgcttacttaattctgatagtttgtatttaatccttgtataaataggtgaaaaagattcaggttttctttagtagtcaatagcataaagcgttgtgggaaaacgagtaattgtcaagtgaaacatttttattggtgaaagaccattccagccattcagttgaaccatcttataatggaaatatgatattcatagtttataaacattctatacaacagacttaacacttgttgtatgtatgtcaagcaaccaatcaaagtttaaatagctatctccatactaagaaaaattaatatatacagtattagtacacgacagtgcattctatgaaatacaaaatgcactcaagtgcatccaccaggaatagaaaagaaaaccttaaaggatatgtataatgaaatttaatatttatcatttaatagttgatttagcaagaagttggggtttataaggtatatactttaaaaaaactgacacatagttaaccccagcagctatagaaccctttaatataataagatg

SEQ ID NO: 110795 - DNA, 2155 bp, Homo sapiens
ataacatttctgatctcagctcactcttggcctggcttccttcatttcagataccctggcctttgctattcctctgacattccagacatggttccatatcacagcccctatacagactgttcttttggaaacgttctcccatgtatctgattagttggtgatcctcaccttattcagggccctgttcaaatcaaagaagcctgcactgataacactgtgtaaaacagcagcattctcagccccaccctcattactctatcagcttactctgtgttattttccagggtggcactatcataattgctggtggtagtggtgctggttgtggtgttgtatgaattatctcattagatcctaagcactatgactatgacaataggtactttgtatgacttttttttttgatgctcttctagtgcctaaaatagtgctttgcatatagtgagcgctcaataaattattgtcgaagtctatataggaggctatagataggatgttttgttttatttttcatctttgtatctgcccaggaacatacatatttcatggattgattatggttacagtaaaacccagttgaattttttaagcccagttgaattagtatatttttaaacatgtatttttcaataataatttttcttagagctaaaactttcagttttttagctaacaataaaaacattcacggaattctttgctgggttttaaattcatggtttatttttatcctttttgatcctgaagcatgccagattaacaagtctgaatcattgagtttttatttatgtaaatgttataattacattttaataacatgcgtaggcagttattttataacattatttttctaaagttgcattatcgtaaattatgtctttagtcgtagatataagcacaatttattatgtaggcaatgatttaactattgtatagttcaataatttaaaagagtaaaattttacactatgagttctagaaaatacatgtttatacgtacagccacagtttaccttttgctagtcctagtaaatgctaattattcaattctcttactcatcatcacattttctattctctccattttgtacaatttacatcactcccaccttcccaaagcattatctgggcagctttgaatggaaaacagtcatgaatgagcaatcaatggctattcactacaaaatggtggagaggtgactaaaagtttatcttagacaaattttatatcatatatttagttagtttcttcctatcacctggcaatgccagctcctcctctgttctttttttcctatatagtgccttcccagtcatatcctgttcctaaacccgtttaagatgaataggtaatggccacatatcaaatactagtgttatgaattagatcaacaaaatatgaaatattaaaatgtaaggattgcctatctgttgcaaatataaagttttttctcttgcaaaaattataggggatggagtgttagatctctctacaaagaaaaccagcataaaatctgaagagtcatccatatgtgatccttcttctgaaaattcagtggctgggtaagcaatatctaggaaatataatttaatattaatataaaattatctctgcagagaactcttaatactattctgagtagtattgacgtatatagttttcctccagaatttttgtcactcataagtgtctctctctcatacctttcatttgtcctttctctttcttttttattctttctgttaaagaaaagttatcagaacaatcaccaaactttagttcatgttactaaaatgaactaccaacttatagaatacaaactaagaagcaggacgagtaagagaatattaaattaaatactcaggacgcaattttaagggaaatatgtaatttattaattttttaaaacaatgaacaaattccaaaagcactgtacttactaattaatgctagtttatagtgtttagatttttttattgcactttagatgtggtggcaaactacttaaatatatctagtaatcaccacaaaaagtcctctcatgttttgaaaagtgtcattaatcattaaataaataattagtagtgaaatgctgttctgttggatttttggatttttttttacaacttttttgcatcttcccattaactaact

SEQ ID NO: 110796 - DNA, 1217 bp, Homo sapiens
tgaaatatttagaagtaaattgtaattattctacagtttcagtggttctacaaataaaaataaagtaaaaagaaagctaatttggcagactagtgacagttcttgaatattagtggaagctatgtcattgtactattctttcattttttatttataatcaaaatttttctatataaaaaatcaaaagaaaatccttgatgatgaaattcaggttatatatgaaatgcacattttatagaattgaatttaatggatacagaattataagaatttagacgttttcctagttaatgcatgcacattgtatattaggataaaaattggttacttatacaatttatattcacatactgagtgttttaatgtctagtaaaatatatctgaatgaatattaaaactcttgagaataagttgttccgcttctatgtctaattctttatttgtattttagtttgggaccagagaatgtttaattgtaagaagtaattaaatatgccacatttttggttgatatattattataaagctgattaaatctacaaagcttttattgctaattcccagaaaacattgggagttatggactgatgctaaaagacttctgaagtcattaatttgtaataaaaataaatttaaatgttggtgatttgcctttctctttttaaaatgattattatatttatttcttccctagatcttcctcagaactgtgatcctaacattcccctagttgctcaggaattaatgaaaaagatgatacgtcaatttgcgattgagtacatttcaaaaagtggtaaaactcaagagaatagaaatggttcaattggaccaagtatagtatgtaaaagtatccaaatgaatcaagcagaaaactcccttcaggaagagcaggaaggccccttagacctcactgtgaatcgaatgcaagaacaaaatactcagcaaggtaagattttttgtgtgcatttaatatataatttgatgttttatatcgttaaatgtatatttataactttttatattcatagggaaatttattttggatgtaatatgacttttaatttgcttatgtaatatgtgctggagagaagtacctatttacagcttttgtacttgcatctttgtttataaaagagaaaatctgagttgctctcaactccttttgcaataaagtgtatcctaataaacagcttaaaaataaagcatataaacaaagg

SEQ ID NO: 110797 - DNA, 1103 bp, Homo sapiens
attttggcattaagaaatggggacaagaaacaaagacccacctaagctggggatgaatacctgtgaattgttcagaaggattatgggggtatctcatatatgtgattttataaattttttagccctatatgtaaattacatagattataaaatgtatgtaatgcattatgaaactattgcaggataataaaaaatgacccatgactattgagcatattgacttacatatttgttcaactttattgtacatgttactgctggtggtgattaggaacttcctgcaatattctgtgtgaagagacatttggagttgggggaaactgaaatgatcttttctaattaaactaagttattgtgccacccctactgcaaaaaataggaaggggagggaaggatagaattagaaacacatacatgaaaaggaaagtgatgcatcaaaatattctccgttaacctctcataaaatatctaaactcaggaattaaataagttcacataaattttcaaataaattccttgctattgaaaattcaagaaccaaacagattcagattctgcaatatccattgctatctgaactttttcttcaaactatgtgaactcaagaactaaatagatttgaataagaagtgatacacattttattgtttttgttggtgagaccacatgatctggtggaaaaaaaatactgatctggaagatgggaaaaccagtgttctacgccctgccactatgccactatgccactatcactgatttgatctttctggatttttgtttctttttttttttttttttcattatgagactggattagattttatctaaaatctggtagttccaaaattctagtggtcctgaaaagtggataaaagtttaggagctatttttaacatttcaaaaagccttaagaagtcatataattatctgcactaagactgtaggtcaaacaaatttcttttatatttggatcaaattgatattactctttataaaaattgccacaccaagctacttgtgtcttattgaaaatgtctttgaattaaaagtagggaattacattatacaagattggaaatcattagctatatgttttctaatgt

SEQ ID NO: 110798 - DNA, 1002 bp, Homo sapiens
aattatggcagtctatggttatggtggttatcaatgatttttttttttttgagacagagtctcactctgttgcccagactgaaatgcaatggtgcaatctcggctcaccgtaagcttcgccttccgagttcacaccattctcctgcctcagcctcctgagtagcatataaaaatgtataagtgcatatatagtatatatgcatatagtgtatatgtgcatatatagtgcctcagcctcccgagtaggtgggactataggtgcccaccaccatgcccagctcattttttgtatttttagtagaaatggggtttcaccgtgttagccgggatagtcttgatctcctgacctcgtgatctgcccgtctcggcctcccaaagtgctggcattacaggcgtgagccacagcgcccggccctgatggggatgcatttttaaacatttgttttctttttctgataatattcagaaacctctgaatcttttctactttattttgcttggcaggttgttctctgacctctctttttctacctcacagttacaagaagtgaaacagtggatataacatttcgtaattgcaacttaaaatcagcatatactactttgctgctgtaattttcatgatactatttatcagatttttatatatctttaattttactttctagctcagagattcttaacctgggatccacatagtttgcccaaaagttcatagataggatttcatgggtccatgaacttgaatggttgaaaaaattacatttttattttcattgacccttggttgaaatgtaacatttacttcaactgtaagcatagacaacaaacaacagtggtattagtagtacctgttccgataatagaaatcataaatatttttatatcatatctttaattattttttacattctcaactactttgaaattatggtagacattggacttactactagattttatattttaatgcattaaaagaggcatatatattacatctgt

SEQ ID NO: 110799 - DNA, 1059 bp, Homo sapiens
tctcctatgagtatctaatgctactgctgaactgacaggaggcaaactcaggcggtaatgctcacttgctggctgctcacctcctgctatgcagcccagttccttacaggccatggactggtaccagtctgtggcctaggggtcggggacgtctccaagaaatatataatctttatattgtattcttccatactaggttgttaactcctagagagcagaaaatacatagattttctcagtatcttttattaccctgagcaagtatcatagttatattagagttttgataattgatttttagtaacttataaaaatgaaagatgatctctagttgaaacccagctctgtgcctctgtaattatcctattacagtattttctaggtaaatgcttttcttaatactaatagtaatttgtttgcattttgcttacagtcttatgctatttgaaaattaaagatgattaaaaagcaacatttgggagggtcttttatggctcattcagtagataaaatagagcaatagtatgagtcttggtagttgattattaagcctaattcctcagtttacctttctgcttgctttgtagcatttagatattttgcatggtcttgtcatgaccagagaataatgcatttaaatcctatagtagtccatagtggtccttacaaaacttaactgacttagaattgactttttacccttatttgggtttcactctattgtcaaaatatttgcttttctttggaaacaaatctgctttttaacacttttactttgttttacatttgttcataagaatgccccagctatagtagatctaaaagcttatataaaggttttgacatttcttgagtaccatactggttagactggttatgttctaacaagtcagatatttgtggcacccctaactataattctccacaatagcctctagacaataactttaaagctgtgttgaaagtggctgtgataggaataaggcattatctaaatgactctgatggttcagagatttatgatacttaatagcaagtgtcatcactgctgaggaggca

SEQ ID NO: 110800 - DNA, 1038 bp, Homo sapiens
atgttaggtcctgagttagtatttcttgggtgaataaatgaatactaagataaactctacctagatagatatctttcagtttctcagaatattcggtagtattagtacttcctttgttcgttttgaagaagtaaattattttgtacgtacatatagttaacctttctctgctttgtacttaaagtattactgtgtatagtttgaatatcagccagtttgtttggaatgttgataaacataggcatatagatataaaatgccttgtttacagatatccttatgaaatgtaaactaagttattttggcctttagctgcagattctctaatcacctgaaatgtttaagtcactggcttatgattcaggaagatgtctcatcttttatttttaaattgaaggctgctggactggactaaattgaacagataatatgtacatagtagctgaacgaatcatactgctatctatataacaaagtcatccttcatcaaaatgtaatatgtttttcctgcttttttttttaatacccacacatgcttagcattcacgtacccacaattctgtttttttcctgaaggaccttcttgatggatttgatgccgttagttgaaagctcctattaacaaactcttttcccttaagttaattgatagccaggttttatattaaaaacctttttattttcccgtgccttttgggaacactgacccttttccttttaaactgttaatgttttgttttgtactctagcatgatataaatactagtatggttcattaaccagttgggttatgactgatgataaagtaattgatttcttaaaaacaggtagtgttaatcttttagagtgcttttctctaaatgcagacatccttgattgactatgtaaatttaacatgattcattcaggccttaagtgtttcttagtaagtgttcctttgtgatgtcatcgtggtcatactttgaatttctcttatataggttgcccttttggaactctcagggaattgtaattgccataaaataactgatataccat

SEQ ID NO: 110801 - DNA, 1168 bp, Homo sapiens
ccatctcttgattcttcacagtcaacaccaacagaggagctatcatctcagggccagtccaacactgataagattgaatgccaagcagaaaattacctaaatgcactctttcgaaagaaaggtaatattggtatgctttgtcatttaaaatttgcaatagagatgtaaaatgttggaatttttttacacaaaagttttttatatgtcagtctctctacttcactctttattgtttctttattcttaatttttctttatatttttagggacagtaggagtctcaatcattctagtactagtcttgtattaggcattcctgttcagcattctattttcaagtatctctctgactttatcacacattttcctcatctattataggaacctttaaaaatttttcttatgcttctggtcttccttattgtattgctgtcttgaacacttcaaaatttgtttgatgttcaataagttacagatatataatattatattgcaaagctatgcctgataatgtaatagtgaaatcacttatcagcttggttggagtatatttgctgacttgctatttcaatatttatttggtaactttaatttgcttagtagacattaaaaaaatcaatgttcttttttatttcttgtctctccaaactactcaaaccaaatagcttttgttttacttgttcccttactttacactcatgtatcaagcagtagtagtttttatattttagttacttgggagaattagagaaatgtaggacctttcatgttttgttcttggctgttcccacagtaatagagtgtcttatttttaccacctggacctttggattaagttatggtgcatgtttaggttgggggattattctctctctcaactttgagattaagaaaacattaccatattgtcatcatctacttgttgaccctattttactcctctttggaatgagatatcactagatatttttctactaaattgataactttcatgtttaaatcaataatgtttaaaatagtacttgactgtgatacaagagtcttttgtttagtcttaagtgttctaagttcttttatatgttggaatatggaaatcctcttattagaagagtcttaatataatttaaaggcctaaaattaagaactataatttttaagagcaagagac

SEQ ID NO: 110802 - DNA, 1050 bp, Homo sapiens
ataaaaatctgttctgacttttgagctatagacttttacttgttttcttgggcatcattccattttctgaaatctgtgggcttttctagtgctttcttctatttctctattttatgttgtctttcatggtgtgcaaagtttatttcctccagatatctccccctttgttctgattcctttcatagcaaaaataaaattaaagcacaatgataagttgaatctttcagaaagttagatgatatttaaaaccctattgttggaaaattgttaatttataaccagctcattgttcttgctattttgtcccataatagtgcagattactctccttacagccttctctgtttatttctagatgttgtgagtttaattttaaagttagttcttctcccattactgttagttttttaaaaattattattatgtgagccattgctgtggagagtggtaattttatttgttttaataaagttagtatatttaatgaattttttccctcttttaaagactgtgaaccagaagagctgactgactggtctatggatgaaaaatgttcattttgtaacctacagagagaagcagtcagtgtaagttttagtgctatgaaattatctttaaactaatgcacaattgtaacacagttttttttttatcttaatttgttttgaaaatttgtgactcacagtggaagtttaagtatttgattttggtaaacgaaaataatattttaaagtcatattagaaatctaacatttagcttaacttgcaggtgaaaatcctagaaaactcatctttttttttacttatttatttcacatttctttcttactcttacttaccctgactcattaagtttagttcaggtctattttgtatttaggtatagagggatgagcttgaaggcctactttggtctgagaccaccctacaatctgatttcttagaaattaatagtaggggaataatgtgctgttttagcctttcacttactcttgaagtcttttggatatcataattatctcctgtgtaaatgatgaaatatgtaagtgt

SEQ ID NO: 110803 - DNA, 2181 bp, Homo sapiens
ttgtgcagttttttgggttttgccaaatgcatggtgtcattgatccatcattatagtatcagacacagtgcatatcactgccaaaaaccgtcttctaaactctacctagtcataccttccacttccccaaacctgtggcaaacactaatttttttatggtctctaaagttttgttttttttagaatgtcatatagttggaatcatacagtatgtagcttctaaagatttgcttctttcacttagaaatgtgcatttaagggtcctctattacttttcatgtctgtttcttgatgaataatattgcgttgtatagatgtacccacagtttgcttattcattcacctattgaaacacatcttgctcactttcaaaatgtggctatttagaataagactgctataaacacaggcaaatttttttgtggacaaattttttcaactcatttgggtaaatatttaggagcatcattgatagactatgtttagttttgtaagaaactgtaagggtatcttcaatggtagctgtaccatttcgcattcccaccagcaatggatgaaagttcctgttgctgcacatcctcaccaatatttgatgtcagtgttttggattttaaccattctaacaggtatatagtggtatttcattgccttaatttgtagttccctaatgacatgacattcagcatcttttcatatgcttggttgccactatgtatcttcttgggtgatgtatctattcagacagagtttgatatttggacaatgatggattcgtagagtaagtgaagacatatttcccctgctgctgtttttagagacagattgtatggaaatcatctgggttggtgctttctgtttcagaaggtttttaattattaatttctttaatagatacagggctgttgaggttatctatcttaccttgtgtgagatttggtagtttgtgtcttctgaggaattggtccattttatttaaagttatcaaatttgtgagcatgatgttcataatattcctttattatccttataatgcccataggatcagtagtgatggccagtctttcatttctagtattaaaaatttgtgctttctctttttttcttcattggctagccagatttgtctggaggtttattttactgatttttttccccaatgaaccagctgatcctagttttttaagcggcataaaatataaactagaagaatctataacaaaatgttaatcattgtctacggatgatgggattatgaatttttcttttctcctttgtacttttcaatatagttaatatgtaattccataatgaaaaatcagtttttagttgtattgcctaaggattagtatctttccctcagaccaatacagttataaccagtgtttcatgatcttcatgaaaaatctagctcaatattcttctttttcatttttcactgaactttgtctttggaaacgctaaatttacagcctatggattaaagggaccaaaaagcattaaaacactcaaaaattatttattaataatgaggttatttagaagaaaataaaaattacatctgttgaggtgtttcacacatgctttaatttttactacagctttaacatgtaattattattctctttttcaaacaaagaatctgaaactcaagttaacttgcctgactgaggccacatgagtatgtggaaaagccacaaaaagttcagtactagggttctcctatttcaaaatctggattagataaaatgattcaagccagattttaactataagagtatatatccatggtggaaaggttgatgtttgtcattcattgactattagttttaattatgacgttaccttttactaatgaagctatttctataagatatataatttaacctcttttgagtttatgcattacagtttcaaaaagagagataacatcttttagagatgagtatcttattcgttgtttgagagattaaaatgaatgttttatttcagcatttatttagtttttaatgacatgaaagataacctggggagagtgaaaatctggcctagagttgatttttcaaaagctatttttccatgtagaaaaatgtatcccaccaaacatcatttgtttggtttaaaataaaaagttaatatagaaagagtgattaaatatttgtaagtaaagctataaagctatac

SEQ ID NO: 110804 - DNA, 1777 bp, Homo sapiens
ttagcaagtgttttggatataaattggccacatccatggaaaccaaaaagaaagtttttttaaattttgttttgtattcatttatttttgagatggagtctcactctgtcccccaggctggagtgcagtggcgtgatctcggctcaccgcaatctctgcctcccaagttcaaacgattctcctgccttgcctcctgagaagctgggattacaggcgcacaccaccatgcccagctgatttttgtgtttttcgtagagatagggtttcgccatgtgggccaggctggtctcgaactcctgacctcaagtgatccacctgccttgatcccaaagtgctgggattacaggcgtgagctgccacgcccggccagaaacaagattatttttaagttaacatctttgatgattataaaaactataagcaagaataaatccagtaaacaatgtgctagacctttattaaagaaatgataaaatgttactaagaatatttttaaaatcataaaatagtgatgtttaacatactgtggtattagcttaggagtagatgagcagatgaatggaaagtctaaaaagaaagtcaaagaaacatgcaaaacatagcgaaacctagtctctactaaaataaaataaaaaaataagccaggcatggtgcatgcctgtggtcctggctactcaggaggctggatcaggaggatcacccgagcccaggaagtgctgcagtgagctatgatagtgccactggacttcagcctgaattccagaatgagaccctgtgtattagtttcacactgctgataaagacatacccgagactgggcaatttacaaaagaaaagaggcttactggacttacagttccacatggctggggaggcctcacaatcacggcggaaggcaaggaggagcaagtcacatcttacgtggatggcaacaggcagagagaggtagtgcagagaaactcccatttttaaaagcatcaaatatcagagactatcaccagaacagcattggaaagacccgcccctataaatcagtcatcttccaccaggtccctcccacatggaaattatgggagctacaagatgagatttgggtggggacacagagccaaaccatatcatcctgtatcaagaaaaagacaatccacaggcttgaagaaaatatttgcagatgggtgaatatctcataagggatttatgttcaaaataacgcttacaactcaataatgaaaagacaaataactcaattgaaaaatgggcaaaaaatttgaatagacatttcaccaaggaacttacatgaattgccaatgaacacatgaaaaaatgttcaacatcattagtcactagggaaatgagactgcactttgcatccactagaatggctataatcaaagtgtttgtaaggatgtggagaaattgttataggaatggtgaagccactttgggaagcagtttgtcagttttttttaatgttaaatataaacttaccatatgacccagcaattatattcctatagtcttacctagtagaaatgaaaatctgtttcatgtaaatttcatagtagtgttattcacaatagcaaaaagtggaaacaacccaaagtttcattagctagcaaatcaataaacaaatgtagtatatccaaacagtggactgctattcagcaataaaaagaattggagtactgatgtatgctacaacatgatgaatctcagacacattatgctcagtgaaagaagccagacacaaaagtgcatatgtgatattctctttata

SEQ ID NO: 110805 - DNA, 1590 bp, Homo sapiens
ctccatctcaaatatatatatatacacacatacatacatatatacatacatacatatatatatacacacacacacacagacacacacacatatatatatgtacccatacacacatttatgtatattttagtgtttggaacaactgtattttttaaactctcaaaataaaattagtagggttttttcttctttttaaattaactagattttccacaggcctatgtaagatacttaagtaaaatgcatgtttggttagaaggaaacccagtgctctcttctgtattataattttcaattaactttttaaacttagaaggaattagtgtaaaagaatagagcactgtttacatggaaaaaaagcaggtactctgacaaatagattgttgttttaattagctctgattataggtgcttacacagtttattcactggtgtctctttttttaaaatataattaattgttcttcaatgtcttcttcctcctccctttctgaacagctcagtactaaaacatcaagtgggagaaaacaagggtaggtatccacactgggtggggtgcgtgggaggcagagccacatcgtcatgtaagaggagtgggatctcagaaccttatagggtgaggagggtgtccatgggggttgatggaatgaagggtaaggagcacctctccattggaaggcatgctaaggcagggtattggagcccaagcagggtgatatggtatctgtgaaggagagtggcctggtatgggggaaggtcagctggtcccagcaaggaggacatctacttggggtgggatgtcatcctgcatgagctctcagggccccagtagataccagggggtagggagtgacccatgtaggattgcagcctggtgtaggtatattaaggctcaagtgagatgaggagggagtccatacatagaggtatctgagtccaaggtattagagcctgagggtaaagggaggaaggcctctcagtggagctcggtacaatatgggatttcatagcctgagcagggtagggaggatattcttgtaggagggatgccaggcatgaggaatagggacctgaacagggtaaggagattatatacatggggtagggattttggggccaagagaggtgaggagggtgtccgtgtagggaaagagacagctacagtgggagattggttacgtacatgaagattgatcagtattaagaataatgggagccaggcttctcattgtctgagaagggatttactaatatgaaagtagggaaaattagaatgctgtctgtagtgttggataggaaatgaagtacttgtgcgaactcatggttttcatcatatatagatatagaaatgtatgtgtatgtatacatacacatgccctatactggtcattgagaaggggcttaggagcagtggcagtacggtagcagtgagcatagtgtattaccgttaatttcctgattttaatggttgtttttgtgagagaattgggaaatactaggaattcaagagtggtgggtcattatgtagacatttactctcaaatggttgggaagataaaggtcttccttactatacttaaaacttttaag

SEQ ID NO: 110806 - DNA, 1913 bp, Homo sapiens
aactagaaatagactttggaataaaaaatcaaaatattagctttttaaaatggtaaggttgcattgaggaacttggcttggaactgaggccaaaattagacattagattgccctactgcctgactccctgaattgaacttatcagcctatcaaagacagtacagctggagctgcaggcgtcttaaaatacaaggaagctgtaccctagtgagtttaccatgcttgttggtaggagtgagcaggaggcttggccgtgaatgaaaaatgacttttaaaacattaatccatcccactagggaccaactgtaaggatgttgccaatattagttattcttccttcttttgggagaactgaataagtagtagagaaaagagccaagtttcttccaaagtacttcccccaagaatgtgaaaagtgtttgtgggagttctattttatggaaaagacaggaactgtggtgtggttcaaaaagcttactgtttacacaggagtaggatttaccttgcttttaaagagttcacagtgatcagggatgttaaatattagacttggtgtaatgtaatggaaagacagaagtgggaacaattaattttgacttgaaggattcaaaatgactaggcttcaaaacattgagggaaagcaaggattggcaaactttttctctaaagggccagacagtaaatgttttaggctttgtgggccatctggtctctattgcagctactcacctccactgttgtagtccaaaagaaagacataaattaataagcatggctgcgtttcagtaacatttatttataaaaataggtggatttggcctataaaccatagtttgctgatctctgggataaaggatacagcaggaaagtagagtggagggaatgggcagagatagtataagcaaatatatttaagtataaataatgatatattctgaaaatatttagcattacagtgccattggtttataggttagcagcagaaagtaggactggaagtataaattatagcttctacaaggaggaaattgtaagcctttgaagttgttttttttttttttttaaaatgggtaataagcatgatcagataagtcagcttattttcatttggaacatctgttgttggtgcaggtttgagggctttttgtttgcaatagttttaagaagctcaaattaaagcagcccttttaaatcaaaactgggaaaatgagcagtcttcattcacttgaatgtattaagacattctgcttgggctctgaacaacttgagaaataaaacaaggagaaagatggaagccaaaataatctttctattaccgatacaggccaggttagaggaatagcttgatgggggagtcaggtggtctggcataggctgacttatccatccagtcctaggctcagtagagaagcagagctgaatatgagtctttggaggtttgttctcctttgaaagctcaaccccaggggcaagaggaatagaactgagctcttcctcaaatccagaatcaccaatcggataattcactttactagctaagggtaaaaagaggctcaggttgtgcttttgatgcatccttcctcatagaaaccaggagcaagggaaaggtattgtaacaatcatggctgttaatttttgcagggttgtatctgggggtaagtatactggaaacaatacaactgttaatattctgaaaacaagtcaaatttacttgttctggatattttaaaaaatatgttatggccgggcccggtggctcacgtttgtaatcccagcgctttgggaagctgagacaggcagatcatatgaggtcaggagctcaagaccagcctggccaacatgtacagaaaccctgtctgtactaaaaatacaaaaattagccaggcgtggtggcaggtgcctgtaatctcagc

SEQ ID NO: 110807 - DNA, 1060 bp, Homo sapiens
ttaaattataaactgtttagtgacagtaactaataagtcctcacaagtggtagaaaggacttaatggaaataacccagtttcttcttagcccctatcattgtaacattaggcacaaatcattccactttttacagatggaaacctatgaaactgggataatatctgtcctcaaatgtttgccatttttattcctatgaaagatgctataatatttatgtagtagtagtatctgggctgaaggtataaattagaaaattaccagcataaagatgatatttaaatccacagaaatagatgagattacttaggaataggggacagtatatctagagtataacttgagtatatcagagatagtttagatagtataactagtaggtgactcagtaccacaccttaaggaatcttagccttccttgggcagaagaagagaaacctcaaagtaaggtcactggctgaagagtaaaaccaggagggagtggtattaccaaatccaagaggagagagaaaaatattacaataaggagggattgttacgtgttgatgagatgtcaagtaccatgaaacagggaagtgtacattgtttttggctctaggtgaccttgactagataaatttcagtagtgagggagatggcagccatattataataggttagaaagtaattaagatatgtgcaagtggagataacatttgtcgtaaactaatttaagagctatattttgaggaagaactgataaatacagcagtaattggagacatctggggtctagggatatttgttttttagatgggcgttaccatttaccatacttagtaagatggggaatacttttctgtatcagtgataaccatgattcttttatatgttaatttcattaagctgagagctgatagtaacaaaatactgaggcaaatatattagataaagaaatgggatagagttggttttaatctcttagtatggattctacatgtatttttttttccccttcaaaaaagtttcctaatcaagttactgagatgtggtatgtgtaacattggtgcattacacatttt

SEQ ID NO: 110808 - DNA, 1081 bp, Homo sapiens
aaattatttttagctcatttaaaaaatttatatcatactagatcatcttgaagttgctttttgtcggtatctactctctattttacttttcctgttaatcaacttgttgctactttctggatgcttcttgtctcctgctcctttatcttaccactaacttctccctcatcttgtcactgttgccatgtaaaccccataagagtagatttacttagaaatctggattgatgggactggtatggatgggtctgctatccaaaagactttgtttatacagctgtttttttcaagcactatcaaatgttttctattttaaaagatgtaaattgtggcaccttctaatagtgtgcattggacaaatggaatctgtgatgctgatgagtagttggatggttaagacatgtatcaagtctttctgtaaaataggcatattgatgaattttgcatgcaaattttgaagttctctgtactcttggatctttttatatttgaaagagtaaaattctgccatttttggaaccaagcagtgtgtaattttatattttgtaaatgttagatatgggctacagactggtcttaaccagtcttttttgtgtgatgccctctttgtgcacatactacatcccttgtttggctacatgggtgcgctgcttcctgattggctgtgcgcatgataaattgctgttatgtgtcctctacattcctctcatttgtctgactttcaaccctggtctttaattcttctgtcatagtgcagtcttgggaggagcaacaaagatatatagatttttggttatgttatgtaactttttattcctcattagtaaatctcatctttcaattgtaataacctacatttttggtgggaagtttctatcttttctttttagtagtattccttccttttggtatatataactagcattcatggctgatagataacagagcaccaaggacataggtccaaaattttaaggacctgcctaactgtatagagttcatacttaagagctgaatctgtaatcaagtaatctttgcaagagtttttattcacaatgcaatctagataagagaatgtgaa

SEQ ID NO: 110809 - DNA, 2789 bp, Homo sapiens
cgagtgaatcttggcatttggagttggggagtaaccctagtgtcttaagaaaacaactctcttaccttgtttccatctgctctggcaccacctcgcacccccgaccccgcctcccatgtatttggttaacgtcttaagatctttttttgactagtagagaagagatcgtattaggttaaacttaatacaatttcagttcagaaatgtgtaccgcagaacgcgatgaatataggaaaatgtatgagaaaggaaggttactttagggggcatttaagtgatgtttaagtaatttactgcttttgttttgcccttacgaaaaatgtattttggtcttctctaaggaaagatgatgagaaatagctttagtcaagtattcgtaagtgattttagtttatgaagtgtaaaaaaaaacctctaggtattctttatataaattgtttaaaaaactaaatattgttgtttgtgcttcttgaatacaaaatgggctgtttttgataattgcttatgtaaagatctcttctggaaaccaatttagaaattactgagctcatttaggtagaattaggtaggatgacagcattgcaacactggcttatgatattactgttaagttttgtcaaggcacaaagtgatttgaggatgtctttttatgttttggaatattttggttggtttttttttctggtcttcttgcttatttagatacattaagtatagctttgcatcataaaaatagatagacttgaaaaatagtcaaactttaaatgaaacacaattcattggatttgatggaaaaggggactagaatatctttttgccttacctacttgtatattcaagtaaaattggaagacattgaaagttactactgtattacacttttattgcaatatgtgattacattgtatcgtatgtgaaaagaaattttgtccctggcttctaactatatttgagaattgtttcccacagtctccatcctaattaagccctattaaaacctgtctcatattctttgttatttatttatttattgagatggagtcttactgtcgcccaggctggagtgtagcggtgctatctcagctcactgcaacctccgcctcctggattcaagcgattctcctgcctgagcctcccgaatagttgggattacaggcgtccgccaccacgcccagataattttagtatttttagtagagactaggtttcaccatgttggccaggctggtctcgaatcccattgttattttaaaataaacaataacatccatttaaacagagtatacacttgtcgattgggctttttttagcatcttaggtgttaagcacttatttatagtgtgaattgggattaaatggagtttggataattaccttttgctattaatgtgccttacattcattactttataaacatatttataaaaaagccatattattttccctttgcatgtgtatacatgtgtgaatatatatgcgtacacatatgtgtatattcagtatatatataatattcggtgctctcattgcttacaatcatttttataaaataatatccttcttgtcttttggtaaaggaaatgatccaaacatcttaattttaagtgagatatggaattgtaggcagcgtctcagggttgtacagcaaattagtattgagcccctaatgagattttgaatctcagttcttagcctaactctaatctgattcattttataactcatataatattctaattttatagggtagaaagttgttttagttgtcatgactgcttgtagttagccacaaaggtaaacgtttaactcttaatatggaatgagatatttaccttcctctaattgtggcattcatctctttatgttagatttttaactactgttctggttcattccacatagttttcttttcattgaagagttgtcctacaaccttttgtcccaattaatatctctacttacattgtggtactttctataatttgactgtttttctataattatcctatactgtactgtgttatagttttcagtagctcatgtcacaaatgttcgagtgcttattggatgtagtaaatagtatcctagtactaactatgatattgagaaatagcaaatatagtcctggatcttatgaaatgtataatataattagcatttgataagtcatacaatttaaaacaggtctagaataaaataaatacacctgtatatttttaaacatcatcaggacttgtatagtccattaggatatctgatctgggagactggccaatatttaaaaattttgtattttgatgtaatttcaatcttaaaagttggaagaatagaactcctatgtacctacatttgttgttttacattttgctgtgtttatcattcttgctttatactgatctctctatattttttcagaacagtttgagagtaattcagagacatcaacctctttacccctaaattcttcagtgtatatttttaaaaaacaaggatactgtcttacctaattacagtgaggttattaaaaccagaagatttaatgctgatacactgttacccaatttatggtccatattcagattatatctgtttatctattttttctgttagctttttttcctcttattctgggatccacttcaggatcatgcattacatttggtaattatgtctccttagtcactttcaattgggaacacttcgtcaaccttactatttcttgaccttgacatttttaaaagtacagggcagctattttgtagaatgtccctcaatttgaatttatctgt

SEQ ID NO: 110810 - DNA, 1009 bp, Homo sapiens
cttggcctcttggagttcctcgccggagtgctgactagtggatatttctgcccggctgcggcggcccgactgcccttttgtcttttctgcgtgacctcggggcaggtcctggtgcagagcgtcgccaaggacgccgagcgggaggcgggattgcccagacatccttcagcgaagtgcatgtgtgtttgtaaaccatcgttggctgtcgggagaccgcgaggaccggtccaggctgcggcggagtcgagggcgagggagaggccgcgtgagtgagcagagtccagagccgtgcgcccccagaactgcgcgtccgccccgtgcacccccgcgcgccatgcccagttgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatccttgggagacagaagacgcgtgatctcctctccgctgctcttggggtctccttgcagccctggccaggcggattcatcctcaggacctaaagttgcccaaggagctcctgctctgccagaggagggtggagagggcggtgggaggcgtgtgcctgagtgggctctactgccttgttccatattatttggtgcacattttccctggcactctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcag

SEQ ID NO: 110811 - DNA, 1039 bp, Homo sapiens
actggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccgg

SEQ ID NO: 110812 - DNA, 1065 bp, Homo sapiens
cagttttattttatttggccctagctttaaaaatatttattctggaaaaataatctaaacattatgaaagtaagaactgtgttatcaaattgtggtcattcaaagttggttttcttcccaagaagattaaatgtagacttcagattttaagatacgttttttacatattacttgaggactttaaaaatgtttacagtatatatctgcaaaagacaaaacctctgtctgaaataattaagataaattacagaccttgtaattgaagtacgaattgtatgtcttacatgccttgattattcaggtttgatatgtttgcattttgaaggcaaagaaaagctctagtaaaagaaacaacaattattttaataagttttcatgcctgccttaatagtcactttaagtaaaaataatttttttcaaaaaataataaaatctaatgttcattttaagcttaacacatattcaggttcactgggcaaaagggcagaagttaattccctgtaattgtccataagtagaaaaatggtttgtccccttccaagatatttataaatatatagactatatttttatcacctcaagtaaaacacagaaatgtctactttattttactattggtctttctctatgttaaatattacaatacaaggactataattgtggaattcaaaataaatttaaaatcactactttcaactaattttagagggaaattaaaattggtaaacatttggttgcattcataacaaagcttataagttcatagcctatctctaaatatataaaaaatactctgaaagtatttattctttgatctccttgatagactatgtgattagctaattcctagtaagtaacttgcaaagatattttaatctttaagaaagcatcaatataattcaaatgtttggtaaaatgaatagataatttaaattatcatttaaactttatgttttcaagaataacttttagtcaccacaggaaagtatcttgagtttagttgttaacttccaaaccattgaaggagttttgatggctttttatgcagtctctattttggttata

SEQ ID NO: 110813 - DNA, 1020 bp, Homo sapiens
aggcatgtggagtgttcatcttttcccaccaatacttggtaaatgtgtgcttttaagacaaatattgctttaacttctcctagtgttagtataattgggtttgaaatgacatttttcccactagctttgtcatttgatactcatttatgcttgaaaatgagctctgaaaatattattatgataaagccatgtaaggaatcttgaacagtcaagctgttaacttagacatttaaagtttccagcaagttgatataaagaacatattctttttaaattagaaaagtctaagtccctttacagtggagcctacatttgactaaacactacattctaatgagatggtatgtaaaagacaaatttattttttttaaggtgatgctgaattagttctccctgcatacacatatcactcctaagcatgggacagacagtgtgagtgaggctgaggaagtatgatgttggtagggtttttgttgtaggtctttacacatgagttcaagtagagaatatgttgtggaacaggtctgaaagaaagcatcatttatcctgtgttcatcaaggatctggatatattctctgtttatcaaggattagtctcttctgactaatccgacaagtttataggcaacacataacacataccttttcttaacagaatgacagtctaacggtgctaatcttcttggaaaagaattcaagcccatctcaaaagaattgttttctggtatctttccacacaagtttaaaatcatggcagtcattttcttggaaagtctctttaaaggacacatcaaactctaacagaggctgagtatgcacatagcataaaatataagtgttccaaaagatataatagccattatatgccaatgatgttcacctattcgtaagcaatgtggtcaattttaaattaggtttactgacgctggtcatagaaagctttaatccctgtgcgctgttacaagtttagcagaacattgaatccatctgagagaatttctcatgcaacagtttttatgg

SEQ ID NO: 110814 - DNA, 1043 bp, Homo sapiens
ctgtgtatggattattttagacaccattcactgtggtatttctgctggatattgaagtcacctaccttaggcgcctaagactgaatcacaaaaatcctttatcattgtgtgtattctggttgactgatgttgcacaggatttcagtttaaagtttagaccccagtaatcatcatcttagtaagcacaatggaaaactgctgtaaagagtcatgtaacaaaaggtgtaaccaacttttgatttgcaatgcttgaattctcctgaatgtcatttcattcttttctgaaatacaggatgaggcatgacactaccaaatcacagtctcattgttgggtattttctatgtaacataagctttgtttttgttttctcaaaaggcgtttaaacagaaatcaccttcagctgtttcctgagttgctgtttcttgggactgcgaagctatacaggctgtaagtagacacaaatagttattgttgctttgggtagtaccttgtgttttattaaatgtattttggatctgtttgtgtgtgctttcctggaatctgttcatcaatagattaatggattaaaagtttgtgttttttctttaggaaatttatgatttgttttctagtggttccagttgttttatttggttaggatttagcggtttatgtatgtgttatggaaattggattattattatttttttggtaacgtgatgatggcgagatttacctaccttttaatggaaatgtttgattaagttctgaagggagaaaattgctactgtttcctcttaagaggaagttggcagtgtgttcttataaagttgagatttttaatgtcagcttttttggtattgtttctgggctcaagtagtcgtgtttattagtccgaaatattattataaggtatttaaagagggctgtaaatttcctcttaaatgtttcctttaaagccacaatttcagcctctgcaatatgaatgactgtatggcaaggttttcatatcaaatacgtcatagactattaaaggaagtaattccttaaaggagcataatgt

SEQ ID NO: 110815 - DNA, 1054 bp, Homo sapiens
ttatgtttcaggagttatataacttgatggcctagcactcaatattgacaaagtgtatccctttacatgagatttgacatcagatttaggcactggatgtacatagaaaactagaggtggaatttttatttgcatcctcacgtcaggaatcttaatttgagttaaggaactgttgcttcatctgaattagacttaggtgaattgttgagtgctttttctctcgagagaataagttataagctgcatgtgaccacttgtttatgatggtgataattaattaaattaaacaactgccattggaagtctttaataaacaaaggaacacgtgcttgtgaagctcactactggctagtgtaattatgaaaagcaagggtacaagttcacattttctcacatgatacagatgccaagtagctcacctgaaacaaatattctagcagatgggaaaatgtgcacaaacctatatgcacaacatcctttataatgctcatttaaaaacatatttttttcacaagaagaacaagtgacagaacaaaggatatggaatttttgacaaataatggggaaaaatgataggacaaggaaagtatttgatagttgatatatatatgatcgttttataaatatgtgtaaaacaatatataagtattctataaatatatatttatagaatatatgttttgacatttatataatatataattattatacatagtatatatttatatgtaatataatatataattaatttatatataatatttatatataatttatatttatatattatatatatatatatagcaagccatagttgcccctactgtctaatgcagtagaggcatactatatgcagaactcataaaaaaacaaatttaggatttacttcctctgtataggttgttccgagatacgaattaatgtttcaatttcttttcttagttattgtatactttattcatacttaacactatgttttcccaggtatatcactaataaaaaagtttactggtttaatacatagtttatacactgaagtttgatttttcgcatt

SEQ ID NO: 110816 - DNA, 1011 bp, Homo sapiens
tttttcacctaagcaaaatataccttaatttaataaaatgttttataaaacgaactccctagttcttggatgtcagtttagtctcataggtttcttggagtcaaccatgaaagcaggatacaacagaggagcccatgtacaaatttctcttgaattaatttctgccagctctgattaaagtgtggactactagagatgtcaggtgccatcgtttcctgcttcattttactcttggcctgtttggcccctgccacaataaatccgactgtgattgtgcaggaattgcaggttacagttgctacggttactgttgttcagccagaccgacatcattactcatctagcgcgctgccatgatagctaccgctgatttctgttgctgagactgccaaagagcttcatgtgctaagggtgaaagttccgtcgaaggtggcgtctgtgttctaatttggtgtaaggaaacactatctgaattatatactgatactttgctaaggggaacagattgactctgtatcgagagagaaaacttagaaaagtgttcactttcagtgattaaaacaccaagtccttcattactaaggtaactttttaattacttattgggcccaagggactatgtttttgccacttaaaaaatagaggcatacaaggagtattgcatttaaaaaaattaccactatttaaccaaaactttattttcaaatagataggcaacagacttgatatatggacatctgaacacaactcaaaatagccattaccacttgtcatgaaagaaagaaaagtgcaaagccctgagcaggacctacttctacttttattttttaaatcaacgtgtaatcctgtgatttaaacgtcctaaatccaatgaagattaagatcatatttgagattttgccagatctagtgttgatggtttttacttcaaaggaattactaatagacttgttgctaaagaaagctaacagttgtccggtttctgctgttaccaacacacagagtggacct

SEQ ID NO: 110817 - DNA, 1049 bp, Homo sapiens
aggtacattagggccaggatattcttaatgagatctcttcatgctctcccagttgatgattcatatagttttaaaattcatctataaaataaattacagatagaaacaaaaagactgtgactcaggaactatttgttagtgcatatatttagattgctgttttaatgatgtgtttttctgaatgacaaatgaaggaaaaatacaaatgttagaaaatgctgagtaaactccttaaactataggtaaagtattctgaaagttgttcagaagatttacatatgttgctaaggaacactttcactactaataaaaattttattttttaaaataatataagattactctgttagctttgtaatatgtacatatgatttgatctatggaacattgtcatctttatataaattgcataggtgattttaagtgtatttttagactactaattatgtcaaaatccagtaaaaattgcaaatcttttagcactttaaatctaaataatgttacattatgagacaagtttgaaccagaagtcgttttgttttgttcttttttccacaattccagtacttctcaaagtagcatagatctatatggtgtatatccactcattacatgttacctataactgagttgattataatcactgaattttttctggagggttaaccttaaaatattttataaattttgatataagaaacctttggatggaagttttaaaagaaactaaatcttagagaaggaagcagtgaagagtaaaaagaccagtccttgacaacacctatggcctagggtacagcatagaggtgtgaaatgttattaagagaacatctgtgtctcttgaaacatcccccaaatgaaagtttatagcaaagtatggcaacttgatttaagtgttaaaaacaaaacaaacaaacaaacaaaaacttaaaagagaaataagtaaatctggaaacagaattggaaaaaatagctttgccccatcatgataggtttcttctgctagtgaaagattaaagctcgaagtatgtgaatagctgagaacagca

SEQ ID NO: 110818 - DNA, 1868 bp, Homo sapiens
gcttcccctccgacagttccaattgattgaaaaaagcctaatttaaagttctgtttgttctatgtcttaaaccatcagaattctcttttgggacctgaggaatgctctggaggaaaaagaatccaaggataaaaagtcattgcaagccaacaattgttcctaatcctcacaaaatgctggagaaattaaatttattctttattgctcaaagtgttacctaggtcactgggcgatgggaaaattggactggaagtcgagtaggcgcaagctttgttttgtgtctagatgcttaaccttagacacgacaaggcatcttagagtgttgtgggaacttggttcagagcattaacaccaagacttttattaccccggatttataataggctgtgctgtcaggagatgaaaatgttgtgtttacatttcagtgttaaatgatcatttaattaacacctaaggggaaaaaaaacttgtgaaattcttagcagcttttattgttggtttcctgggaggttttaatatccaagtttcattgagaatttttttgtaagtaaagacacaaaagacattataaactttttaaggaagacaaacagtttaaccttgaccctttaaaaaaatattaatttaaattaaattttaaatctggtgttcttctcataagtttctagactaatatattaaaatacattttgattggacactacttttgtgtaaacagtatataaatatgattgaatttacattatacattttctagggtaaaacatttgaaattactgattagtttatcttaagaagtttaaaatgtttagaacactgacttaaacattttgcatctgttaaactaccactgtagttacattgtttagaatctgcctcaatgtaggtattcatatgcaagcatattctattggtaagttatgtcattattctattatttttaatcattaatttggatatagctacatcatgatgaaagattttcatcatgatgtagctatatccaaattaatatatatatatatacacacacaaacacaatagggaagaataatgccattaatatgaaaactcagattcacttaattagaaataactaaaagattagacgtcataaaatgcttttatttactcttgctcttttatgagacagttaaccaaaaaggaatggtcttgaggcagagtgataacatttggaagatgtaatgtgtactgtcaagagtagctgcatagttagtaacactttaagggtacctctctaaaactatctttaaagtttacatcttttttattcccattttatctgaatatgaagctttatgttcaaatatatgaaacttaaaaaaaatttaccagtttacatgctgttaaagtaaaatctttcttaatttttccagaaatgaacatgtcattatgatgtagtctttttctaaatacactgtttatgttcacactgaaacagaaatgcttatctgtttttttttttgttgttgttgtttaaattcaaatgcctcaggataaaacccactctctgtcttattcatgataaagaagtgcatggaaaatggaatgttgttaaaatctctcaataaaaagccctgcttttaactaaggattataccctcacttacaaaacactactgagcaattatgtaggcactttttatgatgttatatgctctacttacttctatcaagtttcaacctttctgcaaactttcctcattttttttaacacactttgatctttttcttcccaaagcgacttttctacccagcctcttgtcacaaaaacccagaaataggaatatcgctttaaacattttatcttctttacgtaaggaccaaccttctggttgagttagttg

SEQ ID NO: 110819 - DNA, 1816 bp, Homo sapiens
gcccggctgatttttgtgtttttagtagagatggggtttctccatgttggtcaggctggcgtcaaacttcacacctcaggtgatccgcccgcctcggcctcccaaagtgctgggattacaggcgtgagccactgcacccagctggttaaaaaaatgattaaaggagatttgatgcttatgccttattaagtggtgatcttgatacttgataatctctcaatatgaggtaagtggtgtacaactgaggtagttttaataatcacctgtctctcaaacatcgctagtggtagcatgaagaaataagttaaaaattaaacagggcaaatcaagataatataatggatttggttaataaaggtttatatgttcatatttgcgttataattttttttgtaataggttggaagcagggaccatcattttctgtaattctccctaggaaatgcattgtgcacccgggacaattcattttcctgactttttgaggagaacagaatgtgtggaacctgaataccctgaaggcaaaggaatctggagtctgtttctaagaggagagcttctctctgacttggtgtgggttttctttccctctgttgaaggggaatgaattccacacctaatgaatagtttcaaggaaagttgttaatcaggtactccaagtgaccaccctggattcttcttttattacacaggaacgtgagggaatgagaaagcagcatagttacatttgataaaaggaaatactctttctcctctcccctcccaccacaccatcccttggaatttagttgatgtgggaaattactgcagcaaataatgtgtttgaaaaagcaaagttgtatgaatgagaataacgcttgtagctacaataattatgttaaaaattcacaaggtatatccatcatcatatttcagagcaagagttttcgtctaacgaggttggaaaagaatttttccttagttcttgtcaatctcccagggaagcatggcatgcaggaataactgttgttaccaacattatattttgtgcttttctgattcatcagaacctttctgttgccgtaaaatgggaaacttcatcaaaatcagatgaagaacttcaagtaaatgtgacagaggggtaataatgaactataaatataattgatttttattcagatggacaaatgttattctttaatcctttcccatttagaagccatactctaatttaaaaagagaaaagtggtctctaatttaaaaagagaaaagtggtttaaaacaacaacattacagtccagatatttctctgtcttctaaattaagccacctgggttgaagaacactattcaagtgtgggtaaacatgttttgataaaaagttttgttatttccaaataactattatacccccaatcataagtgtgatatctattaccagatactcatttgggttgttttttaaaaataatatgattcagttttaggtttttaaaagtatagttcttatcttcaattctcaagaatatgtaataccttttatttattactatactaattttatattatatttcaaagaagtgatacctccagtgtgcactccagtggttcaagagaaaagtgttctgtggtcaaatgtgttgggaaataatgaaagtcatatcacctgtggtggctacagtgtacacttgtgtgttaatcttaaaggcatactacaataaataaatctgtttaaccttttaaaatttgtttttcaaagttatttaactatagaggcctctcttctttcttaactattcctgtttgttcttgttaatccagagagcaaaaccagtttt

SEQ ID NO: 110820 - DNA, 1076 bp, Homo sapiens
agggctaataagcacataggagaggctggataaatacttgctaaataaattcaataaggtcttttcttaaaaacaattttctttaaaaaaaaagctatgtattgatgtttaagttttataaagacttctcattcttttcctccaagtcaaatttcttttattgaaacagaaaacttgcttttgaaatgaaacaaaatttcagtaacatggtatctgatttttaaacagcctatatagttgcacataacagagtgtgtttatgtgtgcaaattagtaagtcgatagaatttccaggtaaacaatcatggctgttattgtatgccatcacgtttattatggaaacatattattgtaatttatctgggaatttaaaaaaacagtgtgtgagtcagcacgctgtggtacagagccaagtttttgtgggcaaacagggtgggattccgatcttggcttcagcagtgtggtgtgtaggcctgggttcctcacctgtggatggacgctccttacctcattggcttgttgtgaagatcgaatgagtctgtgaggtcagtgaagcacttacacttagtaaattctcaataaatattcactgtgatgttttttattagaaacactgacacattactgagtgcatgtgctctgcacgtgtgcatgacaatgaggaaatttccctttaattcctgaagtgctgggtgatgatctatacccaggataatttttctagtaaatcagcttattggggatgcctatggataaagcccttcacttttaaggtattccctttaatttaacaataagacataaaacattgaagtatacaaaatgaacggctatggttaatggattacctgcaaataaatgacacctgtccaaatctggcttcaataataagggaattcatcactttacaaaaacaagaagttcagaggtaggtcaagccatagcttttagttactttctccctcttcatttctccagcctcactgtcagtgtccaaaggctttgctcctggtgtcaaaacagccatcagtgtgccttgtgcttcctggttcatagtcagtgagagagagaaggga

SEQ ID NO: 110821 - DNA, 1424 bp, Homo sapiens
gaagccttacctaatcccccaggttaaaccatgttccctttataaatccccacagcatcaggattctttcctcaactgtttttaaatacagtcagcccttcgtgtctgtgggttccccatctgtggattcaaccaacagcagatcaaaaatatttgaaaaaatgaaaaagaaatgaaaaataaccattaaaaaatacaaaccaaaaactatacagtataacaacaatttgcatagcatttacattacattagttactgtaagtagtttagagataatttaaagtctatgagaggatgtgttaggttctattcaaatactaggccatgtaagggacttttgcattcttagagtttggaatccctattagcctagagcacggggtcctggaaccagtgtcccatggataccaagggacgactatatgtgtgtatttgtgtgattacttatgaataccctttcttcactagagcttgaaaacaggggtgggttttcactcatcattgttttgccagtgtctggcatatggtggttgcttggtaaatatgcgttgaataaatgctaaaaaatactgttttgtcagcctgttttcatggttttttttttttttctgattacactcatgatttacagaagaaaggttagcatttgtattaatatcttatttttttctgtatcatttttcgtaataacctatatatcagaaaatcataaagtctgcagggacagcttctgtgtccctagcttaaattattatgcccatttccttcttttagggctaagcttaaaatttatcttcactggcctttactcagtcaaggctggattgggtgtccctcccaatccaggggtggcccagcatcctgttaatgtggtcagcacccaactatttttttttcatctggctctccactgaacttaaaagtagagactgaatttagttcgatatgtttgcccattgcccagcacaatgcctggcatattagacaccagagatacttttccaaatgaatgaattaataaatgcatgtcttgcacttgtgtgatgttcctcagatatctaagtcgttcctggaaaagcattcagtaaatagttgtaattcagtgcgttcagtgtggtatgcacattcttcaaggattgtccaagttaatctactttttagtgatcttatcactggattgcagattgcacactacatacgagtatttggctgaggaggaggagaatggggcctgaaatccagcatgcactctgaccattatggtatgtctgctcctaagaaacctcatatatatatatatatatatatatatatatatatatatatatatatttttttttttttttttttttttttttttttacagcaatgctatgtgtaattgcatggtcctaaatgtaggaacaaaaatgttaaaaattttc

SEQ ID NO: 110822 - DNA, 1018 bp, Homo sapiens
aaatttaaaattgatgctctgccgaaaaggcataattgtaagggaatctataattgcagccttcatttctcttgagtactaggaaaaaaaaataagaaaggaaaaatggaaggacagatattattaaataaagtgttactagcatcacatgctcaaattaacatgttctttgccacagtgctctaaaggagatatttgcactttatctgtatgatggccagtgccatatatgaagtatattcaatccaagaaaatgtctgggagtcagaagtatgttcagacaagttttctatcatgtgttgtctaccagccttttacatactgtagatattctagaaagactaacaagctagacaaattaatttctccttttgttatgcttatgagaataaactgattaaacagttcctattctatctgtgtaaacagagacatattagttaacttactgcttattttattttcccacatacttacagtaatttcaaatgttgaaaaatgaggagagcagaatatggcattaagcaaagagaatgaaataaaaaataaagcaatgatctgaactagaaaaaaaagttttaaaaatgtaatttttcagttacacaaaagttaccatggcattacctttccttttgtgtctgttggtgatttaatttagtagttttagaaaatgtgtctattgctgtatttaaaaattctaattacagcaattggtaaagaagtttccaagtacaaggggtatttgtagagaacctgtaggactgacaagtgattgacaggtaaacaaccccactgtggccttatattccattctgtgatgttggactatagatactacataagcctcaggaagtaaccaccttccaatttttattaaatgcttggcgtcatggatgtaaacagtattgtgccttagttgactaaatgtggcactttcttttacactgccgcaccaccctgactcagtgtgatggaatatctgtgaaaagaacaaatgggaacttttctttaatgcgtt

SEQ ID NO: 110823 - DNA, 1025 bp, Homo sapiens
tttttataattcaaaatgctggctatttgggatacatctttatttttatcttaaagagataagcatgttactggctatttgaaactttctgtatgagaatgtctcttttttgcaatgctgcagtgaatcatgcttgtaagaatggccaaatagacctatgtttgctaacgttagattcttgttatacccaattacccttttgttcttcatgccattctgaatgtcattttgcaccaatggccaggcattaacggggcatactaactctattgtacctgccacttatgcagtattagtttcagactccctacttttaattgaagagctatgtagttaaattatcatgtcatgaattccaattcactagaagagctaaggaagaaaatgctattgaaagctttcccaagtaacatttcttttaaattgacaagtctttagactaatgagatattagtagaggaggatgtattttcatttgtaaataaaattgagattaaaaaatgttaaagagaaccattttagaataatcctctctctcctgagaaaagttgtcttgacaacagtaccatttataattagaaatgatgaatattttatttctcgaaggaaaattctccctaactatgctagacagtgatcgggctaaatgttcatcaggctcaatcattttttggtgcaaaaatatactgtcgattttttggctcagtaataatcaagccttgccttgtagtttataaggactgggttttcctatgcatttcttaatagtaatctgtgaaattaagaaaaagagatcttattgacctaattttacagaaagagtatgtatctaataagtgacaaaaatagaactagagaaacgaagattaatttttttgcttttcatcattttgccaaaggggcagaaacacatgacacatttcagagttgtgctttcactcatgttcgaatctattcttttatatcatggaatttgtatttctttcaatttaaaatattttattttctttgcctattataagtga

SEQ ID NO: 110824 - DNA, 1060 bp, Homo sapiens
attccatgcctccatccctccacccgctctatttctttccctccctccctcccttcccttccctcccttcctccctccctccctccctccctccctccttccttccttccttccttccttccttccttctttccctgactccctctctccaccccctctatttcttttccttccttccttccttccttccttccttccttccttccttccttccttaaactaagggtctccttgtcacccaggcaggagtgcagtggcgccatcatagctcactgctgccttgaattcctggactcaagccatcctcctgcctcagcctcccacgtggctgacactgcaggagcacaccaccacactcggataaattcttaattttttttcatagaggcaggatctcactttgcagtccaggcttgtctcaaactcctgacttcaagtccctccttggcctgctaaagtattgggattataggcatgagccactgggttcagccagtttcttattcttgttagacatttgattaatacttgttcaatctatatatgcagttactctttttgaatcttacctatgctgcattaagacattcaagacaatggggtgaaaggacaggaaactagtatttagtaagtgcttaagtgtataccagggactctaattctttgcatctgttcttttaaaatcctattagcaactgtttaaaataggtaatattatgtccatgcatttaaggacatgaatctcacaggcagtaacttgcccaagctcacatggatagtgtgaggcagaactgggatttgagacccactgcctgtcccctgaccacctccaaagcccatgtcgttttcacaacacagcagctattatctatttggtgctacacattgctttaggaactgctgattctacattgaataaaatactctactgtctttgaaagactcacatgccagcaaggaggagattaattattatgatttttagtgataagtgctttaaaaatgtcctatggctaccaggccagggaccattacctgtgcctggcaagagacacgcttc

SEQ ID NO: 110825 - DNA, 1050 bp, Homo sapiens
gccctttctctggcagccaaaaatttagtgcttggttttgtgttaaatggcagtggcttttcttagttaagtgtttctagtatattcttgttcaccccgatttactattttaatgctcttttatgattttactctgtctgtgcccttaaaaaatctgttttggaagatgctggagtataaatagcatagaaagtgaactgcatattctgacatttacagttctaaggataattctattttaaggatgattctgtctgcaagtaaagttattagctatctatatactatatgttttagacaaattttgattgtcatataccttttctcagactctatctactgtgtcttgtttattgttgttgttgtttttcttcccataaaaccatgtctcttttacacaagaatgtgtaatgactcagtctgacttagtttattattaaactgatgtttcaaagggcatttgattcttctgaacccttccataggccctaaattttcttaattgtaccaaatcccatatggatttctataccccagaaagtatggctacccgtcttgctcatttccaactttgtgcttttattttttctggttcttgttgcatgtgcttgcattttttccttgggttttcaactactccacttctgccttgtctttcaaagcctggcttaagactaacctcttttagtaagacttacttaatgaactctaagtgactcttattctgagtcttcttggaattatctactcagtttttgttctattaatttgcccttatttgtttgacatgttgaaagcattctgaaacctttttttttttttttttttttttaagtacatgaatgagttctggctccagttagaaaatttgataattgtttcttagaatgtgtcttcttttcctttttttattttccccaaaccacagagtttaatgtgctcattaaataatattggctccctaattcttagaaagcatagaatattgattatgtttgtcatagcaaacattttattaggaaataacaagataattatttttgtaaaatt

SEQ ID NO: 110826 - DNA, 1497 bp, Homo sapiens
attactaatcccctccatctataatctgaatacctttcccatcaatcttgccttctccaaaactttcttttctcctttattctctttctctttttaaaatttttaaatttgctttctgttttaaatttatgtgggaacgtagtaggtgtatatttttatggggaacatgagatgttttgatacaggcatgaaatgtgaaataaggacatgttggagaatggggtatccatcccctcaaggattcattctttgagttactaccctttctttctcttaatctaagtgtttcccttctgtactaccttctttatttaatattcttctaacccttgggaagagaaggagaaataataaccacaaaaacaaaatcaaaaatccctggacatattaatttatgtgtgaccattcttcatttatgtattataatccttttaaaccaagggagtatctgtatcttgttcattcattaaatatttattaaaaaccttgtagtgctacttctcttctggatgtttaggacatattaataaacaaaatgatccatgatacctgccctcatagagtttaatttatggccagaagagatagacaaaaacagtaacataataaatattttttataataaatatatattttttgagatggagtctcgctctgtcccccgggctggagtgcagcggcgagatctcagtccactgcgagctccgccttccaggttcatgccattctcctgcctcagcctcctgagtagctgggactacaggtgcccgccactagacccggctaattttttgtattttttggtagagatggggtttcattctattagccaggatggtcttgatctcctgacctcgtgatcggcctgcctcggcctcccagagtgctgggattacaggcgtgagccaccgtgcccggccaataaattttgtaatatattagaacacgttaagttctatgggaagaaaaaagaaagacggaatgaggagggtagggatggttggtttcaatttcaaatagatagctagataagccttactaagaaggtaagatgaacaaatacagagagatacagatgcctggggatggactaaaaagacagccagtgtagggccttcaaaacaagttgccactagtaccccaaatgctgaggaccttgcactttgtaggagtatttgaaagtatattgaaataaagagcaaggggtcactggccttctgctcagacgcatagactttagcaaaggagagctgaaggaattgtgttccccttcagtacccatggagaatgtgtcctctgttgtgtaagaaagaattggatgagatattatactgagtcaatgtttgtaccataacaccttatttttccttagacagacagtaaagcaaccactaagggtgcttaggcagccccacttactgttttgtttactgtaacttttagtgttcaccaaacacatcttcaagggcattttaaatagacttgttttcaaataga

SEQ ID NO: 110827 - DNA, 1055 bp, Homo sapiens
tcccaaagtgtgggattacaggcgtgagccaccgcgcccggccacaaagtatccttttaaatatagttgaaaccacaaagggaaatgtggtgtttttgctaccgtggcttacaatccaggagagtagacagacacctgatgagacagatacccctctgataaagttgacaatgatgtaagtgctataaagagaaaatgagtttctctgggattggggaagtgagaattcattttgattagagcaatttgggaagaattcttggagaaatttttttaggtattatacacgatttcatggtcttctccaagattttgatatttctctcggtctctctctttcattctctctgtctttctgcctgcattgaaacactgctagcaaaaattttgatgttgccagggcatataaggctttaaatgaaaggaatagccatctgttgtgactgactgaggcagggagagtggatatgtagtcaatattttctctttcctttccttttacttccaaagtcttcacacatgatttgtatcctttttctgtctccctcattgatatcctggaatcttttgctctgtccattctagtgaactgctttgtgaatggtcactgttgaacttgacttagtcaaatataagaacttctaatcatactaatcccctttaacctctgtgggttaagagatactactgataaccctagcttctgaaaatcattttctcatgagagtttctttctgttattttttctgcacttttcttttgtttaaatatgaaagatatttttctcctctaatgcatttttggaagagaacatgcttaattttaaattctgtagtgcttaccttgccacgtgtatgtatgtaatagaagctctataaagatactgagattaattttgggagtgattatattggtcatacccaccattaattattgatagtaaaatacataagttatgtggatagaattaaactaatatttttgtgaaataatacaaatatctatgttttaaatcaaattaaatttgattttaagtttgcatcctatgaggcagg

SEQ ID NO: 110828 - DNA, 1067 bp, Homo sapiens
ttattactcacatttccattagtagaattctttccaagagaatattctccttattgttttccatttcaaggtgtgtattcaggacagatgagatttttttaaaaaagacattttcttaaggaaagcttacattttaaatgctacttttcctagcaaatgcaggtggtcattgtatgaagcacatatgaaatgaaacctttgatttaataccaaactatagcctactgtcaactctaagaaaactgtatgatccataattttaagtaaaccaaaactttactttgtttctaatattccaggtggtcttttcagactgatatctatgtagaagtacgcaagaaagtgacgtgattatctgattatcagattatgtttatatgtctctgattgttatcaagctcaaaattttccttaaatagctatggaaagagatagcagtttactactactactattattattaggtcatctaatgtaattcaatttataaatctgatgcatacatttgactgataggatacagacttttaaggacctagcattataaaaaatataatttaaatacatagatcaaatagagccatatataatattgttaaatagggaacaagataaatgattatgaagatgtatagatcttttaatcattcagtgtttgtttttagtggacattttattttgggatgccattcagtaacttgaagttattaaatgaagcataatcaatattagaacaaaagccagcataagaagatttatttaaatttgatgtatttagaatttggagtctggtcactagaattttgaggctaggtgattctatgaaaggctgtatgtaaccaccttctactctattccttcctctccacccaggtcaaatatcccagaatatggtattatttaagtatcatcaacttttaattttagtgtgtttccattttcaaactaagacaggtgcaaagttgaggttaccagcggtacaagatcagatcacctagttagatattgatgcatagtaaaatgtagcctaacacactctattcataatgtggattgacaactaagaa

SEQ ID NO: 110829 - DNA, 1110 bp, Homo sapiens
acctcctcattatctctccaggaagcaggttgattctggccggcaaagctccctgaggtgggatccattcagtccattcttacaggggtaatagggcttggggctcatttcagtcagccttcgttggaagagagaggtccctttcctttccttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacaaaatagcaaaaaaaaaaaaaaagaaaaaaaagaaagaaaaaagagaaagaatgggaagtagagaatttctaacacagtcatctaacagactgactcagatgtaacaagaaagtataataataataaaatttaaaaaaaaagattaacagaaaacaaaacaaaacaaaaaaaagagaaagttctcagtagccctctggaaagagaaatttctaagcacaacttttttttgttaaagataattgaaaataattatatgtgtgtttggtaaaccacaacgatctttctatattgttaacacctaaagtaggtgaagaggttaatgaggaggtttcccagcaacaaatttaattgtagtcatgtaaaaattacataaactcaacataaaatttgaacacctgtgcaggaatctgaaaaaatttcattctaagtaattcttataatttggactctcagtctagtggtgagaatttgaaaaagtaaagaatgctcatgataaagtttgacaggtgctctgaaagcagtaaatatgaggaattaaggcaacctctacttttgacatcgtttgctctgaggaagtattgtatatcctgactttaattttttcaggaccctgtgcacttacaggatgacagaaatgatatttcttctctcctgaaaccctggggttgatatttacatatcacactcagacatacaaaaaa

SEQ ID NO: 110830 - DNA, 2158 bp, Homo sapiens
aaatctttaaagcacatggaggtgtcctggggccgctctgctctccactcccatcttttcttcaacagttgctaggatgattctatctgaagcccccactttttcaggcttcctgtgcctaagttcccattgcagctcatgcagactgcattttggccctctcacacagtgcatggttatgccacccgagagggaaaaatgcactgtgatcatcactgataaccaccattatacctggtcaaaaggagatgtgtaagaatgtaagaagttattttgcctactgcatgaataattaatgctagtggcctgttttccatatgtatggaaatatagagagattcagccaaaaatactgtactcttgtacttttttttttaatttggtgattatccatttacctattttaattacaaggaagagctccaaagaaataggaatgttttaggaagaacttgatggaaagtgcctaactgctttttaggactattctgtgcaatatgtttttaacaaaaagagagattccatttatccagcactattttcatcattctgttgcttcaagtggatgagagggttctcttgtctttcttattcttcacccacttttagagtttaacatcttacatttactgagtactctttataggtacgacacattatgccagttgtttttgaagccttgatttcatttaattcttcagaccagtcttagaggtgggttgattctatttccatttcacaggtgaggaagcaattattttgagaggaatttacctgacattaagtggtgcagaaagggcagaacatggcttcaaaactagttttgtctgctttgtgagcctgtgatctctagaggcgtgattattggactttttttttttacctccttaaattttacaaaaaactaaagtgaggaaaagaaacccaaagagaaaaggtaaaatactgttgaataaaacctgttttctgactttttattaaaaagaaatgattttatattatctattgttaattttctaatttccaaaattaactttgtcctgtttgtaaattgtctttataatttatatctttaactgtgttctatagcatggatcctgctaaattctgactttcatgctgggaaggaccctattttccatttttatgatctttgttggtttctttgctctgttcttacaattttgcatatgaattctagaaataaccagataagagaaagcaaagcatagactaggagacttttaagcccactcacagcttcaagcatcatgataacaaaattgaaagcaagtgtattgatttgggtggtattatatttgtctctagggcttgaaaagacctttaatttctctctttttacacaccattttttgttgtaagtatgtttacaaatgaataaatgtcatatttaataaacctaatggagagaagttgcctttaaagaaaccaacagatatgagcatcatgttgtgagcatgtttacatttacgaacatattattttctcattacctactcagttatttagaaatcataggagttagatgctaaatgtcattatatttatatgtgaagcagcatttctaatctccagtcacttctttcaacttacacatctgactttgacctctcacttcccatggcatttcagagttgttacagaatttataatcaaaattagtttggcagcttagaacttattggaagaaaaacatcaccttattctgccgctattatcatactcaagaaaactgctttttcactttgtttaaactgtatttttgacttatagtagatcaatttctccgcatttcaatttacaattatatgtaacatgaatctcaatttttgaaatacctaactcaataatgtatgaaatcatttataaaataatttctcctatttgctttgaaggaaattttaaagagataaaagtgcttccactttcacacacaagtttaactcataagtttaatggtgaccaatattatattcttggtgtaaatcctactaaaattttatctatcctgtaatattaaatatatataaattacacacagtatgtgtgtgttattaatatgcacatgtatatgtgttggtgtttaataaagttggtttctacaaaatttcttagagctacccttagcattaattta

SEQ ID NO: 110831 - DNA, 1051 bp, Homo sapiens
agggcagcatctttattgggatagccagcagtgctgaatcaatcacgtcctgttgtggttggatctgtatgcagattgtctttgcacagcatgacttaataaaagctggccatggtggtattttattataattatgatgacttagttgcattagcatcagcctcaatcacacagtaaaagaatatttggtggctgaactaggaagtgtgagaacctccatcatttgactacttcagatggtgtattcatgatccttgaattaaaatcaggcaggtaaaagggttttcaatgaaaaaaaaacatgaaaaaggagtttgaaaatatataactactaaggaaaggaaaataaagccttgaaaattggtatcgcataagcttacgtggtatcattttgtcgtttaaaaaaatgtgtctctcagtctttacttagaaatatgtatggaactttatttaaaagtttcccttaaatgtgaacttatgtaaaatccttgtttagagtctttgttaggctaccatttcagaataataagattttacccccatgcatgtgatccaaagcattacacctctccaagccacctactaatcttgtctattcaaatgggattttttttttctaaataggagacaactctgcactgtatcctgctattcttccaactgcaggacctcatggagcgagagatccaaacctttctgaagtactttaccttctacctttttcatgctactcaggattgaatcaattggaagccaacaaagccattctgtgttactgtgcctcctgactgtcagcacgctgcactgtgcatttagataattctgccagaaggcatttttataaaaacagctttcaaaatctattcttgaaaagacatttgtatactcattatgccattctatcatttatccatagggagttctgtaaataaaacactgaggtctaatactatagtagctgatggcagtaatcttgaacagagtaatttctttttctttatttatctcgatagtgcacagctggttatgaaaaaataatcacaaggctttg

SEQ ID NO: 110832 - DNA, 1011 bp, Homo sapiens
ggtcagagtatgatatggggaagattaattgaatggtaaaagtgggtgtggagaaatgaggaggcaatttagtaatatagaagagggatttttagcatcctggcatagaaggatggccatagaaatgaagaaaagaagatagattttagaatccctagaagatgtaattggtaaaatgtggtgataggtaggtagaaaaagagatgagtatactatgttttcaaggtttctggtttacacaaatgagataggaaatataggatgagatatagccttagctataggggagttcataagttgagcatgagacttttttttttcaaattagttcttgattactctagaacttagagcaaactatggactgtctacataaatctaggagtcataaaatagagatggaaattgaaaacatagaactggattgagttatggagaaggaaagaatatggaataacaaagaaaagcgcttaagagcacctactgccctaaggaatgcgggcatttaatgatcagttaaagaaggaggaactaataaaggaagctaaagaggaatccatgggaatgtggtgacttagatgtctaagaaagagatcagaagtttgagaagaattgagaatttcagataaacatgtggattgccatgtgttagtatatcctgctcaagggtggtatccataaattttatacagatataactgaactctgagatttttccatagtacttagaagctaagatgatttgtatctgtttagggttggagctacttagggcacatgtaacaaaagcttgaaaatataaacaagtttaggttaatggtagagatacagctgctttgatgaaccactgaatctaagttgattggtctttcatcattattctcatccatcatcttctgactaaggatagaattgaagtcagaaagcctgatagaaatgaataaagtctaagttgttggtaaaaggtgaatgattttcccatctcatcatgtctcaatcaccacaaggaca

SEQ ID NO: 110833 - DNA, 1031 bp, Homo sapiens
gagacagtgttacaagaggccattgaatttcacttttttgaacctccgttgctggggcattggttgctggattgttattctgttagcatgatgaactaattgacctagcagggctccctgtagaataacagcttctgcttagttcatcaggagtacaatttgttgtttcatttcctcttctagtcccattggggaaattgaattgagaaaagactacctactgggagcgttcagtgctcatgactgaataagtaactttatttatgtatttatgtatttatttatttggtactgtcttaattagcaaagaaggaatgactctattaggcaagagtcgactgtgtttttgatacaaatgaataagctccgttagcaaaacatttgattcacagagacttgtcatagtcagggccccttgcaggtgcagatcttacataaaattttaatttgctatggtagagcagttttctgttttataattgttattcattcaatgaagacattgaagacaagttaatggctgttaactggacttaaaaaaaaaacaaaaacaaaagcaaacacccataagttggaagtttggaagatagattcattgggccgcatacaaacatgaaatgtcaactttgcctcaataaagatgaattatttatctacagcagtgtccaaatgtggacttgaacagtttgtcattaaattttgaagcctttacaatttttcagttgcatcattgtttcattagtgtgtgcattcttagtcaacaacagagaacatactatctgaatgtaatgaagaatgaagtctgatgatacattttacattttttaagaagctattactagtttctattgtgtcttagcaaattcttaagtgtattaagcagatgttctaggctatgatttaaacgtcccctatattacaatctcacatattttctagaacactgttcaatttgttgcttagcctgagagtaggggaagagtagcatagtcattataaactcttgctctgaaataagatatccctgattc

SEQ ID NO: 110834 - DNA, 1006 bp, Homo sapiens
tcagcatgttctactgtgagtaggagtgtttggaacttgattattgtaagacattccaactgatacaaatgataactaaatctctctctctctctttctctttctctgtgtgtgtttgtgtgtgtgtgtgtaaatctctcactctctgtgtgtgtgtgtgcttgtgtgtgtgagagagagagagacagacagacacacaaaatgtgaatgaatgaaggaaggaaggaaggaaggaatacaggagagaaatttttctgtatgttaggtggctgcgattttggctggccaaaactgccttttgccttcggtgaactggctagagctgctcactacaacccctccccatcccctaggacaaaaccactggacctttctctctttttgtctctctctttaaaaagacagaaaggaaaataaggtttgcaatcagtattcagacattcttatgactaataggattaggggcgttacgaagggatttgaacaagataattagtttactgcttagtccacagtgaagcaagaaaaatacttctgagaaaaggcagacaaaataggtcagaaaatgtgtgggaaatgaggtaagacctctcaacaaggaccacgatcaactggaatattatgaaaggactcctgagccttcattcatagctgcagactgtctgcctttttttttttttttttaatacttggccaccagaggtgtgaagcaaagtgacttacttaattttagagttaataggtgttgttcctggaccctgagtatcctgttccaagtgcataaatgctgccttcaaagtatttctcacaacgtgatgtaaggggaatgttttggaaaatctgaagagctcttatcgggcattttacaagctggaaaaaattatacaattaggagaactctttaaaaactaaaattttcttgaatagattcattactttaattgcaaaaataaatcttgaaaacataaatgtgaggggtgtgttctttgcttaattaaagtactta

SEQ ID NO: 110835 - DNA, 1126 bp, Homo sapiens
tccggaatttcctagatttgaggatgctctaaattttaagaccactgtaatatgaaatctgtaagcatcaaaacttattacccagagtggcttgcttactggaaaatgttgcactttttagggtatttgtcttcgattttatcaacataaaacatcaaattaattcaaatcacgtatttagattgaggtctacaaactgtaacctaaagtgaaatccagcctttttcctggatttgtaaataaagttaaattggaacacagcaacagtaatttcttcatgagtagttgatgactgctttcaaggtacaaccatgaagcggagaaattgctacaaaaatatggcctgcaaagcctagcatatttactgtctggcccttttcagaaaaactttgctgacctttgatttaggggcaagataattttgttgcactcttttggtcatgatcaataatacttaaattgatgagtaacagcctcctttgtaaaactaggcaaagtccaaaaattagagggaatggaaaatgcaaactattcaatcaccacagagttagttacaaggattaatgagataacatatgtaaaacatttagaaaattgcttggaatgcagtaagcacttaataaatgtaagcattttgtctcattcacttagtgatctcatataatttcttgatttttaattctgtaatgactcccaaatttatctttagtcaggacctgctctctaaaatccagactcatataccattgcctcccccgcatctccatttggatgtctgctcggcagaatctccatcttaacatgtgcaaaactgaatttctggtgccatctcccaagctggcttctcctgcaaatttccttctcatgaatgtcatcctctccttgttgaaggcaaaaaactaggagtcaggtcagatgcagtggctcacacctgtattcttaacactttaggaggccaaggcctgaggatcacttgagcccaggagtttgagaccagcctgggcaacatagggagaccctgtctctacaaaaaaattaaaaattatctgtgtgtcgatgtgtgcctctggggtcccagcacccagagaagctggggtgggaggatcacctaagccaggaaggtaga

SEQ ID NO: 110836 - DNA, 1059 bp, Homo sapiens
tgaagcttagagaagtttaaaagagaaagaaaaactggctcaaggtcataacactaataaatgacacaactgggatgaaattcttatataattaaagcaaaggcccagtcctcaagttatccccaaagtagagggagcaaacagaaatatgcagtattgcacacaggcttggcaagtctagcatctgtcaggcacttattctatgctgagcacttcaccaagcattgtacaagctctagtcgaacatgaggtaggcagttttattatgcccgttttacacatgaagaggtataggtacggagaggttgaatggcttggccagaaagtggcagagccagatgtggattcaggcactctggtttgagtggcatggatcttaaacccacactgtactctctttgttcacaggaaggcatacgatcttaagtcacattgaattaacattgaaatgtactaatttccacccttcataactgtgcttcccctttagttttttagaaatagcttccctgtagggaattctaaaggatagaaagcattgatggtgaacacttctcccaaggcttcaaacctctccccagtcttccctgagtttcatgctgcataacctgtgtggtacctgattattctatgcaagactgtactacgtataactagtctttctcttgaatgaatacaaatatctctcttttatgtgaaactcatttttttctaacacatactgttattaggatcttcaaatacatgaaaataattcttttccctgatatatattatttacctggatataggaacaaaaagagtttcattaagtaaatatacttttaatcaaattaggaatttaatctgtaatgacatttacaagttggcatactcatttaccgtccacatttacatttctttgcttttctaaagttaaaatctggcaaatactcatttatcattactcagtagtttccaaagtactccatggaagtacagatttatgatatttctcagtcagactctaagagaggttaaaccatgaaggaaaataaaattaccagtaattaaatttac

SEQ ID NO: 110837 - DNA, 1034 bp, Homo sapiens
ccaattcacatacttacaaaatatgaattggcataatcatgccatggctgctgtgtcttcttatgatacagaatggacctttgattttttgcatctttaacactgaacagtacactttctcacctctgaactcttaaaatagcctgctaattgaattttgacctctagtttatattctcattagataattttaacaaggttgccagattttttcccataaaacattgtttattatctattactacagggtttaaaagtattcagtttatttaaaaagttgttttaaagtacctttgttatagacactatggcaaagccctgggaatagagcagaatgttgccagttctatagtgtctatagtatactagatacagaaactctaggactaggcagaatgttgcctagttctacagtatctgtaggaattacagactctttcctgaaagagcagagatgattattaaatgctgtaacatccagtctctttaggcattctgactactcctagcattctgactttgatccaggctcctagctccttcttcccttcaatctgtacagaagctctttgctcaagccagaatggcctctctgttgcagatattcactgtgaacattgtagtgcctctgctcacaactcttctttgatagacccattacctccataggaaatacccactttattttctgtctaattagattctatccattttttgaggatctgaggttttggtttttttttttttttcctttctttcatgactacatcagcctagagtaatctctgtcttttctgacattctatagtgcttttcatctgctggtctcttccatagtaatcattgatttagctgaaacctccatttggagaacaaaaagttcctgagtctttttcctgagtcactatgtattgagagggagttatggcaatacatacatctacattccaatgaaaacttcacagactatttgctacataccatgtataacttattgaacttctgtgagactcatagtctcaaaatccggatga

SEQ ID NO: 110838 - DNA, 1046 bp, Homo sapiens
ttttatattgaattattattctgtcttgttcagcaaaaaatgcaagtgtcctgctgcaaaggttttataagcggtttctatagagactcataatggcaggaattattgatatttcaaactgggagccacaacttttactaacttgcccctcgcccagtctccccattctcccaccccacccccattggctctcaggatgttggaactgtggagcaatttgcattggacttatttttttctctttcctcttttaaatgaacgtaagtgaaatatgttcgtttaaaacataattttatggacatattcaagcttctataaattgctcagttcagactaaatgaagagagacttgattctgtgattgtacatcagtttaatttttaggaaaaataattatattggaatctgcttagctttatctacttctatgttaagaaatacaggtatatattaatgaaataacgactttctgttttcttgctttacacttctttttttctcatttagtcgactgcattcaaacaacctgtattgtgactgccacctggcctggctctccgactggcttcgccaaaggcctcgggttggtctgtacactcagtgtatgggcccctcccacctgagaggccataatgtagccgaggttcaaaaacgagaatttgtctgcagtggtaagggagaaggaagagtgatgttattgtgtttattgtatcctgttatgtaacagaatgtgagggctgcatgcgtcaaaggtttcagtattgttcactaatgttcaattgtgcactaatcactctacagagatcctctttttcagtgaaaatatgttctgagacctcactatatcggttggcaagtactggttacttgtatctaaattatgataaaacacttttcagttttcactccaggggaaaatatggaaaatcgctaaatgatgattctacttttgattttttattttcccattaagtaacaatttatagctacttttatgttaacaattgaaaaaaaatgattagctaatcctggatccctgctatgaa

SEQ ID NO: 110839 - DNA, 1002 bp, Homo sapiens
tcgtagactgtcgtgggaaaggtctcactgagatccccacaaatcttccagagaccatcacagaaatgtatgtgcctgaaattctttcttatctccccaccttcccggtgaaccaaactttgattttctttgggaaattctgagtttatcgaaggcacatctgatcaattggcttagacaaatgttctcttcagaaatgtattgattcttactctgattgtttaaaaacataccatgttaaagtggctgtgatgttttttcttccacagatagaattaaaaggaatacattttttaggaaaaacaaggcaaacaggattgtttatacctggttccaccctttgggcctgtacatctgtggttgtccatttctcagtttggagcagtaggaatataaaaagggaccaagctggggttagtaaaccacagaaacaatacagttaggtgatgctctgcctcctcgagagctcatgttttaaaaggcagtttcactgttttgtttgaattgatagttcaatgcaaagtgaagaaaggataacataaagtcaaatgtaaagattttttatatagtgcatgttttagcctatttgaagcagtgtctacctccattaaaagttaaattcttatgacaaactattgcacacgtattttgtatgcagctgctgaatgcatttctatgtcctcaccaaatataagtcatgtggataaaacaaggtcacataagatgtaaaatggaatgcttttaccatcttgaaaagtaagcactagggaaaattgttacctcaatattcattgacaaaaccccttttaaccacccagcccattatattattatgttataggccaattctaaattgtaactaaataaattatcttggatttttggttgaaataataggaacaacttcttagaataggcctacatagtatgcgaaaaagttgtttttaaagcgctcatttttaaccaatttatttaattatgataataaagtaacttatctaa

SEQ ID NO: 110840 - DNA, 1050 bp, Homo sapiens
atatatgtaattttaaaaattatagaggtcatgagaccatgcaaagaaacttaagtatgagtatataagtgtttgacagcttaaatattaagtgatgtgactgtctgattactagctctgtaataatattttaatcttaatatctaaactatgtaatttttaaaggtctgtaatttagcatattgattcatacaaatgtgaatgtttatggtcaatatattttgcatatgaacatatgttcaggtgttctattgtcaaaaataagacatagcatcttatatgggaaagtagacaatggttattttaaaaagtatgatttcttttttaaatttctgatccttcagatgttcaatgttgcacgttttggacatgtcttgataagtacaaaaccaacatttaaaagccatacatagctttttccgcagtaaatctcactgacatttgattgaatgtaacctaaccctatttctaatcttagtgacctgagcaataatcagatctctgaacttgcaccagatgctttccaaggactacgctctctgaattcactgtaagtattcactgtgtcactgaaggaaaagagaagccacaacaaagagtggctaccttttttaaattggggtttaaaaaatgctctcaggtttttattatgaataatgaattattaataatgttaattattattaaccacttctgggtcccattatttttatggaggactgctacccatcactaaaattagccaatttttaggggtgtatattttatagtttgatcattttgctgttaggagagcaagagttagatcccctttttgaccatttttttatttctttttttttttttttttttgagacggagtcttgctctgtcgcccagactggagtgcagtggcgccatctcggctcactgcaagcttcacctcctgggttcatgccattctcctgcctcagcctcccggtagctgggactacaggcgcctgccaccacatccagctaattttttttttttttttatttttggtagagatggaatttcacaatgttagc

SEQ ID NO: 110841 - DNA, 1035 bp, Homo sapiens
cttctgggaataaacccatattcaaatacattcctgatgctatatataaaacactaacacattttagcccatctatctccacctagttgccttcttttagtcattaacatttgacaattttaatcagggactttttttgaaaagtttcttgttaggttttatagatggcataaaggtttgtgtaacccaatacctgacctcaagaattttatactcctggagacccttggagagtatgacatgagtcacgctggcattttttaccacagacattccctgttagtattattgtccctttgtcttgatggtgtaaggaagtggaatcttttcagagccctggcagtgctgggcagtgaaaagttggaaaacttggatcattagaagaaaattatcaactatgtttcaattcccaccttgttagaaattatttaaaacctttgttccaacaatttttatttagaaactttagcaacaataagatcacagatattgaggagggagcatttgaaggagcatctggtgtaaatgaaatacttcttacgagtaatcgtttggaaaatgtgcagcataagatgttcaagggattggaaagcctcaaaactttgtaagtatttgtacttgcattgcagttcttctaccaaaggattgcagctcattgttcattataatcctgggagagagaaacacctacttttacccaccccactccctctatctctttcacattctctgttacacacacatacacaccgctacacacacacacatgtattgtgaattcagatggtcccttaccccaatattcctgccttcgatgtgtgttacacacacacacacacacacacgtattgtgaatgcaaatggtcctttaccccaatattcctgccttcgatgtgttcatagcagatgatcaggagcgtcccccatggcttctgtctcttctacaaaatagatcatccttgttccagtgcttatatggatctgactaccctgtcctgcctcaaaatggtcattttatttctttgtcttcaaaca

SEQ ID NO: 110842 - DNA, 1062 bp, Homo sapiens
ccacaaacatgagtagtgtgttgggctatggcattatgatggccatgacatctcgaggcaataggaaattttcagcttccttgcaatcttattggacaacttttgtatagctctgcttgaccaaaatattgttctatggtgcatgactgtacagtcacatttgggggttagggcttcaaaatacgaatttgagggggacacagttgaacccgaaacaccacctcaaggaacttatatcaaagtatttcttcttgttttgtttttcattcacaggactctccctgtgaaaagttatctaaattccactttctcctttcattgtatttctgtggatgtttttgaagtgcttacattttagcacctgagacagatattcacggactccctccttaatctagttaggtttcaacaagcgtcatagagcattttagaaccaaactcagggtagttaatcctagaatagttttatctgaacatacctattcttggtgtcttttgtcttggagctatgaagattttgagagcacatttccattccccctaggcttcttaaccctaataggccacttactaattcatatacatatttcagccagtcattgaattccttgacattgcaggtgaaatttgtgcatatgtgtgcttatggatttttctagcaacagagatcaaacttttctcttttttaaaatttttatctatttatttatttatttgagacggagtctcgctctgtcgcccaggctggagtgctgtgatgctatctcagctcactgcaagctccacctcccgggttcacgccagtctcctgcctcagcctcctgagtagctgggactacaggtgcccgccaccacgctaggctaatttttttgtatttttagtagagaccaggtttcactgtgttagccaggatggtcttgatctcctgacctcgtgatccgcccgcctcggcctcccaaagtcctgggattacaggcatgagccactggacctggcgctcaaacttgtcttcaacttcccccaggggcatgtgactccagcaagattaagacccagtgctc

SEQ ID NO: 110843 - DNA, 1083 bp, Homo sapiens
ctaaagcaacatgagtgttgacaccagtgacaactcactaaatcccagtgcacatcattcaggaaaatggggaatccccagtgtctctatttttttgctaaattgttatcctcaataaatctatggggattttctgctgagcatcactttgaattcttttgcccttaggaaataacaatacttccatacttgtgtgtgtgtgtgtgtgtgtatgtgtgtgtgtgtatgtgtgtgtgcttctgtggtgttgtttttccagagcaattggagccaaccctctttactgtgattgtaacatgcagtggttatccgactgggtgaagtcggaatataaggagcctggaattgctcgttgtgctggtcctggagaaatggcagataaacttttactcacaactccctccaaaaaatttacctgtcaaggtatggtttttaatcatttgtatttcttttaagaattactatattaagtaaaaaagaaaaagacaaccaattgtcaatccaaaggtatggttgaaatgcccagtaaatgattattttttcagcccatgcttggacaagacagagcagttacctgaggtgcccaagtaaagaattaggcttttcaaataaatctcagaaatagtccattggtaatgaccaagttttcttgaaagtgtatcaaaaaacgtagagttcacaatttctggaaattcctttcatagcctctaacaagtcaaatgttttgcttttgccctgtctgaacatgtgccctgctcctagggctgccagggccctgtggcttcctcataccaggtaaggagaaacaggccctccccagtgttcagcccaaaccttctgactcgccttatgtgctgcagccttcctgtgttgatgttcttgtttcttgcttgtttgtatccctttcttttccctttgtttgatgtatttgtgaatctaaatattgtcagaataacaaatattattttcctttttattacaagaataatacatgcccctaaatagaaaaatatgaataataagaaacaatttattttctgcaagaagaaataaaattaaccattagtcagcatacctggagat

SEQ ID NO: 110844 - DNA, 1049 bp, Homo sapiens
ccaagcctggtaatccaaaaggtgtagtaatttagcctttgtgtttttagctaacgatttttacaatgcaaatttacaggattttaacctctgtcatctggagatcatctccacccctccactgaaactagaacaccagtatcttctatcttgccaatttagtggcttctttttacttatctttatttgctgtctttacatcttcgacattggtggccacttctccttcctctacaatctcttggcttcctcattccttttattttttcacccactttttcatgtagacatgtagcattctatctttagccctatcaaattctcagtagatttcaatccatgcctttaaatttctagccatggcttttcttaagaacttcacattcatatttccattcacttagtggattcttctcccttgatggcttgcagaaacttgaaacacatattctaagacatgcattctcattccccacatccactctctaattgatacatgtatgtctctcctgctaaactgtaagttttttcagaaattcaggcatttcacttgtctttggtctctgaaaatctggcctagtccctggcacaatgtagatgctcagtaaatatttgataaattaatgatggaatgttgttaacaaatatgcatttggtattattaataaaacttgagaaatgccataatgtaattgcaagtggagcgtaaaagcattggttttaaataaaaaccttcttttagttaattatacccaacatcaaatatccccaggatgttttcctgagttgcctttgatgtacctctggcttgatagaagggcagtgctagaggattttgttatttgacccatgtttccaagggatgccagaatgaaggcagattctagaatatagctagaagtttttgtctggagcttttggtaataaatcaaaatgagatacagtactcactgggtagcaatagtggtgtcaggtgcgtaactagtgattttagtcaagtaagctagtctgcctacaggctttaatggaatcgaggtccaacagttctt

SEQ ID NO: 110845 - DNA, 1040 bp, Homo sapiens
ttatatatgtttagtaaatctttttttatttgataaatggtaggtgtcttgaaaatcagatgtaatgtaaataacataaggacttaaagatagtttcagctaaccaaataaaagacccaggaatctctgttcaaacatacgcatctattataaagccatgctatccagtaataaaagaagctattttgctaaagcttttagtcccacaattaaatggcatttttgtgcaaaccattttccctgtgcaaaccaatccccagtacctgtgtgtaaagaggacatttatttaatagccaaaacataattaagcttttgagatcatttgtcttcatacttgtgtcttcgctagtgagtatttgcctctagtaacccatgtccctcaaaataaaagtcaggaagatattgagcactttggatagtcttataagactatcaccttttttctaacacttttgtttctttggatgacacatctcattagagtattaattgctaaacttcctccctattcaaaccaatttgctctaaagtcaacatcaagtttatgacttgtctgttttgtcagaattgattttttatttttattttttgtggctccgaattagaaacttcatagatatgctctttttcctttaataaattacttaacattgacaaaggaaaaacaagaaagttgtacattttatttgtaagaaaaaaaatggagaagtaattttgatcactctactcaaagttgccgttttcattttctgggtgcatttcatttactatgtctgttttcatataatttaatacatagcgagaaaatcaaaggatgaaattacaatgcaggtgactggagttaacatctcataacatgaaagatgaacatacatctgtataattaaattttcccagggatttgttggaaaattattaaaacggaagcttttatggaatacccaaactgaactttactaggtacctttcttgatgggaaaatgctaggtagaataatgaggctcggttttggcaacccagatctgtttgagtgactctga

SEQ ID NO: 110846 - DNA, 1017 bp, Homo sapiens
aatttgagtttggaatctgattaatgagcatgagatctgggagcagaagccctgctatgctcagggaatataatagtgttgtcagtgtttaaaaatcatcctagtaacaagttgatttttcctttgaaaattttttattctatatcccgaaagcatacaatgagaagtgaactctgtttaataagaacaaataatgacttacagaaaaaaagcttgtaaattattatggtgacagtttttgtatttgacacctatgtcaagagtcagaacggacattatgtcaatggaaacaaattcagagatctgagagcaatctgacagagaagttatgatgtgatgaacagactacaaaacgtgactagaaatatttaaaataaaatgagccaccaatggggaatttattaaacattgtttaagccctatgtgaccaaaatatcacagtaagtagttactgatttgttagaggagaaaattctctgctctttcctgctccagggattgacagcatgaattgtaaggacaagtactgtttttctgttatttaaatattgctgtaacttcaccaccctagtcaccaaaaccattctccatatactccagttatcatctgtgcttccagttgtgtaatgcatgactgccgattactagtatattttaggtaagattaacttttgaaaagttgaattcactatgaatctaaattaacatccctatactattaagaaagtaggacttcagaattgttaaacaaataattttaaaattaaatttaaggttttaattgtagcttgagagaattttgttgattttgattttttgtttggttatttttttaaaatcatgatcatcttctttctaaagacaagacatttcttggagctaaatttccaaggaattcctgaaataacataaacctaacacctatgcaaataaaaactataaatgtggcacccctgtttttttaaaaaatggacactttttttaggctgtagtgttaacttaggtgtttaattcaaa

SEQ ID NO: 110847 - DNA, 1053 bp, Homo sapiens
ctagattaaagataataaatatagtgtacatggggcaaattatgtctacatatttgttttatctgataagcaaaatcatttaatatatttttaattcaaatgactttagccagtttcatgtagacaccaccccttttttggtttaccctgatactctagtgagggacaggggatccttttgaagtcaggaagaagagaatcctggaaggcatgattctctaccttccagtgtttgccccaccaaattgttatgagaaccacacagtgatgttggggcttaagtcttaacttagctaattaatcctttaaaagccaaaatgggccaaagagcaggataaaaacaaagatttccccctacacatggcataactgtgaagaatttgttgtttttaaatatgagatataaaaatccatctttgacaatgtagtcatttttcacagatgctataaataaagcttataacgggagcaaaaggagcagtttagcgaaaatctgcagcaaagaaagttctaagcacatccaacatgtttacttgaggatttcttattgttctttttaagtttcttcatggatttatttgcaacaaagcaatttaagaacaagtcacctttcaaggaataatttcagcatcgttttctcatagccatcaggaaaacataaaccatagtaaaacctgttcacctcacttagcagtctctttctgatcaaatacgtttggttgcgtacacatcctagtaatgccagggttactttctactagattgccacagatgaagacagcggaatcctcctgtataagggtgacaaagaccatatcgcggtagaactctatcgggggcgtgttcgtgccagctatgacaccggctctcatccagcttctgccatttacaggtgaagatctctcagttacgggtaaaggtgaaaaaaattgcttaatgaagaactgcttctcctctatcattttattatggagaggagagagactaagttggccccagcaggttttaggatgagggtattagtgaaaaacctggcaggaacagagggcatac

SEQ ID NO: 110848 - DNA, 1712 bp, Homo sapiens
ttaatggaatgttacttgtattaagtaacagattggataatattaaactccaggtctaataaataaaatggcatactctctgaaactgctccctgtggtaaacaaaaccagctgttagtagtgtaaaaacagaagatgtgtactttttttccttttttgcaatgaaagaaaatatttaggaatccaattttcttgtcactgcaatagcattgtatttatactctacataatagcattcactttgctgaaaatagagactaaaaagaagtatttttcaaagaataggaggccgtgccaccagctaataatatgtaaagcaagttacaaaggggaagcaaaggcttctgaattaagttgtggattcacagtcactctgcatgacttacagtgactgttcttaaaatgcttgtgctttttgttcttttctagaaatctcttgtcgaggggaaaggataagagattattaccaaaagcagcagggctatgctgcttgccaaacaaccaagaaggtgtcccgattagagtgcagaggtgggtgtgcaggagggcagtgctgtggaccgctgaggagcaagcggcggaaatactctttcgaatgcactgacggctcctcctttgtggacgaggttgagaaagtggtgaagtgcggctgtacgaggtgtgtgtcctaaacacactcccggcagctctgtctttggaaaaggttgtatacttcttgaccgtgtgggactaatgaatgcttcatagtggaaatatttgaaatatattgtaaaatacagaacagacttatttttattatgagaataaagactttttttctgcatttggaaaaaaaaaaaaagaaatgcttgaactaaagcttcccctatgctggagaagtatgaagaaagatatacctggagacattagaacagcgatgggaaccattgcaactcgggtccatctttgtaacatgctgaagacaagcagaagcacatgcacgagggacagaggagctactgtgcactgctgtgaaattgcccagagcataaaacctgtgtaccctccttcacatcaaccaagttcactaggacataccaagcacatgcgtgtgaatgaggatgcaaggcaagagaatggaactccagaattcacagatagaacaaatggatgagaaatatttcatgcaaaatataaagtgtcctgaggatctgggttccatttacgagaggaaatgaaagtgctaaaataaattttatcttccttttaaatgtcagcatgtcagcagaagcagcacacaaaagtctttaccattttccagtattaatttttttgtaatataaatgataaaggagatgataaagaaccaatagattattgataaataaattagtaataatatgattttttgtttctatgagttctaaacagccctatacagtattcagtttccatgagaaatatttattgtatcaaagtacattgtacttaacattttaggccatccttttactgttccttgatgctttaatatatattaatttataattatcctgatatttttgtacatttttcaaacttaaaaatcaggatttttttttttttttttttggcaatagtactaacatagggttttatcttgggatacatatgtattggtctgtttgttgaccttgacatctgatcactgatgtcaatgacctactggcctcattcaggacacctgcagagag

SEQ ID NO: 110849 - DNA, 1043 bp, Homo sapiens
aacttaaagtcagagtgggggaggaatggaactccaaagaaaattagaggttttgctataagaattacagaaactggattctgaatagtccaaaatgtcaatgttcatcccacagaatgatgacaataatgcctacagttttgagggtctactttgtgttagtccccgcatgagaaagttcacctacgttattttattcactcttacagcattcttacaggataactcttagcatccatattttactgttgaaacagagactcatgaaaatattagagcattaatctcaaggcaatcatcattaggaaaaaagaaagaaaagaagacctccttcaatcaagattctcactgaactctgggatacttgaaaatggaactgactttttaaaagatagaataaatgacaaaggtgcagggagtgtctgagtcatctgagggaatgtaaagtaacatgcaacatttcaattccatttgtctgtctcctctatgcctccactcttcagagagtctaatcattaatcacccagagactttttgtctatgctcaggctgtctttactgggggggaagtaatatatcttgaatttttaaagtcacagtaatggtcccgaaacaaggccagggtaccaatttttaccattatccatacagtcaacgtttctagacttacacaacggtagcagttttctctcctgggtgatgactttatataaatatgcatgcaaacaaaatcagagtttatttggaggaagtttctgcaggatcacttcacagactctgtatttttattaaggagatatcctggggcatgaagccagttctcaactttgtgaattccctgatattcagaactaaggatatgttttttccagaaaaaaaaaaatgtacaccacgtgggtagattcccagctaatcctgctctctctccagacaccattaaccatcctcagctccaactcccctttctctaatcctcttcttcctggccttgaaccagcccagggacaaatggaacagctgccaaaggaagtgatcactccaga

SEQ ID NO: 110850 - DNA, 1001 bp, Homo sapiens
ttaaaacacaggaatgcagttcagggaagcaaatcctcattgtcaaccagttctccagagtctgcaagaaaacttcatcctagaccaagtgataaactgaaccctaaaacaattaatccggtaggtccaaaactattcctaactcagtagattttttaaaggcatttcgcacagtattgaacaatgctggatgctgtgttgagttttgtccctttgctagttttgagctaataatgagagaagggcatgtggttattatgatgaagaactgagataatcagtcacatgtgggagtgagtatggaggtaaggagacatagaagttaacctgtttgggatatcgcattgtagtgcatagaaaattgcactttagctttagattttatttgcagtgttgttttacttccccatatcaatgaataaactgtattcagttgccacagaatgcttttcgtgcttctatagttgcataaaggtctctgacctttcctgtgttctgtaaattagttccaccagaaatcctagttgtagtactaacctcctttgccctctcctaacaatttaatgagatttaataaacatgggatttatgcagtaaaaatattcagaagtgaacacacctgtgcaacaacaccaggtgttatttgccccatgcccaactttggtagggtgagatgttagtgatttcagccttcgaaggggattgtgagggtggctgaagctcctgactgactgtggtggtaggtaggggtatggcagttacttaaggaagcaaaggtatagtgagctctccaagacagaaggagtgtccgactggataaaagcaaagtgacaaatagtttgagcggctatgttcctttgcttttttctgtaatctacagtgtcaaggaaattgaatacctgaagaaggccctaataatcttgttgctctcacttcctttgcttatgtttagttgagggagtttacggtgacgcttcaattttcttcctctctttaaagaa

SEQ ID NO: 110851 - DNA, 1397 bp, Homo sapiens
gtaaataaagtttagaaacggcacattaagatttggaaggggaacacagagctgtagttgagtaatccaggatcccagaaatatcaaattctttttttactactccatcttactagctttgaatgttgctaatacagaattttaaaaaagattttgtagctacaagggctgttattatttattttcttctgactcctcttgtttcctccttcttatatcctacataatattttaataatgattgatgtaattggaatagaaaatttcctattgcaattacataccaaagactttctcttggcttattattgtgctaatttctgttacttcgtaatccttcatgaaactaatgaatgttcttctttctcttctaagaccttaaaagcttatatatctctttctttcttaaaatattagaaattaagtctttaaaaatgagtgttctcagttgtggtttctcatttcttgggacttgtgtatatcaatgatggaactattcaacttttggatacaggaaaatatctgttacagatagtcacagtgttactttcttagaactgatctgccttaaattgaaatcagttcattcttagcctgatttgattttttttctaagtgaaatgcacatttattttggaaaaggcacaatgcaaatcctgatctttattgattgtgtgggaacttattacatggcaggtactctgctgagtactttttagacatgaaacccatttactcttcctagtcatcagagggagattttgttgttatctccctctaaagatcacggaacttaggcacagaaaagtaattagtccaggtttgacgaataagtgactagtagatgctgaattcagatactggtagtctggcttctaactacttctctagttagatacttcaaaaaaagagaaagaaacagcctatattttatttaactcagcaaaaagtccttcttatttcatcattttgttcttacccctttttgtttgagttttagatactttctaggcatattcctgcaaatataatacctattaggggaactctgcatgatactaatgatgctcaatttttttctgttgacaggggagccttagcatcatcaaatctaaaattccaacatactgctccatatgctgttgaagaagggagccaacaaaaattgttttttctacctgttgacgtgtcaagcactaactgtgggtactcatttattttattcttttgtaaatcacagccaccattcattatttactaggttaagatgaatagacactgaatcaaagttattcatcaacaaaaaagaacagttactaatggaaagttattaaaataagttctataagagtacaattttgaggtttattttttgtatttttattatttgtgcgaag

SEQ ID NO: 110852 - DNA, 1068 bp, Homo sapiens
ccattctattctatccattttccacatagatgactatgaaggacccattttatattttgtggagtctattgaccaggcattaaaccactttatttaaatctttacttggtattaatagaggatatttctcaaatcataatgccaaaatggaaactacagaggtgcagaggtgtgtcaaagcaaatgagaattttggcattctatgtagatcacaggccaaatcacacagacttttatacaggtacaaggaaaatttgtgtgtatgagccagcagttcatgaagattggaggctggcgcataggaggcagggtggtggattaagaggtaacatgtttgcagtaatcatctctctttctgtctgctagttatggctaaagctgcatggcctgaaggagcctttaaaaatgaatggtctctcaattacagagaaagaattggggagcagaaaccactgctcagtggctgtgttcagtttagcatattctttagaaatgagttaggggacagactttgggcattattggagcacttgtcagttgcatgtgaatagcacttactgagctgtttatggtagtggtaaatggtggctgaaccaataatggcttccactgctagaaaccaagtaacatcaccgtcaagcagcttaatgtcaccaaattaattctctcaaagaccactgcatggaaatccaagttgagagacaagcagacatccagaaaagtaagaacaacaatttaaaaataaagagaaaaactaaagaaacaacggatttctttgttttcaggattatttgaaaaattctttttttctttttttagttttgaggcagagtctatttctgttgcccatcattctggagtgcagtggcacaatcatggctcaacagggatcaagtgatcttcctgcctcagcctcccaagtagctgagacttcagccacgtgccaccgtgcccagctaacttaatttttttttgtagagatagatagggtcttgctatgttgcccacattggactcaaaatcctggccttaagttatcttcccgcctcagcctcccatagtgctggg

SEQ ID NO: 110853 - DNA, 1050 bp, Homo sapiens
tgagttcatgtcctttgtagggacatggatgaagctggaaaccatcactctcagcaaactatcgcaaggacagaaaaccaaacaccgcatgttctcactcataggtgggaattgaaaaatgagaacacttggacataggatggagaacatcacacacgggggcctgatgaggggtcagggggatgggggagggatagcattaggagaaataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaat

SEQ ID NO: 110854 - DNA, 1048 bp, Homo sapiens
aaattggtggtatatttctgacacataagtaatttcaagtaatggagtcactaatagtttttgccttactcatcctctggaagccagctataaaagtttatattaggtgaactatattaggtaaaacctttggcttctatattatagataaattaagactgtgctggaattaaacttgtttctaaagtgaagcaaacacaaacacaacattatcatgaaatgaccaaagttactatcatggagtgacctaagctgccattagcaaaagaaacattgtggagactggtacccaggatagtcttcccccaaccatctcctctccctccactaactgcttctacacccaggataaacctgcctgccccatcttgacttagttcattccctcaccttagttcattccttctccactctcagcttttatttttctcttctcagtgctatttctcacttaagttatgggagatgaccttttgggattcctggcccagaatcttcgcagttgtggtacccagtctgcatgagcatggagtatgtgtgaggaggctcttgcctgccctgttcatcctgcccctgtggtgactggctggatgacattgcagaaagctgcaccctatttttttcatcttgactccacaaagccatttcacccagatagctgcctacgcccatatgaacttttcttttaaacatgacagttctgttggaatacaattctaccaattttgttttaatttcttttgaatttgtttcatgcttcacctccaatacctttactggagttcaggcttttatcagaccctgtctgcactcttgcaatacttagctgctaattacactccatgtttccaggaatatagctctgataaattcacatccctgccaaaaattctacaaaggctcctcatctcctacaagatagtccaatctcctgcctaagacatgtcaacttctggcctctatctccttccccaaccttcgctcttggctctccaattgtgtattctatcttcttgatgatttacacgtttcccttggttcccaggcc

SEQ ID NO: 110855 - DNA, 1056 bp, Homo sapiens
agttgcactgagcaggcttccctgctacagccccttttgtgccagtaccatttccttgctggcctcattcatcatctgcttccctttatcagagctctcatcaaaatttctgctcatatttaagatgcatccttcctcacttccaaaaataaatgcaccttccaaattttatatatatatatatatatatatatatatatatatatatatatattccataagtaaatataaatgtatatatggaaaagagaaactggaatcacaaagcaaaatatgtataatgctacttctgagaccaagcacaacccaatcagaatgtaacaaataaatgaggtatacatttctcacatattttccctaacaaaaataaaagccttcacagctgatcagagttcatgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgt

SEQ ID NO: 110856 - DNA, 2087 bp, Homo sapiens
gaagtagggagcccctactctgtctgggtcctgggtgggattcaaggatctgggtaatgatggacaggtatgtcttctgaagtctaacaggtgttcttagtttgcttctattgggtattcttcccctctcatttttccttccttcctttcctgtttctccgttgtctccttaatctctgggctttctgccatttcatttaaaagtctgtattttttccttattgttttctgttctgagtgcctagctttcattccttagggtttctttgcttgacccttgataaaatttacattattattttcagtgttgcatctcatgggctttagccttttatcttaaccttttttgtcttttcaaaataaaatggtaaccttttagctcattggctctagccttttatcttctgttttaaatctcatctatttctattttataacttttaacctttattgggttttaacttatcattgatttaatttttactttatgaattgctttttataggctgtcaagaagctaagtcatagtaacaggagtacagaattgccctctgaggaggccatctaaatttctctcctggctctcagggctcacggcctccttacaggttgtttttcccgaatgcttcagtgtagtaattaacactactgaaggctatacatttcatgaggtagactgtacactcaatttctcaaaatgacagtggcatcttcgctcatctctcacctttttaatatgctatgaagaactacttatctttgaacacaggaattaccagcaccgttttcagtgaactaaccaagaaccaaaattgggtctaaataacatgtaacactgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaatatcagtatgtacttcatagagttttttttttttttttttttgagacaaagtactgctcttgtcccccaggctggagtgcaatggcacgatctcgggtcactgcagcctccacctcctgggttcaagcgattctcctgcctcagcctcctgagtagctgggattacaggcacctgccaccatgcccggcgaatttttgtatgtttagtagagacagggtttcatcacgttggccagactggtctcgaactcctgacagcaggtgatcagcctgcctcagcctcccaaagtgctgggattacaggtgtgagccaccatgcccagccttcatagagatcttactaagtttaaatgagacactatttgcaaagtgtttagaaataatcctatatacttattaaaatttcagtaaatattagctattattatttcctaggcaagccacttttatttcaactaccttaaacacatgtgatcaaatcttttacaaa

SEQ ID NO: 110857 - DNA, 1045 bp, Homo sapiens
agctcatttgttcattcattcattcattcattcattcattcaacaactgtttattatatgcctagtgtagacaacataagtgcattcctacaacatgagcaggaatagcccaggaaactatgatttttatgggctttaaaaatgtttagtgaactaaaagcttacacactaaagcttctgttgtatgtggagtttaagaagtttttgtgtaaccatataggcaatagcaccaacaaaccgtttcctctctgcttgccttacagtaggcatactttatcccctgccaacaagaggcttttgttcaatccagttttttctgacatccagctcaccaaacaagttgggtttgataaactgtttcacaaagcaatagagaaagctaacagcctgacacaatacaaattgcagagagttctgtagataagacaaagcactttcctggaggaaatggtgagatgttgtgatttatggacccatcaatgttactgttcataatgagaaaaactgttgcattcagaccatcatcctgaataaaggatgactccgtggaagtgtaaggatggccatcacatgaattcgcctgccatcagagatcacattcttccttaggacatttttccttttctggccttatgtaagaaacaatttgtatgtatgatattaatttttaaaaatgcaaagcaaatcataattctttaaaatatttcatttccttcagcgatgcctcatgtggtcagatttctgcattcaattaacatgaataatgaaataattgttaagagtgtaacagtaattttttctcaaatccctaatccctttggattttgtgataggaatcctttgcaaaatagatgtgctctgtttaagaagatgttctctaatgcagaaatgttatttttcaaataaagatataattttaatgtggagctctatccaagttttagtatgtaataacttgatttgaaatgattgaaaaataacttaaagattttcatctgcattggtgctttgatattaatgcctattaagatgttggtaggcactc

SEQ ID NO: 110858 - DNA, 1050 bp, Homo sapiens
cacagtaaagaattactgaaagaaagaggaacagcagaaaatatacaaggggaggctgcagaaaatctaggttataacccagatctgccactgagtcaatatgtggccctgagcaaaccatttaccttctccaatccccagatttcatatctataaattgaggataattacatttttcctaattttcagagttgggagaatcaagtgagacctacaatgcatgtgaatgagctttgtggcatttttgagcaccctcataatagtcagaaaacattgtgcatttgagagccacagtactgggcacacagtaatagttgtattaaactaaagagcagcctcttggatatttgataatttctaagtcgctggcttttatggtacattaaaaattatatacacttgcatgctgtgcattaattcttttacataacgattaaaaatgtagcatcatgctatgaaaaattaaactcaacactgcaagcataattgtaactctgatagtatgttaacaagtccacatttgtacttacctccctgtggaaagaactgcgagtaaatctctttgaaggtttcttcattaacaacaccactggggcattcctagggaaagtggcagagaagcaatatgagcaaagtgttcataaaactgaattttttttgcacattttgaaacagaactgtctaccatgcaaagctgcaccaagaaaattaaccattcatccattattacaaagggaataaaagcacactataaacttatgtttgttccagttctcacaagaaaaaaaaacgtagatgtaaatatctttgcatattgagtatcaaagtaggtgtaatgtattcagaaacacagtgctgcttttaagaacacatatgtttattataaagtaaaaggaaattgcattatttttcacacagcaagcatgttgcaagatgtttataatatagtctttggtgaatcttggttttgtcctttcaaggttttctgaactcacataatcttcgattcaatggcagaattactctattggcatctctagtggctcaaga

SEQ ID NO: 110859 - DNA, 1051 bp, Homo sapiens
ggtcaagcattattctggatagttctgtaagggtgtttttgagatttattacattgatgcaaaattgcggcttttgctattactttcaatacatttaagctggtagactttaagtaaagcagattgccctccacaatgtgagggggcctcattgaatcagtttaaggcctgaacagaacaaagacggaccttcccagagaaagagtgttcttcagacatcatctgtaatattggcttcccttgttcaccagcaccctgcctttggacttgaactgtaactgttttctgaggctccagcttgccagaccccttcattagatatcaagctggccaaggctccacaaagtgtgaaccaatatcttaataagtctctttatactcacacatcctattagttccatttctctgaaggaccctaatacataaatgaattaacaaccaatagctacaactccaaaggtggtatgtatacagctaatctctcaaacattttgactatctatctagctgacaccaatggacccattttaagactaaacactttgcagttagaccctctcacacatggaaattgtgatttattggctatttaatgctaagccagttgcttgggatagtaaggagagagtaaatacctggctctctgccatcaggtggcaagcttgtgcaaagttagagctggaaagttgcctgggagttaaaagttgatgctgataaaggaagaggacttcaagcaaagggacctctgcatcaacaaatttgttagctgccttcagtctctagatatatttgatagatataatgtgaaatgaatttgtaaactgactatctgatatgcatgtgttttatgtttaatcacatatctgtgtcagaggaaaccttttctctgccaaatgaaaactactggccaagtttcagggtggaaagtctcaccagataaatttgtttttatccaccttatattcattacattagtttacatctctacaaacacatactgtatgcctattattccaggagtcttctaggaactgggactgctacaataaac

SEQ ID NO: 110860 - DNA, 1037 bp, Homo sapiens
agaagattttggggaaggctgcaaaaagataagtgacattttacatctcaagagttgagagatccaaaactttgacaggtagagactagaaactaaaagcagaaaattgaactatatttttaaaagacaggcagtttcctgaaatcatttttgtaatcagattggcactgaaaatttcattaattatttaaaataccaagtttctgcttggacctggcaatgtgcttgatactgattagtctggggactattattttccagttctaattatttttacttactttggtaacttgtgcctcacccaggctggaagaggagagctataattttaagtgggcagtgaggggagtggaaggggaatgccctccagccaaatatcatcaggaaacacacctgtggttgaataattttcatttattattcattgcagagagagagaatacatgctgcagagaaacggggaatgtctcagagagtgttaggacttattacagggtttgagctcattttggtgcctttggagaaggtttaagtgagcaagacattgacctggacaggaagctgtcaagaagccagagtcatgctgtgattgggtaacttgtgtctgcaagtagtgaagactagacagagacaaaagctgtaataggtaaagaagcagctgttactcatattagctgggataggaggtatttgattattttgtggtttaaagttcatgtttggccaggcgcagtggctcacacctataatcccagcaccttgggagaccgaggtgtgtggatcacctgaggtcaggagtttgagaccagcctgaccaacatggagaaacttcatctctactaaaaatacaaaattagccaggcgtggtggtgcatgcctgtaatcccagctactcgggaggctgaggtgggagaatcgcttgaacccaggaggtggaggatacagtgatccaagatcacaccactgcactccagcctgggcaacaagagcaaaactccatctcaaaaaaaagagaaaaagttcatctttttgcttct

SEQ ID NO: 110861 - DNA, 1035 bp, Homo sapiens
ttttgtcttgggctgaaaatttattttgacttacatttgccaaaggctttgccaccgtaagctttgtcagttcctccagccagtggacagctaaatccaaaaacctgacaccctcatttgctccccttaaatccctggccggttctataatcttctgcctttaaacaagctctaccttaaaaaatcacccaaacgagaattctgagctacttaaaaaatctagacactcaatttttcttcttaacattagacatcgttttgctccagtaagtctgtggaaatgacagttgtcagcaggcatccttcctcctttggccctagttcatctcccactgaaaaggtagtttcaaattccaatctgctcttttcctccatcctttcactccatatatgattttccaggtcataacaaaaggaaaaatgaacaaagatgactcaatttctctttttctcttttctaccaatcatttaagaaccaagtgctttctgatcagaaaacagttgcttaattgagaaaggagaatttctaaacacttttctcagtgtgtctgactaaagcatattactttctttcgtaatcaatagttaattaaaactgtgagtcatcttgttgaaatgacagatgccctgaagttttagagcatcttcaaaactgattgtcaaagttactttttcctaaaataaacagaacaattctcaatgtatttttaaccagcgggacaatttttaaacagtagtaggttacctcacagacccatagctatgtatctttaaatacatttataaaagaatatggtgggaagaagagtgaaaccattatggattttaaaatacttagaggagttttactaaataagataatactgaataagcaaaatacaataaaatcaggtctattcaatctgaagatgatccccagggaagcctgcagtttcaatactattataacattgagttccctcctttagtgaggcagacagtgcagataaagggcactgactttgcaacccatcaactttggttctgatatggact

SEQ ID NO: 110862 - DNA, 1050 bp, Homo sapiens
ggcaagtctgcagttcaaagtgaaggcaagtttattaagaaagtaaaggaataaaagaatgttactccatagacagagcagtcctgaggggggctggttgcctgtttttatggttattttctgacaataaactgaacaaagggtggattattcatgcctcccctttttagaccatatagggtaacttcctgacattgccatggcatttgtaaactgtcagggctctggtgggattgtagcagtgaggacaaccggagatcactctcgtgaccattttggttttggtggattttggctggctcctttactgcaaactgttttatcagcaaggtctttttgacctgtattttgtgctgacctcccgtctcatcctgtgacttagaatgccttaaccatctgggaatgcagcccagtaggtttcagcctcattttacccagctcctctttaagatggagttgctctggtttatacgccccgacaacggtaccaagttaggttgaagactatgttgaggaacagattcagcaggaaaactgtgagcttcactactaaataggatattttgttaccgacatccactcctttatacaactgaataaagatgttaatttagtggtcaaccatgattgacaatttttattgctatagaaaaaactttcatgttgagtctgggtaaactactattttttaaaaaatgcagtatttctgaagcttaacacaaaagtttctcactgaataatcatctggcatgtatgttactaagctggcagctctcctcaggggctctcctcacgcaggcgtctgccattatgtggctctgtcctctaggtcgttactcagacaatagaggttagcacatgggagggttttatggatcatgcctggagatggcttttgtcatttgtatccacagtccattgcccagaatgcagttgtggccatgcctaattgcaaaggaagttaggaaatatagtctagctatgtgtataggaaggaaagggagatagttcagtccataaataaacactgccacaggatagattcccagt

SEQ ID NO: 110863 - DNA, 2088 bp, Homo sapiens
cactgtaacctcgagctcttggggtcaagccatcctcccacctcagcctcctgagtagctggaactacaagaacaagccagtagcccggctgtttttctttttatttttgtagagatgggtctcactgtgttgccctgactggtctcaaactcctggcctcaagtgatcctccaacccttgcttcccaaactgttgagattatagatacgagccattgagcccagccaaaagttgttttcttaatgtaaacattatatctacagattacatatataatgttatatactaacctgctttttaggtaacagttagaaattagatttgtgtatgactatttttgtgactagatttatatactaacgtacatgtatattaatatttcaggtcattaataggtggcaactgatttttaaatctcaggatattttggataaatgtaacaatgtaactatatgtatgttcaatatatttatattagtaatatatacagatggcaacttaggtttagttgctgattggaatctatacataggtctcattatagagaagcaacaatgttagaacagacttacatgtttcaagtattgagttcagaatgcccaaactgaagttggttgagaacatacaaaattaggaagtaaaaacattaactgaaaacatctgatgcaggaattaaactaaatcatcaaggtaagtgaggcatacaacagcaatccaaaatttaaaacaaatcttaattctgtttttctttttggattccagtaatcatttagttattttaatattgactccagtgcttttatctgagaggtgatttgattgttcataatcacttaatgatgttttccaaatttgagtcattctgtcacttttgctaattttgttatatttttcttaacacttgtattaatgctgtccatggattattgcttatattgaaatataagcaataataaattatatttattatatatataatatattattgaatatattgaatatataatatattattgaataatatataatatattattcaatatattatattgaaatataagcaataataaattcaaaataaaatcaatagatttatttgtataaacaaggcaatttctcctgaaggagaaatttttcattgtttgtaatctgccagtgctaaaaatgtgactgcatgttgctaggtcttagacaaaggtgagattgtaaccaatgaaattctgctttttgtttgtttgtttagttttggtatgaactctcttgaatccttctgacctactcagatcatttcacagccatgtcttttattggccatgagaagctcctaagcagtggtcataactgggctacgggggatactgattgatgaacatgtacagtgtgtgttaacttagttgttgttggctgataaacgtggtctttccaccttttttgtagacccgacccagctttgtattatgtgaggccccaggcagcctttggataaagctttttcttcagcctcctttcactggggatgccagaggcttagaagtagatactgaatgtgaatttacaggaccatagtattaagaagcttacatttatagagtcattgatggaggtggaccactacgttctctgataaagttcaatgcttagaattacttcctggcccaaatctcactagtcttctgttcaacaaacttgtttgatgctgcttaaaacacatattaacctaattgcatcatatttacaaaatggtaggagaaaagagactgtgtgtgtgtatgtatatgtaatccattatttactgctgccatctggtttaagaagacctttatcaggtattttcaaaaagttcaaaatgttttcagaagactcttcagatgcattccaaagaatccagctaatcacatcttcaattttgtaatcattgtgttcaccctgttttggcatataatactgatgaaggtttgcttttatggataaattttgatgttctaatcaggacctatatttgcaagacatggttgcttgcaaagctggatttggtcatgagtactgtgaatggaaattgatctcaggacccccaaatcactaagcca

SEQ ID NO: 110864 - DNA, 2591 bp, Homo sapiens
agggcctctgcactctgtgaagctgctgggatccagataccttccttaccttaatctcagtggactggcgatgagatacacagcagtgggcagtcctgggacatgcaggttgagctgaacattagtcagtaattaatatgtcattacatttcttgtgtgaactaaggcacttttcagttcaccggctgaatctaaaagaagccagttcctgctacaaaaaaaaaaaaaagtaagagtaagtaagctgaaatcctaccagcaggctcagagtgttactttgcctgtccacaaggtggcagaagccgatcagctttcctctactcagaaacttactagaccttgtgctttaaaacaagaaatctaaaaaacaaaataaaaacacattactgctaataaatcagcctcccaacttaactctcagcttattattggaataaagataataattaatcttcagggaatgacttttgaagtactgagacattatgagagatacatgttaagaaatggaatgatgagtggtttttcctgtgattcctccttctagattttacctgattggtggtggtatccccatcattgtttgcggcataactgcagcagcgaacattaagaattacggcagtcggccaaacgcaccctagtgagtattttatattctctgtgtacttgacccagttgtttctcttttaagtattttctaggcattacaggtgattgcaatttcgtagataatttgttgaaacatgtagcatcgatctggtttaccattttcttttccagttgctggatggcatgggaaccctccttgggagccttctatgggccagccagcttcatcacttttgtaaactgcatgtactttctgagcatatttattcagttgaaaagacaccctgagcgcaaatatgagcttaaggagcccacggaggagcaacagagattggcagccaatgaaaatggcgaaataaatcatcaggattcaatgtctttgtctctgatttctacatcagccttggaaaatgagcacacttttcattctcagctcttgggggccagccttactttgctcttatatgttgcactgtggatgtttggggctttggctgtttctttgtattaccctttggacttggtttttagcttcgtttttggagccacaagtttaagcttcagtgcgttcttcgtggtccaccattgtgttaatagggaggatgttagacttgcgtggatcatgacttgctgcccaggacggagctcgtattcagtgcaagtcaacgtccagccccccaactctaatgggacgaatggagaggcacccaaatgccccaatagcagtgcggagtcttcatgcacaaacaaaagtgcttcaagcttcaaaaattcctcccagggctgcaaattaacaaacttgcaggcggctgcagctcagtgccatgccaattctttacctttgaactccacccctcagcttgataatagtctgacagaacattcaatggacaatgatattaaaatgcacgtggcgcctttagaagttcagtttcgaacaaatgtgcactcaagccgccaccataaaaacagaagtaaaggacaccgggcaagccgactcacagtcctgagagaatatgcctacgatgtcccaacgagcgtggaaggaagcgtgcagaacggcttacctaaaagccggctgggcaataacgaaggacactcgaggagccgaagagcttatttagcctacagagagagacagtacaacccaccccagcaagacagcagcgatgcttgtagcacacttcccaaaagtagcagaaattttgaaaagccagtttcaaccactagtaaaaaagatgcgttaaggaagccagctgtggttgaacttgaaaatcagcaaaaatcttatggcctcaacttggccattcagaatggaccaattaaaagcaatgggcaggagggacccttgctcggtaccgatagcactggcaatgttaggactggattatggaaacacgaaactactgtgtaacattgctgggcttcctaggcagaaattcatataaactgtgatactcacattccttgaagctatgagcatttaaaaactgtttacagccaccatagggattcaaaagaatttggaataaactttgaagttttggattttacttatttttatccccaaattgttgctattttttaggatctgaaacaaaatctttctaaaacattgttttagttgtcaaagcaccaacaggacattttgggatgtgaaatgtaatttcttggaatctgtaatttgtacttaatatttcaggcttgtatttaatataataaataggtgtttgttattgtgtcgatctgttatttttatattttacaatataagcatttagttctattttaatgaaattagtggtttggggtattttaattagagttacacataagtcagttatatatatatattgcatggttaagtgtattgattttggcacataaatcaaagtgatttttgggttgctgtattttataagtctagttttaaatattaccaggttttaaaaggatctctcaggatgttttttgaaaat

SEQ ID NO: 110865 - DNA, 1345 bp, Homo sapiens
aggtctcactttattgttactgtttcggagattctgttcctgtatcccccagtgttattctgtggacctgtattattctgttttcatgctgctaataaagacatacccgagactgggtaatttataaaggaaagaggtttaattgacccacagttccacatggctggggagacctcacaatcatggtggaaggcaaaggaagagcaaagtcatgtctttcgtggcagcaggcaagagagcgcatgtgcaggggaaatcccctttataaaaccatcagatctcatgaaagttattcactttcgcaagaacagctcaggaaagacccaccctcatgattcagttacctcccactgggtccctcccatgacagataggaattatgggagctacaattcaagatttgggtggggacacaactaaatcatatcaggtccttactaaaattccatactgcctatgaaactttatgatttactgtttaactatctctgaactctaagctctccctggactccaagctctacaagcataagaattatagtagttgaactttgggaggctgaggcaggcggatcacgaggtcaagagatcgagaccattctggccaacatggtgaaaccccatctccgctaaaagtacaaaaattagctgagcgtagtagcgctcgcctgtagtcccaggtaatcaggaggctgaggcaggagaattgtttgaatctgggaggcagaggttgcagtgagccgagattgcaccactgcactcctgcctgatgacagagcgagactccatctcaaaaaaaaaaaaaaaaaaaaaaaaagaattacagtagttgattcactggtgcttatccagggatcagtacaaggcctgacccataatagatgctgggcaaatgtttactgggtgaatgaacaaaaagaagcctctgtctgcacattagaaggcattcaaacctggagccattttgactctattaggagagtactcagcacacagtggcaataaaggtcttcattgtgtctaaaagtattcattgatttcttgaagcagacacataaatttatttcactaaggaaatgaatggaaagacgctgttgtaaagatgactgcctttcattgtcctgagtggaattttctaccatttctaaatggaaaaagagaggaattgcaatgagtttttagggcttcaagaacaaatgccattaaaggtttacaaaagggaaaggcaagtctagacgtttcattgtcgttctcttctatgtttataatgtgtttccctttgatgaaagacatagcatcattcttatatttctgactcagacattctttgcttcactttgtcact

SEQ ID NO: 110866 - DNA, 1270 bp, Homo sapiens
tcattaactataaaaagaaaaaatcattctttaataccttttctttaactgattaaagttaaatttattgtctgtcacttaaacaatctgccagtttacttcctgttttaaattaccattttgcaactgaatatataacttaaacagctcatccctttatcattgggaatttagtgttacacgttatggctattattacaatgcctgttacttatttttaaaatgtatgaaattctgactttggctgaaagagaagtgacattttctgatagtagaattttaaaaattattttatgtgttgatgaaaacaaaaattagaaaaagagttaatcataaagatataaaaatgacactaggttagataaatatgaagaatttaaaaatatcttactctttgtttccaataaattattacatatgtaggcttagtgaatagtcttcttgcagcataaatataaaaatggaaattcttcaatctatgaatagaaaatacgtaacattttatttctttgtttgtatatttttttcacatgcatgatagcaagaagtataacgtagtaattgaaagttcaggctgcctggatttggatttcactttaccatttatcggctgtgtttctatgggcaatctgtttaaccttttttttttcttttgtttgcttttaaaactgtaattaaaaaaatatataacatgtgatctctgtaaacaaattgttcactgtacagtacagtattgttacctgtaagcacaacattgtacagcagatacctagaacttttcatcttgtataattgaaactcggtatgcattgaacaacgaccccttttttcttctcctccaatcttatggcagtcaccattttcttcttggcttctatgagttgtgactacttcagatacctcatataagtggaatcatgcagtatttgtccttcattgacttacttatttcatttagcataatgtttcaacgttcatctatgttggtgaatatgattttcctcttttttatggctgaataatattccattgtatgtagagaccacattttctttatctatttgttgttgatggacatacaagttgtttctatctcttggctactgtgagtaatgcttcagggaacacaagagtgcaggtatctctttgagattttgattttaatgtctaacccttctgtgtctcagttttctcacctataaattgggaatgataatcgagttgttggatgatatgattatgtacacaagttattagaattaataggaac

SEQ ID NO: 110867 - DNA, 1005 bp, Homo sapiens
gagatactgctctcattgtgtctgatcagctagtgattatgcagagtgataactgggcttaaagggcattgaaaaggatgaattctggttatgctttctgaattgcctaaatgtagggggctgatttctcttttaccctcatagcagagtcaatatttcaatttataaaatagatggtccagtgtaaaatgagggtatgccgtaagcagttaacaccatagaagttaggaaagcaaagtaacatgttaggaaaatagcgtgaaacattagtctgaataaaataaagagacataagggccagagtttttgtttattgatgtgttttcgtcactcaaaaaaatctcagtagttaaatgtggagagaagtactgctagaatggatctttctttttgccctcaggatttgacgggatctgaactatacacccaggcggccagcctcctgcatcctgtggtttatactaccgctatcattctcctcttatgtctcttagccgtcattgtcagttacatataccatcacaggtaagaaatacatctcgacaaaatagatctgcggactttgatttgaaggactttatttcacatttaattaggataaaattgagtttgttatcatcctgtatttccaaagtaaggatgatgactttagaatatatacatgccttcatttcatgccattagaaacataaataattagtatttgagatgataaattctgtttttacagcatccagtcagtttgctgggtttgtatctagaaaagaatatgggcaataggtattggacactgtggggcgggtcacaggcgcaataggaggtaaagtgaggcggaagtttcttacctgcagaggtacctaaaggggtgtctctaagtatcagactgtactattactcttattttatgactttttgcctattatgatattctttattttatagatgacatttttaagaaaatttgtggcatttaagcgtgggatatgttgtttgttaatcggaggc

SEQ ID NO: 110868 - DNA, 1571 bp, Homo sapiens
atctgcctgcctcaagctcggaaagtgctgggattataggcatgagccactgccaccttttaaattaaagcatgaagcgttaaagtatgtggcattttctcttccattttgaaagtgttttctcattcagttttgaatataaaataaactgtgatgtactgatgagaaataatattcaacattgtcagaaatttataagttaacaagaaaaaattgagcaaaataaatgaaacacaaaacatacacaaaaatgcattttataagccttcgctgtgatattgcaccatgtgaaacttttatttttatttagtctaataccagtttaaagcatctatttgtgaacttcctagctgttcttcaaaactattaaattagtataatccttttctggaaggaataagctattcttttatctttcagacttttaatctcttaaaaaaatgtaatacacaattctttaaagttaaaatactgtagtactaagattttttttctatttattttcaaagactttttccttttcttaaatgtaattgtgccatctagaggcagcaaagagaaatgtatttgaaattgttgacaaaattaaagttactgcatgggagttagttgctaattaaacataaagaaaaagttaatgaaattatacccacttttaggtaaagttatgtttaggattgaaaaaattgtttttaaaaaattagaaagcaaattagaaagcagtgtcttttttccttatattaagcttttaaaaattgataaaatcctatgtctcttgaataccatcttaatatatccttttatatagtaagtctaaattcctatcttgggatatagtccataaaactttcctttatctgattttaagagttttgaatttttaaaaaatgcgacataaagaatatacttgttcataaatctgagtatacatcctgctataccagttatttactaaggtctcattgggagccagaaaaaaaaattaagcagaaattaggtttgcttgaatgatatgatctggaatagccaggtggggcaggaagattcacaggagctggtgtctgtaggaaaaaacaaagaaagaaaactgaatagaaagtagggttatgattaggttcaaactatgtagtgcttaatactttaatcactagtggtgaagataagctaatttatatacattgattcctcttttgttgtgttcacctaaaaatatgaaactagagagcattcattaattttctttttctagtgattcttttacatttgtttatataaaacatgctgaataccatcttaatatgtcattttatagattaaaatggtattcaaagcaactttgatatcatttactctataattgaacataaatgctagtgatgtttttgtttaaataattttaaaataagtactatactcacatggatgtaatgttttatttatttctacacattaacatacagtgaaagctggaagtcctacctatctctcgtatcacactgataagtaactactgtttgtttctcgcgtattgttgaggagaccctcgtgtttatggaaacaaaaatgagtat

SEQ ID NO: 110869 - DNA, 1653 bp, Homo sapiens
aattgataactcagtgtagctgtgttttaggttgtgctataggagcattcaggggatacatctgagcaatagattttcatcaaattatatggtgaacttaggatttgggcttagtattaaacattgcaaaaccaaggtgttatttaaactggaataacatgattcgatttgtttcttaaggggaaattccggtgaatatggaattagaagaagagaggttagaagccaagaaaaagattgtacaataaattcttcaactatggaatgtttttagatggttaattgttcacttctttggtatatatatattttttactgaatgctgaataatttgttatttaaaaatcctcaataaagaaatctgaaaaaattcagtgatcagtcagcattttcagttgttcctatgtgttattattttttttttctaaatgtgtttcctagtctcaaggaaatttctgctaagtgtactgaatctaaacctctattatgtttgtataatttcattcttttgttgtgtggaggtttgaattcatcataaatcaccttaaagttccataagcccaaattaattatactcatatttatgatatgctacatttgtgcttctttatcatattttatcattgtaaaattgatacagcctgatcattgagatccttgatctgtttaatgctatctacttcaacatataatatcatgggaaaattaactttgttaatttgaaacacttttcttgtttacttatttaactctttaaagtttgcatttctgttttatacttcttttaatctatgttatgtggtgttgacatttcgcttgactgatgatttttttaactgttaaattttgtatatccaatttaaaaaatgaagtcaacctaattataccacttttgtaactatctgacatatttttttctggtttctatgtactaatgtagtgagctttttttatgtatatatattttttcagaatactattgtggaggcttctattcagcttcctccttcccttttctcaccaaagcaaaaaagagaactcagaccaactgatgactctctttacaagcttcaactcattgcattccgcaatggaaagctttttccagccactggaaattcaacaaatttggctgatgatggaaaacgacgtactgtggttacccctgtgattctcaccaaaataggtttgtatgtggcatatgttatcctgtagtcagtggacaataaggccttgtagttgactgttcctaaaaatgcttattttagtgttttctcgttttaatgagtcactagtgaagaaagatcttgcagagtacccattactgtagaagttgacatttataattggttatgaagtttgtttcagaaatatttttatttcccattttctccagatggtgtgaatgtagatacccaccacatccctgttaatgtgacactgcgtcgaattgcacatggagcagatgctgttgcagcccggtgggatttcgatttgctgaacggacaaggaggctggaagtcagatgggtgccatatactctattcagatgaaaatatcactacgattcagtgctactcccttagtaactatgcagttttaatggtatggcagttgttaactttatgcataaacactattctacatttttgc

SEQ ID NO: 110870 - DNA, 1055 bp, Homo sapiens
taatcaagcaagctgtatatcaaaatttttggcagaaaacacaaatatgtcatatatctttttttaaaaaaagtatttcattgaagcaagcaaaatgaaagcatttttactgatttttaaaattggtgctttagatatatttgactacactgtattgaagcaaatagaggaggcacaactccagcaccctaatggaaccacatttttttcacttagctttctgtgggcatgtgtaattgtattctctgcggtttttaatctcacagtactttatttctgtcttgtccctcaataatatcacaaacaatattccagtcattttaatggctgcataataactgatccaacaggtgttaggtgttctggtttagtgtgagcactcaataaatattgaatgaatgaacgaattagtgtatttttgtatactttttcttggtgaccaccattaaagagagccaattggctaaatttagaaaatcccaactgcccaagaaaatctcaactaggtcaaaatgtctgataataatatatttacttgataccctatactcagaggaaaattggcaagatttgcctgttaatattggcgctaagagagtatttgatgcactgtgccacactcctttggacctgctcaactttccttattgtgtcttatattggggaaaaaaacaaaacaaaacaaaaaaaccacaaacatactataaaagactagaaacagcaacacagagaaacccatgagagaaaggtgtgttttttgaggaatacttaaaattgatgaacacttctgtcttagatgatcacagttggtagaaagggattaaaaatgacgaaaccctacatttcatcaatttcacaacctacccctctgggtaaggagagtttctacttgctaaagtagaaggctttagatggacactcagatttgtcaatttcatgccattctatccttttaagatcatcctgtggccagagagcaaggacacattacactattattcatgcttcataggtggacacgattaaactgaatgaaaaaggaacatatccctcgt

SEQ ID NO: 110871 - DNA, 1048 bp, Homo sapiens
ctggcggtgtgtatttcttaataataatagtttgatttaagctaatgcatgcacaaaaaggaagtgtttataaatggttttctagatgaacagtcaagatctttttattctggtattgtgtgacatcctttccttctctttaattaatctaattgcctttcttttcctccatttgagataacacctggcagtcttttcaccagtgatgtggtggccacttacatatgctcttttgagctaaataccaccaaatggctatacttgaaataactgttcatatctgaagatgttttcatgagaaacaagtaaagtgcctgttgggttctcatgtggaatttgagactgaaggccaatctcactgtccattaggattttgattctacgaaatagtttatggtggttttaaagatctttcttttttctcctgaacccctgctagctaggtgacgtgatggttgacattgcaagtaacatcatgttggctgatgaacgtgtcctgtggctggcgcagagggaagctaaagcctgcagtaggattgtgcagtgtcttcagcgcattgctacctaccggctagccggtggagctcacgtttattcaacagtaagtgtaacattatcatagactcctgagaaaaaaagtgcatttcacacagctctcacccgaaagagataggtgtcttctccattatggggtggatatcttctcttactgctgattattacagaatttcttcttaacattttataagttataacattttataagttattacagaatttcttcttaacattttataagttataacattttataagttattacagaatttcttctaacattttataagttaattttgcttttgagtaatgttttcttgggaactggaaaatactttcttaatctttaatttgaatgtttatcaccatctaatccaccgaaagtgtttctgcaatggaaaataagaacactattgtattgccccactggcacatacccatagtccatctgagcctaatactctgttctgggccctgaaggatattttga

SEQ ID NO: 110872 - DNA, 1013 bp, Homo sapiens
agaggtagagggaacctcaagcaagttgtaaactgaagcccacgcttaggttagggcacgcctggaaagagaacccaagatccctgactcatccataagagttttctgtagcatcacattcaccttcccatacaatgtggccctgacttggaactctaaaagtgctctgtacacaactgtgaggaaaacactgggctaaacaaaacctgcgtatttctttatgtagaacttctcagatccattaatattgctaaaatgtaaataataagccttattttcctgaatcattctaatatatttttatatatcaattatatatacacacacttatatatcacatatatattctaatatattatataatatatatttagatatatctaatgtatattacatatttatgtatctaatatagatatattgttatatataatatatatataagaattagtacttgcaatgtggtaataagtttttgaaactgtggccctagtgcattaggcactttacttgataggatgtagttattaaaggaaggaaaatagatacatgtatataaacgggacttaggcaaataggccacctcacttgtcagcgggataacatttcatttgttttctgaacttcaggggccatgattttttctaataactgctcctgatacttgattgtgtctccagggcacagcccactttcctgcagtgaattttccttgcactgggagaggccgtttgggttctggctctgtgattatattgtgctccattgttgcttaagatgacagggttggtgcccacaggattagcagtcatttccgggagtgggatgtttctagttactagaataattgtaatgacatttggaatgtggacatggaagaacattcgccatcgaagaatacatgtttatgatgtgaacctgttttgctcacctcccaacttgagcaacgtggtgtccagaggtgtatgttgaactgtttgccagcctgtggaagagtggtcggctgcgttgac

SEQ ID NO: 110873 - DNA, 1794 bp, Homo sapiens
gtcttcatctctagatggcccagaacattggcaggcattactgcatatctgcagtgtacgcggaacacccatggcagtgggatatatcccggaaacccacaggatgagagaaaagcttggcgcagatgtgatagaggtggcttttgggcagatgatgattattctcgctgtcagtatgcaaatgatgtcactagagttctttatatgtttaatcaggtaactagaaagtcttcatgtttacttgggttgtggagaaaacatggtattcaaaccaaatacataagttttttttttttttttaatactaggcaaaacataaggattttgtgtttttactttagttgacttaactgtcttcaggatcaggtccatcttaatcactagtcaaggccctctatagaatccttcctttgcagtcaccatctccctttgtgcctttgtttgaatatcttttttttaatctgtatccaccagacagaatcctaaccatccttcgagttcacattgaaagccacctcttggattcattttataatcactttgttgaaagcgattgcttagaatacttgaactactcatgtgctttttgttatctttgcttctatgcatctttttaaaacttaccagactataagcaagtggaagatggcttttgtgtaatgtattttcttttgccccttagcacctggtaaaaatccttttgcaatgttaggtgctaagtccgtgttagagtcagtagataaacacatgtaaaacattactggcagtgcatggcaataaagataagtgccaaataagtagttcgtactcttgtgcagtaggagctccaagggaggtattgatcattcccagcaggaatactcaggaaaggctttattaagcaattggagttgaggtatgtgtagaatttggataggcagagaagagatagatggtgcaacatgttaacctcatgtatttttatgtattattgtatttcactccaagcttgaaaaaatttccctccagtgagtttccattaaaattccagttttcttgggtttgtaaagcattttaagaaggccatgatgagtaaataataaagtttttaattcgttgctgttttgaaatgcaaagttaaaatgtcaggattgtgttgatcattttgctaatgactgttttgttgatcatttttgcctttgaaatgtagatgcccctcaatcttaccaatgccgtggcaacagctcgacagttactggcttacactgtggaagcagccaacttttctgacaaaatggatgttatatttgtggcagaaatgattgaaaaatttggaagatttaccaaggaggaaaaatcaaaagaggtacttctctaaattcagatttgtagcatacagtgtcaacaaatggtagtgtgacagagttcaatctatgtattttaaggcctgtttatgtttatcatatttgagctaaaagcatgcttttaaatttccagaattttattgagatacttctgcctcttctcttatgacctgtttgctgctgggaccgggagaggtgaactctcagttcttggacgttaaggtccagagatacagcagaggtcgctggtgagaaagcagtaaaagcagtgttctgcctccacgttgtggcttaggcagagctgcttagctcagcctgctggatttctcttctccacatatcctcgtgctcatcttttgtaacgggagttttagtcacccagatcttgtagtaaattccttttaattgtccttgtaatgtcctagagaaatgagaggctgtttaggcactt

SEQ ID NO: 110874 - DNA, 1073 bp, Homo sapiens
agcagctgggattacaagtgtctgccacaacacccggctaacttttaaaaatatttttagtgtagacagggtttcgccaggctgatcttgaaggctgggctggtcttgaactcctgccacccgcctctgtctcccagagtgctgggattacttgccattcctgttctgtaaagtgttctgctctccctatttctgcaaggagaattctcatgcgtcgtatagcattgcatttgattcatatgtctcttattgccctgattgtgtattttaaagatctctttccttttttgccttgagattgaaggatttaaaggaaggaatcattttttaaattcatttttatatagcaagtgcttaccccacaatatgcattcaaaaatatttgctaaattaatgattgagacccattattgtctccttttttgcctaattatattttctctctttttaaaatctttctttatgcagtgccctaaccatttctaatattcaggctggatctactggaaattggggctgtcatgtccagaccaaacgtgggaataatacgaggactgtggatattgtggtattagagagttctgcacagtactgtcctccagagagggtggtaaacaacaaaggtgacttcaggtcagtgttgtggaaaatacggggaaaagtttaatttgtcccagatccttctgttgtctaagacacattattggtttcctgtcctgagtaacaaaatttgagaactgcacatgtctgaggactaccctttagaataatgatttcagaatcacatatggagatgaacaaaaggggtgcttgaactttatctcagacctgttgattgaagaatctctgaaagtagagtcatttttaacaaatggttttgttgtgtaagagccattgccttagggaaacattggagatattctggtaaaagagtacaaaattcaaacaggttaagtaaggtattttctgttttttttccccccagtggctcttttatagatgaaccttggaaggttttatattgctaaggtacttttcactactggcagttcagtaggcatcagaattagaag

SEQ ID NO: 110875 - DNA, 1027 bp, Homo sapiens
tatttatatttttaaatggttacatttcagatggttacataattccctgcataatattcttaatattgcttcgtagccagcaaagcctaaaatatgtactgtctggccattgaagaaaaagtctgccgacctctgactctggattctgttatattctcctaaagtgagctaacttttgtttggtcaggcagttagcttggctgaactaactcctagctctgtcccctctggtaggcagaagctaaagtcttggtttctgctctctacctgcaagtgtagttcaggatcagtaagagatcttggtgcattttatacatagaagtttgggcttccagcctgacttctttctacctctgtcttctgattttttaagccaataagattgtgagtttctatttgagtgaggcctacccttgggcaaaagccattaaaaaaaaatctagttacttcccagtgccaaaaacccttgtttctcatatcaactcctgttcagttattgcctgcttttgatcaatcttcatatgttcaaatgattgtcattttataatttgtcaggggcatataattgttagctgtgggaagggtgatttaatatgagctactcagtgattgctagaagcagaattcccttattaggagatacgattaatcgttcgaaatgatatattcattgttacactagttttactgtagcgataatttcacatgcctatacatatgtcagaattcatcacattgtacactaagcagtttattgtataaacagacaataattgatgtataattcaatagtaaagttttaaaagtagaaccattttctatgtagaagagctttgattaatttagaactctaaattatttgactataaaataagtagatttactgtataaatctatttctgcaagtcatgcttaaatttaaattatgtttagcaatgcaaaaaaagttaattctaaggataacaagttaacctaacattttttttggtagggacatgtgactaaagtgaaaatctttcatgtgaag

SEQ ID NO: 110876 - DNA, 1054 bp, Homo sapiens
atattgatcaggacatgcaagtgttgtggtatcaggatgggagaatagttgaaaccgatgaatcgcaaggtatttttgttgaaaagaacatgattcacaactgctccttgattgcaaggtaaactttttttttttttttgaatgaagaattgtgcctgtgtattttatttatccttttggaggtgtaatgtttagtggaatttgaattaatatttcatcttcttgtatttaaaaatgcaaacatctggcatttccttttcctggttcttattcatcttctaaaattaaatagccatcttttcatccagtttttaaagaaaagacttaatttcaaagaaactttagaaattgaagacttttttaaagtttttggaggaaaaatgtaaacttttagtgctaaacctaatttccaactatttcctgctgctaagcttacattttctcttttagtaatcacctgatattgactctagtcaaaatattgactgatacaatattttaaggtacttatcttctccacctactagtataaaagaatataacatctgaactatcaacctcataattggtgtgaataccaaaataattaaaagtaaaaatactttataaagtataatagactaagaatatatatgatattatcacttaccagatattttactttggtaaaatttttacctttagacattgagttttccactccctttcttctttctttccacctacctagaacttggcttatatttttatttcagtagagctgcagttttcagactctctgccaggtcctcctagggtaacatcacagcaaactcacaggggtgctatgaaagattactgaaaaactaaaggttctgagttgacattcaaatctcaggggttctctgagttgagattcaagacttatgcagttggctattttataatttttcttgagatttcatgtctactagaagcatattttcatttatatcttccaacatttagagtagatgctttaaatcctttcctgctaattccaacatgtgggcaatcttgtggttattgctactgg

SEQ ID NO: 110877 - DNA, 1352 bp, Homo sapiens
cataaaacaatctgtattgctttaggttgctgtttgattgccagaatcagcagagttggtaggcatttaggccaagaatgtggcaatgatggtggaaaattggggatggcttcaagattcaatattaatgccacacactgcatgataaatgggtagaagttcgatagacaaaaaggaatgggatttggtattccagaactctggtgttcagtggcttgttgcatagaagagggatatctgccaaagagtctttgtttgcctacaaaatttcatccaaagcagaaacccgggatcagcaagaacagtgttggggtccaacactctgcaattcagctccttggagagaaactgtagctagttgatgaaatgtactttaggcatggtatgggtgaacagtattgtgcttgccaccagaaatgtaacccaatataaaacaaaagtgctatttaattttattcactataatctctaagttgtatttgcatgttacagggaattccagactgagtatcttttgtgtgactgtaacatactgtggatgcatcgctgggtaaaggagaagaacatcacggtacgggataccaggtgtgtttatcctaagtcactgcaggcccaaccagtcacaggcgtgaagcaggagctgttgacatgcggtaagggagaaatccaaactgagaaagcatttaccatattttgacttgctaccatgtttttcttgacaaattgtaagattctctttatacttggacagaactagtatgcagccagtaatcattatggatttgataatatttagtttatgccaacgattaagccagctagattaaatgaccttttttttttcagttgtctttaaggtagctgtttttaggttcacatcagctttctttatgcaaaccaatttcaaagaatagattttcagattttccatcagttggcaactcgtgaatttgtctgtagtaacacaatctcaggatgcccacatcctgtgtgtgggtgggaatgtgaacgatacagcctttttgaagcaacatgtttcagtgttcttaaaagactgatacaggcagggcgcggtggctcacacctgtaatcccagtggatcacttgaggtcaggagtttgagactagcctggctaacatggtgaaaccctgtctctactaaaaatacaaaaattagctgagcatggtggcaggtgactgtaatttcagctactcgagaggctgaggcaggagaattgcttaaacccaggaggtggaggtttcagtgagccgagatcgtgccattgcactacagcctgggtgacaaaagtgaaactccatctcaaaaaaaaaataactgatacagttagatc

SEQ ID NO: 110878 - DNA, 1125 bp, Homo sapiens
aggaaatagaaatgaggagtgattgcaaaaataattgggccatatcatagatattgttaaagtaatttggctaggagtctgaatgatagatctgtaaactaaaagctaacacagttttttttttcattatagttgaaacttctgagtatttaaggaatgaagtcagaaagtggtattttcagatgtttccgaggaaatgaaagttccatcattgtaatattttgcccttttatccattatctgtcatttactggctgagtttgggctcagttctccaactgccccagcataattaactgtgtaggtcatctaaggaattgtattgcaggcagcaaaatagtttgagtctcatttttactactccagttttatcttgagtaattttgcaagagtaagtgcttgaaatatagagggcactataattgagcagcattgagtctgtgcgtgccagcagtaagtgaaagcaaggatcattttcagcctcactgctatccttatctcatttgcgtacagtaaatatctcaaagttgctagaataaaggtcttgtgcgatacctgggtgctgttcttgaatactgaatgcatgagaccttctttaaccaagagaactaattgaagacacttttccacccttctccttagggatctgacaaacaatcgaataggatgtctgaatgcagacatatttcgaggactcaccaatctggttcggctgtaagtatatcttttctttcccattaaaagataaggaagcatttgagccagtacctaaatatgtatgaaacttatgtatttaattataagtagcaactgtaggggttatagaagccataggggacaaggagctcacaatttaatcatggggatgtaatctcctcagaatataatgctaccttaccacaccacacacggacacatgtgcatgtacaccacacacacacaccaaataacacagtgtagtacatgcaacagagagcacgttcatgctgagcagtatgatcaaaagctttgctagtctgggaaaatttctaggaaatagtaaaatgtgagctgatggcccagaagatttgcagagatctggatagtgagaaaggaaaagaagccaaactaatgatacatgaaggt

SEQ ID NO: 110879 - DNA, 1030 bp, Homo sapiens
actcaggaggctgaggcacgagaattgcttgagcctgggaggtggaggttgcagtgagtcaggatcacgccactgcactccagcctgggtgacagagcaagactccgtctcaaatgacaacaacaacaacaacaacaaaaaaccccaaaaacctaaatatagaaggccagggaagggaaaatatatgaacaaccaaaagacatgaattttagagtgtatatttttgaagatggttttttaaaattcaactgaatgatgtttgtcacaattgtaattagatttactttgatattcaaagtatggcatactaaagaagaaattatagaaataatgtatatgattgtagttcagtgataattgtgaagttgaataatattaggtcacatatttcttttatgacgtatatttttattattttattgaccaaaccaaaaggctttggagccagatttgtcaaatttgcattctgactctcccttttactactgggttgatcttggcttaacccttttggcttcagtttcctcctcttattattatacttttgttttttttgtatagcaggtaagtgtattgtgcctgaatacttgttgcagtgttgatatgtgaataacttttattttatttttaacagggacctccgaaacaatcttattagtagtatagatccaggtgccttctggggactgtcatctctaaaaagattgtaagtgtttgaattgcttgcttacgagtttgaattgttgcttatataaatagctgtcaacttactttaacatgatgaaaaatggacatttaataattttttgagctttacctggccaggtccctgatacagaaagaggctgggcacagtggctcacgcctgtattcccagcactttgggaggctgaggcgggtggatcacctgaggtcaggaattcaagaccagcctggccaaggtggtgaaaccccgtctctactaaaaatacgaaaatgagctggcatggtggtgtgtgcctgtagtcccagctacctgggaggctgaggc

SEQ ID NO: 110880 - DNA, 1050 bp, Homo sapiens
acaaatggacagtagatttgtatattgttaaattacaaatagtattcagtcttattgaaatgatgtctagaagataccttatttctttataaagtcagtattttacaagatcataggttatgcatttttctgctaagtttccattttaaaaatgtgtattcaacttgcataatatgattaattatataaatgtacatgctatggtattgtttatgcttatgttgaacttagagctattacatattgacttttctctcttaaagttttgattatgtgtgatagaaataatttagatgtgacaagatgcatgagtaaactactttaaatagttggtttctcagagaaaggggaagacactcactttttttcagccatctcaaacattctggctaataaatgatgtcttagaatttctcataggtttaaacataataagctaaattactttgatattggtagtgtatattaggcaacttattatttttttggtattttttaggattctgagtaacaataagatatccgagctgaagaatggctcattttctgggttaagtctccttgaaagattgtgagtattctttaattatcatctcattattattttgtttaatgcattttcattgtaaatcttcattgtaaatctgtgactaaattcccagctattcaaaataaaaattgagtttttctaacattttttaatgaaaaattttaagaactttattttaaaaaagaagtaactaaattctgtaaagggccagatagtaagtaaattgcgttttcacagctggccacaagtgactcacctctgccgttgaagtgtgaatgcagccttagataataagccaatgagtattgcataagacaatacttaggaatgataaatgaatcgacgtggatgtcttccagtaaatctttacttataccagaggtcatggaccatactttgttgactttaagtatgctagtttaaagcattgatgctgtgttgaaattctatatcctgaaatatgtatgccatgttaggccattcttgcattgctatagaga

SEQ ID NO: 110881 - DNA, 1051 bp, Homo sapiens
gacatttgagaagaaatcaacagaatgagaggccaccaaaccagtcccatggaaccactggggaaaagttaacacaggaaaattctaattcatagtctcagatccaagagcagagcaactgattaaagaaaaaaaaaagcatctaatgggaaaggttgagcaaaggaggagttcttacaagttaagtgtgggattataatgttaaaaagctctggtgtgggccgggtatggtggctcacacctgtaatcctagcactttgggaggccaaggcgggtggatcacttgaggccaggagttcgagaccagcctggccaacataacaaaactgtcaagtatggtggcccatgtctatgatcctagctattcaggaggctgaagcaggagaattgcttgaacccaggaggtggaggtttcagtgagccgagatggcaccacttcacgccggcgtgggtgacagagcgagaccctgtctcaaaaaaaaaagtgctggtgtggggtcagtaggtgggctgaagggagaaatggaaacaaccaaggacttaagaaaattagtcttctggaaaattaagcagaggatttattccacaattcaaagcagaacgttattaagatgagaattttgaagcagaattaagaaatgtgaaggttggaactaagagatggaatatctggctaaggagcagatggagaaaaaaaaaaggcagcctaaacaattctttgattcaaggatgccatcaacagtcagatgcttatttccaaacaacttttcagcgagggagccagagatctaattattcttaagagctggtttctctaaacgtgtacatatttttttcccacccagtgaaatgccacttccttagcacctctgtcacccccagccttctcatgctgaatcacttaaccatttgtattctgcatggtatcattttagtacaaagctgcttacgcttttttttttttttttggaaacagggtctcactctatcgcctaggctagagtgcagtggcgtgatctcagctcacggcaacctccaccctcagggctca

SEQ ID NO: 110882 - DNA, 1888 bp, Homo sapiens
gatttttgtcaataaaaacttgtgtgattatttgtatcctctcattatataagtacctacatcatattatggatcttgcctcttggcctgcaaagcccaaagtatttgccgtctggcacctggcaagtttcttgacttctgccctggagttttattactcttctcgtgaattttaacagccttacatttaaacaaagtttaccattgataggaggaccttgtgctcattgctctcagagggctggctgcaggcagaaagagcttatttaatgtggcacacattgttttccagtttttttcctggatgttttcagctggacacccagaacgtctgcctgcctgtctttttctgaccacttgtttgccttctccctccctcccttgatccattcatgaactcaggaacaccctcactattggtatctcggttctctggggccatttacacctgactagaggatctgctcactccctgtgcctggacttccgacctacagagctgtgagctaataaacaggtgtggatttatgcagctcagttagtggtaacttgttacacagcaatagaaaacaaatacagatctttgcaaggttatctcactttaaatgattttccccttctttgtctgccctttaaatttccactagtattgtttgtttttctttttacagcaaagttcagaaatgtttccccaatcatcttacttttcagcaacattgaaattctgtattccctaggattcagttacatatccctcttgtagcacttaacacttagtgtacacttgtgtaatattagtctttgaggtctgtttttgtatttctgctctcactcccaggacacaatagttgctcaaatatattctgaaataatgagtaataggtccgacatcaagaattttggctgaaaaaaaatcagagactcagactcctataagaacctcaggatggtcccagtagaaagctttcaattagattaaaatgccaaataaaatggcttttattatattcataaatattaagtgtccagtgttctttattgatatacagacaccttaaaaaatgggttgtcttttctcttgcagctaatgtgttcataagataaggtgaagtgttatttaataaacagtttttcatttttaggcatttttgaaagatatctactatggcattaaaaacgcttcaatttttcttaacgaaatgctatttaatttcatgtaaacttacagtttaatgctaaggcagaaaaataggttatttcctttttatttatgacactgctaaataaagaattgaaaatagaaaaaaaatcaggcctcctttattttttaaaatgtcagatctttgataagaatgcctggaaacttgaatcttatttattgaaccgtttcaggagttaagggtaaccacgagcccaggttggaatctgttgtctcagtgtaattattaatggcaactctttttatcctccagtgtgtttgatgataaattgtattgtgaccttatagtatatgctacctgttgatatgtttgacttgctgtctcattttgaataattgttaaccttgcagagattgaagttagaagtactattgtagatggtttgggaaggcagaatatactgaactctcccccattcaccaaatctgtaggaaagatattgaaaccgagtgatggaaatacccacaagttttcatgtctgtttggaaacttgaaggatcatttctctattatggaatttggaaattttagtagaatgtgtccagctatgcatctttttcatcagtttccctggcttgtagttagtcttacaagtctctcttcaaatgaaagatatttccttttcgttattttttttgctcatgtacatatttatatttatacattat

SEQ ID NO: 110883 - DNA, 1766 bp, Homo sapiens
tctcctgcctcagcctcctgagtagctgggattacaggcacccgcctccacgcccagctaatttttttgtatttttagtagagacggggtttcaccatgttggtcaggctggtctcgaacccctgaccttgtgatccacccgcctcggcctcccaaagtgctgggattataggtgtgagccaccgcgcctggcccaccagagtttactcttgtggccaccttggttttgatggattttggctggcttttttactgcaacctgttttattagcgaggttttttatgacctgtatcttatgccgaccttttttatcctatgacttagaatgcctaactgtttgggaatgcagcccaataggtcttagcctcattttgcctagctcctattcaagatggacttgctctggttcacgtgcctctgacaaaatgagtacacattgactcctccgggaaggcttgttaaaacagattgctaggccccaccttcggtaaaaagtcctagtgctttaccagactggtaacatagcccaatgcacaaaaaggttgggagtctctgctttggatctaatgccagtctgcaggtattgccaggagagcagagaaactatcaaaacagcaccacaaagacccagtcattattattattattttttgtctaacaaaaagaggttggatggtactgttatgttgcaagggacacactcaagatacacttgtagtcttagatactggtttggataaaccatctatgaaggatctttttgaaagatctttggaggtcttcttttagaaacttaattattgcctgagtgttagatgagattaaaaagataccgaaatggaaaggtggaggctgggcacagtggctcatgcctgtaatcccagtgctttgggaagctgaatcagaaggatctcatgaggccaggagtttgggaccagcctgggcaacatagcaagaccccatctctacgaagaaatacaaaaactagctgtgtgtggtggtgtacacttgtggtcccagctacttgagagacagggatgggaggatttcttgatcacagggattggaggttgcagtgagctgtgattgtgcctctgcactccacctgggtgacagagtgaaaccctgtctcttaaaaaaagaaaggtggagatcaacagcttaaaaagctggtaacagtagtatctacagtgtaatctcatcttgtgtgtgcaaaatgcacacttgtaaatatatgtgggtgacagtgttggaaatgagctttattaaggtgttaaaatggtcatctctagatgatggggatatgcttttattttcttggtttggctagtctttgttttctaattcattacattgtatgcctactgttactgtaaaataaaaatcatttagaaaaaagccatcttttcagtgagaatgtcatttaccacactctttaaaagagaaatccacccagctacacctccactgtttcttatgttatgtctctgtttcttatgttatttttctccatagaaattttcaacagctaacatattctgtgttttgcttatttattttttcttccacccactagtacataaactctataagggcaggactctttattttgttctgttttccccatcaccctgaatgctatcaagcattcaagtaggcactcagtaaatctttgtaattaaatacatgaatgaaaaatatccaatatctatgtatattgggttattgaaggaaaacggtgagttacagtcaagtttaaaaacca

SEQ ID NO: 110884 - DNA, 1017 bp, Homo sapiens
gttattttcatgaaagtgacaccttaagtgctttctttggtagtggtgttggggtaagcctttgtagaacagttgttacagaaaacttgtttacatggaagcattccttcagcgatgactgacagacgggaaaagcaaagtgcaggtcgaccatctcaaatatgaaaatgtgaaatccaaaatgctccaaaatccaaaacttcttgggattgacatgatgctcataggaaatgctctttggagcattttggattttagatttttgggttcgggatgctcaacctgtaagtataatgcaaatattccaaattctgaaaaaaggcgaaatcagaaacacttttggtcccagacatttagaatgagggctatgcaacctgtaactgagaatttttacctagtgcatattatgtccaagtaactaacaactgttgaaggaaagaattttaacatcccattttactctcattaagtggttgtggaaatgaccaatggcatttatacttaggtttgtaacatcatccatttattatacggtctttctttgcttatctgctgcattcttgagattgaaaattttatcctggaataataaatgaccctatctcaaacagctgccatgttaagatgaataagaacatcatagggggagtagatgcatttttgggaggcctccatctgaagtgacatgaattcataacactctagttctgtctacatgtcatgctgttactaggtgagcagggaactgtcattcctacaccttatttaatagaggtgatcagaatggaggataaagggaaatagcatgagactgtgaatggaagtggggattcgcattggttttgctgccaagtagaatcgtgtcacctagcaaatcacaacatttctggccttcactttcctgactagtaaaacgaggtttttgaactaggctgtctttactgattctttaactgctaaagttctatgattttacatatgaaaccaaacctaacaacattgctaacgtgtattttt

SEQ ID NO: 110885 - DNA, 1031 bp, Homo sapiens
tgacctgaaggctgtcaagtatgtggagtgttctgcacttacaaagaaaggcctaaagaatgtatttgacgaagcaatattggctgccctggagcctccagaaccgaaaaagagccgcaggtgtgtgctgctatgaacatctctccagagccctttctgcacagctggtgtcggcatcatactaaaagcaatgtttaaatcaaactaaagattaaaaattaaaattcgtttttccaataatgacaaatgccctgcacctacccacatgcactcgtgtgagacaaggcccataggtatggcccccccttccccctcccagtactagttaattttgagtaattgtattgtcagaaaagtgattagtactagttttttttttgttgtttcaaaaaaaatttttttgtgtgtgtttttttgtttgtttgttttgtttaaaagcaaggcatgcttatggatgactctgtaacagactaattggaattgttgaagctgctccctggttccactctggagagtaatctgggacatcttagtgttttgttttgttttttttccctcctctttttttgggggggagtgtgtgtggggtttgttttttagtcttgtttttttaattcattaaccagtggttagcccttaaggggaggaggacggattgattccacattccatttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccgtcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaagtaatttctaacttctttcactgataaatgaagaaaagtattgca

SEQ ID NO: 110886 - DNA, 1085 bp, Homo sapiens
gtgtgtatatcacaatttctttattcactcattgagatgggcatttgggctggttccgtatttttgcagttgtgaattgtgctgctataaacatgtgtgtgccattactttttattaaaatggaagcttcacaagtgaaagagttatatcacctttggttacctctgtgtctcctactgcctgatgcagtggctagcactcagtgaagccatagctccctgccaacccccttcctgctgaccttctctgaatttaccatcggaacctctctgaactacgtaggaagcttagctatctctttacgttttatcttcaatgaaatgaaaaccctcttatactactcatttctagtttgctgccggcccaggctccattcccctttctagtaattccctcatagtatctcatgacaaccccaagaatgaggtagatcccgacagacccattttccaggtgaggaaactggggtttgggggctgcaaggagttaagtggcctcttatcggcacacagccccacatcccataggtgacagacttggtatctgaatccaaatctgccttccttcaaagcccaggctccttccatgggaaacctgagctgactcttgcaggcagggatgaattgtgatgagttgaactttctaggtagggtcagactagaattcctaattatgagcaaaagctgagaggtgggagagtacatagctagatttgagaagagagacccttgaataaagtcattgagattcgagtgttttagatttacttgctcaagggggacctgcatcatttaacaatgctatattcttccttcttgaccactgcaatcccaagtcatgctcttccttatttaggaccagtcagtaggacttgagaaccatttcattgagggtagctctggccttttgccagactccttttctgatcacttatcctatagccagcagctatgaaagatctgaaaactttcattctaagagtttgcaggtctcagaataaaacagagtgattttatctttccaggatctgggaccctgcctctgaagccttcagccaaccctgtatcacattggctaccggtagc

SEQ ID NO: 110887 - DNA, 1045 bp, Homo sapiens
gggtaggatctatgaataaaacacaaacacaggaataattaatctctactgatcaaataatcccatgtttttgtgttttaatgtgacattagccctctcactcccaacttctatttattaattataaaataattcttgtttttctgtaacaaataaaaaacatatcagttgagacagccttgactatctgaagtacatttttagcagtggcactgtatcggcactgtaaaaaatcacctcaaaatttagtggttaaaatagcaaccacttatgtagctcatgattctgtggttttgcaatttgggcttgtctcatctgggttcatgcatgcttttgcagtgagcctgtggttagctaggcagttttgtattgggggctcgtcaggctgtcacctgggctaaagagggtagctgaactacatgtctctcattatctagcaggctagcatgggcttgttctaccagcaagggtaggatcctaagagagagagagagaacatggaagagtgcaagaccttttgagccgcagaactggcaacaatactgctctgacacactggatgggtcaaagcaagtcccaaggccaggtcagatgcaaggggaaagagactctgccctgggatgagaggagctgcacagttacgtgataaaggggacttgctgcaagggagggaagcattatggccttttttattttttacttttgcaatttgttacaaccagttggcaaatatgtcaccttggacaagtctcttcacttttgcaggtcttggtgttcttgtatctaaaaaggagataatgtactagtccctcagctctcacagttgcaactatgccatgtaaatcagaccagtcacagattactctacagaacagaacttaactcataaagagatgtgaagagtcaataagacaacgaatgcacactgcttagtcctagcacaaagaaagagcccataaacagcagtggctcttttgttattaacaaaaaaatgaagataagctgtaggtgaagaatacggaataggttatgattaaaaaagaaa

SEQ ID NO: 110888 - DNA, 1026 bp, Homo sapiens
gtgacccaccattttgtcagtgtccacatgtctggtgtctgcacaccttcctttccaacagtcaaagctgagtattgccctttacagggaccctttaggtggcctgctagagtaggagaagcctcgtttccatcacaatttccactttcagctctgggatcctgggccgattaactaacccccctaagcctcagaatacctaggtttaatatggagaaatacaacctcctcagccggggcaatgttagattacatgtggtagtgcatccagagatgggcctgggagagtgcctggaacgtgttagccccctcttcccttcctagtagttccaggactgaaccaccacggggatcgatgagtgagcacgctcgccccctagtgggcatttctgccttgacctcctgagccaacccatccttaaagaggactggatggcctctatcgtcctagttggtttatttaccagctgttttgaactggtgtgagggcaattcatgttagggtaacaaggcaatagatcatttaaatgaaggcgacaggtttgagaatagggatggtgaattctttctccagtaaggggcaaagtaccatcccctttttacagatgctggccttgaggtctcagaagggacagcaggagactgggactcatggatgggccgtttgcacacatctaaatgcttgtgtggacaaccgagagcgagatcttcctagtgcctttatcacacgtggttcttaatttggaagtgcggggagaggtgtgaattgccttgttctgtctgtgattcaaggtaatctctatcatgtaagtgtcttgcaaagaggaggcagtaggcaagaaaccaaagttattgtttatcgacagcttgctctgtcaggtatcttccttagtgttttatgtatttaatccttgcagtaagccttggaagatggtagaaaagactctcattcccattttacagctgaggaaatggaagcctagagcatttgagtggcttgcttaaggtcacagagccacatgtgga

SEQ ID NO: 110889 - DNA, 1055 bp, Homo sapiens
gtttctgggcataacacatccatgctttcaacctcatatgcttcttgcagcataaacaatacacacttaaactcctaagcatttaccaggatacttatagaagaaggttgcagctacttgagctaatttttgcatgctttgtcaattcacattttctactaggttgaaaatccactttggtttgcagtggtgatgggttttatcctctgatgattcaacctttttgatttttgaaagaaaggagttttaaccttagcagtcatgtagcactttaaattcaaaacaagaatctgactctgactcttgaaatgatactgtgtgttttgtttttgtggaatgggagggccaaatgggtagttagtttcttttgcaattggaataactgtcataaaatcaggaagtgctggaagagaccccagaagtaattgatttcaaatcctcatactcaaagaaaaccaagacccaaagataaccaagttctgttcaaggtcattcagtttgttattttgtctcatcctaagcgagagcatttcctctctatggagtatatcctgtacctgtgttttgttttgttttgtttgtttgtttgagacagagtctcgctctgtccaccaggctagagtgcagtggcaagatctcggctcactgcaacctccgcctcccaggttcgagtaattctgcctcagcctccccagtagctggcactacgggcatgcacatccatgcctggctgacttttgtatttttagtagagacagggtttcaccacgttggccaggctggtctcgaactcctgacctcaggtgatccacctgcctcagcctcccacagtgctgggattacaggcgtgagccaccgcgcccggctgtacctgtggtattttataatcctatttggtttcttgctttccccaaataaaaaccgtttttgaactctgccagtggcattaaggaaaggatataaaacttgatagttatcaaaagaacatttccccccattattttagtgatataactatggaggaaattttaagcgttttgctaattttaaacttt

SEQ ID NO: 110890 - DNA, 1552 bp, Homo sapiens
aggcacccgccaccacgcccagctaatttttgtatttttagtagagatggggtttcaccatgttggtcaggttggtcttgaactcctaacctcaagtggtctgccctcctcagccaccttaagtgttgggattacaggcgtgagccaccatgcccagctggtattgagttcttaagaagggaaatacattgatttttaaggaagatagataaaacttgtgcagtagattataaaagaaatgattagaatttcatctctgactgatttgtgataacgagtatgttattattttagattatttgctttttagtgtactgtctcagttctgcttacacaaaaacatgctgaagacttttttgtaagatatttacttaaaaaattttaaagttttatatttgggtgttttgttgaatcactgtttcccaagattatattaatgaaatacagcttacaactcattttcttttttcttattatttccctttttacacttaaggagggctgaatggataacttttaaggtattgtcttaagtgttaaatgtctgagtatgctttccttgcctctccagaaatattttaataaccttagagaaacatgtaggattttctacaaaaagtgtcggctgctttagcggtttctccctgaagtgatgtgtaactgatcaggatctactcatgtcgtctttggtaaagttatgtcgcttgtcagggtgaggagagtttttgagatgcaaattttcccgtttttgttttattaccatggagaaatgtaatagttggtgtcttttggtatagctaacttttaaacagtacaggtggctcttggacagtcactgttttaaacaagcagcagtaaggcagactgaagacagtaggaaaaatgatcaacatggtggaaggaaagaaagcagtcagtaacaacttatataataatttgcaggaactcttagaactgaaccttacagttaagttgtgatatctggggtagattgtattatttccttatttcagaagaactgaggccccaggtcacatggctgtttatctgcagagctggcattccactctgcttagctaagtgctccctcaaccttgatgctatttttcctgagctgggtgccaggggagcttggatatgtaaagcttggttgatgtccttgataggtgcatggttctaagattgtgattttcatcctaagtttaggaagttacacacctgcgtggacaaggtgggtctaattatttttcattctggtttaatgttgacaagaaaacagacatggaagaggactttcctgcactcctggtcttccttttccttaagtagtgctacaagggtctgaccggaagatctttttactggtggcttgctgcttaatataatacaggttttgagtacaatcatttcttcgtattgtttttaaagtagagcaatgatatgactagtctgaagtgaacatagtctagaagtcacttgcttggtttggggattagaagtatttgcaaggtgaaccacccattctcttctgcttatttacactacactgctt

SEQ ID NO: 110891 - DNA, 4414 bp, Homo sapiens
aagggagaactgtccattttgatgagtatcaccagtcaaggtgttaccaaaaaaagaaatgagagggaagcacgtgcaagctcttttttttttcccatttttattttcctgtctttgtaggttacctttttcttttcctctttgccctctttagttttctaccttattttttattctatttctttattttcttttttgaaatggagcctctcggtctgtcgcccaggctggagtgcagtgacttgatctcagctcactgcaacctccgcctcctgggttcaggcaattctcctgcctcagcctcctgagtagctgggatacagacacccgccaccacgcttgtctaatttttgtacttttagtagagatgaggtttcaccgtgttggccaggctggtctcgaactcctgacctcaggtgatctgcctgtctcagcctcccaaagtgctgggattactgcacctggctttagttttctaccttagacatgaatgttctggtaattgtctgctcatagttggcgcccagtgctgaagagcctgctctagatggtctcaggcaggaaagatcagatagtaaatgttgggctctgtggacccatgaagtccttgtcaaaactacctaacactgcctgctcttggagcataataggtatagacaaatgggcatgcctgtgttctaataaaactttccttatggatactgaagtttgaattttacatgctactcatgcttcacggaatgttttttgtatgatattttttctttctaattaaagataaataaaccattttggattcacagaccttacaaatagaggctatgagttggatttggcccacaggcagcagtttgcttatctctgcttttatcagacagtgataaataagtatagccatagaatgaaaagtaaaagggaggcctgcctcttcctaattatgtaggtagctttacaactagcaagtcagaagcattgtattaataatatactgggttttggtttcaggtggcacatttagaacgaacagggcattacttaactgtgaaagataaccaggtggttcagttgcatccctctactgttcttgaccacaaacctgaatgggtgctttataatgagtttgttctaacaacaaagaattacatccggacatgtacagatatcaagccagaatggtaagtacaccttttgttctaacagttttttgttagtactttgctcaaaatggaacctgactgttgctagagtcatggccttgcattcactcattgagaatttatatttcagtgtgtaggtatgagggaattgactggatggtgtgattaatctttcacacccttcctttgttaagtggacagtgggattgttgatatttatgggcaggatttgaagccaaatgtgaagttacatttgaatagcatgaaaagtttcttcaggggctgggcatggtggctcacacctgtaatcccaggactctgggaggccaggatgggaggatcacttgaagccaggggttcaagaccagcctgtgcaatatagccagaatccatctctactaaaagatatataggtgtgtacaaaaattagctgggcatggtggtgctgcacgtctatagtcccagctactggggaagctgggcaggaggattgcttgagcccaggagtttgaggttgcagtgagctatgatcatgccactgtactccagcctgggtgacagtgagaccctgtctctcagacatacttttaaaaaagggtttttttttaatttttttaatttttagagtttctttggagccattctcttgctgttgtgattctcaagtcagtactgtttcttgcttgcagaaatctgtttttttttgttttgttttgttttttaacattttttttgtcccattacaattagccctcaactatttattatttatatattggtttttaggaactgtgcaggcataaaaatgatagctctttgtgttttaacatactagcttctacaaaatgtagagtaagaacggattgttttattttaagcaaaataaccctcaccttcatggttttttgttttatttatgccagaatctattctataacctatgacaggaaatgtcagccaagagtagtgggactgaaggcacatattctaggtgctgtcaccgctttatattgtgcagctgctttcttatacggatttgggacttttgacacttaaattgtgtaggacattaccattttatcttaaacgctttgttgagaaaaaaattatatagctaaactttataaaagatttcagtcaagtgtattttgggggtatagagttacagttattaaaacattgaaaatgaaaagatccaatcatttgaataccacgatgtttcctacacagaacctgttatatattactatatccttggagtggcaaattaatagtgtgccagagtaaagaaatcagtgactttatctgttatctttacattaatgtatcttgaggggtttgttattaagtttatggtaagtccaacatcagaaaattcacatcttactaaataaaatacttaacacatttctaaaagtgctatttgtaaggattagttatttgtatttttctgagacttgaattcatagatttgccttggttcatcagtatattaatgaataatgcctatcctattaacaactccagtacttcaattaaatgttaatttggaaatttttctgcccacttctaaacaggttggtgaaaattgcccctcaatattatgacatgagcaatttcccacagtgtgaagcaaagagacagttggaccgcatcattgccaaacttcaatccaaggaatattcacagtactgaattcagtgcttagaactgaagttattgagaggacagctttaaaagatgaatgaactcaaaagttcgagttgtgctcttcacgttggttcgataatggcctttatttgaaagctttttaatttttctttacagtaaatattccattctgatttcataaattaaacatttatgcctcccttttgtgttgacactgtagctcatactggaaaagtcgatcaatgttttgcagtttattgaaagtagttctatatataacaatgttataagcatttctttagaaatggttgaaaatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatactaattttggccaaagccctttggtatctttgttctagtctctaagtatagttgtttttcaagtgtggagcttttttattattataattatactgttactacatatttagtatctttctaccaggagtactccttaggaaaagtagctgttaaagcagtatttttaagagcatggcttagcgctttgttaggttaatcaggatgtgatcgatctaaaaggggtaaaatgtgtgtagtgatcatttgaaactggaccccaaaagagagaataatgaaaggagagctctctacttgtctttcttagagttcctttcataaggctcataatttattaactacatttttgtcagatgtttttattatacttctagcttctcaaacacgtttattagtattaggtaagaggaaagcatattttagatctcagtttaacaaaattcttagtgatggaagttttatgcagtatacaaaataatttgtatagtgtgttaaaatgtacatttgaccttccattttctatgacaggcagtagacaagttgaaaacttgtctacattcattttggaatgaaaattgaggtgttttatgtggcccataaaatgttttttaatcagttattttcatatgaagactaaatactgtactcattagtctggacttccctcttcttcccctcctacctttataagtttttaagtgttaaaggaaatatataggtgtgtgcctggcatttaaatatacttggtaactagcatgtgacttagggagttgggcaagttaactctttgaagctaactagtatgctttttagtgtaggtaggtgttactaaatgatgcctagtggcttgaaaaagttaatgtgccttctataagtgcctcattttgttcccatggaataatttacatggtggaataatacttcaggttacatttaaatattggttagatattcatgcaacattaagcattggcaacattgccagaatgtcttaaagttatgttgaaaaagtctaagtacttggtcagactgttctcactgaaatggcagctctcaccagaggaatattttgcttgttaatttaagctgcaagtgtagtttgtaagttgttgtgtatctt

SEQ ID NO: 110892 - DNA, 1069 bp, Homo sapiens
ctgatttctattaacagtcctttgaatccactcaaaagcaaaagtgagtttgtgcatgctcataaaaatttatcttaaatgttggtacatccagtttctttgagtgaattaatatactaagaaattttaagtatttaatgagtaacaaattaatgtactaaatggctaaggtagtctagttatacaggaatcgtttttagaattattttattaatagagcctttgttatacaaaatggaaactttggctactttcagatgtgattaggcacctgtttcttcaggaatgtgaatattgatcagtgcattaaagtttctctgaatctagggcttaattggaaatacattgtcataacagagtactaaaaggaagcaattgagcggatccaaaagtacatacagttggctttagtctttatctaaaaactaagcacctccaaattcaaatattcaaatacgtggatttcatttacagtcctctacagagtgatcattggtaattatgaccaagacccttgcgtactgcaaaagccaaaaacgtctgttgagtagcaataaagatgaaacataatttaaaaggttttatttagtttaagtatgctgtgttaacggctataagaacagaagtaaaacttgtcaagtaaatactgtgaacagttattttaaggtgtttataaaataagagaaactttgagaaaaatgcaagaaaattttgtggtgataaaattgaaaacaaatcacctgatttgggataagtctcttctatctcttttctgtttgttcattctctctttggctgtgtcttttaagcacgatgtggcttacccttaaggccagatgggctcagtagctagaatatgagcctgaggacactcagtttcagaatcaaaaatcaaaggagattggtgagatgtctgtatttgaatctaagtaacacagtgtttattgtggcatcttattatataataggcttattagagtttggtgaatgataggtatgagcattctttcttgaaactcttaactatattcttaatatttgatatgttgtactggcttctctttgacat

SEQ ID NO: 110893 - DNA, 3275 bp, Homo sapiens
ggcacccgaacaaacatgaatttcaaacttcatatcaagtaaatagaaatagtaatgtataattttaggcttaaaatctaatctgataatggtattcttttacaatggtagaaaaacttggtaaaagaaacatacctaatatataaaatcgctaattttgtaaaattggaccattaagctaaggaaataatgctgtttttagtaacaataaaatgtaatccacaaatgaatagtaacttggaaattagattttccctaaaggagaagaaatattgttaagaaacaaatgaatagctattcttacagctaaaaatagaaaataagttcttactgacgattaaaatattctctgctactagttttagcacgggagagaactgactccctattgctgagtggtttattgaacttaatgctgcaaatatttcaaaatattctgtggaattaaaggataaattgaaaaaaatttaaatgtaaaattatggcttagtttagacgtatggtatattctaatggtgtgaattttttatttaagaagtagctaaaatgttttcttgcagagttatgactgatcagactcagagcagatgggcagggcagtattgagtcactttaattaaattgtagcttcatttgcggaggtggtggtaggttgttgtctgcctttcttatatgttgttttatagattctcccagttgtacttctcccaagattttagtttttagagaaagtgtggggcaagaactaatggattgtgtacttacttgtctatctgcctagtttttatttctctaggttctcttatcagatatacttacatgattactgttgtttgagtttagaatattagctctttaagaagtttgttgttgtgatgtagttgtaatcttccaactacatctcagttttatttgtaattaaaaaaaacttatttttatttattacaaataaaaacctttagtttgtcaggagaatgagcatttatgtgcagcaatgtaaatggactgtttttaaatggtccatttataggaaaagtgttgaaataagaggcaagtaagaagtcagggaataaaaaatagtttgctgagcttgtaatgctttgtttgacattaaaatagtttttgaagttttgaggtcctgatactaacagtgcaaatctagaggcctttgagagcactacttatttattcccacttaactctagtggctagttcacattaaaattcacagctgtgagaagtttgtgtgcttttatgaattaccttgcttcaattaaattaagcaagagttttaatatttattatgatcatgttttgttgtcactatttggctattttggcatctttttaaaggggaaactgtatgggaaagagtaatatgatactgtattttatcttgttgttgattattcccattatcttctatccgaaccgataatttatgaattttttcattgacaaggttttaagagcttttaaaatgtgttgaaaaagtcccaagctgttaagtatttttattttcatactgcttttatgactatggaattgctaaactgaattaaggaaagttgtatttcaaaaaatgtagtacatgctttgtaacaatttaaagttttatgtgaattaatattgaggctctaaacaaataactgtagttacatatcttgatgacccttgatatgattgtttcagactaattgtcaacttttgaaatattggactttgcttttatattgaggttttgattcaaataagtttgttttttttcttttttaaatttgggactttattttctaatccttttgttaaaatgctgaaacactaggctgaatatcccagcctttttgaattttcttaattcaaaggcggtttaaccttccaccactactgctatcatccaaacccaagaattcttgatatttttatgtttacatatgcttctgctcaccggtgctaatagtgatacccaccagttggtaatagccacagtattagggaaaaaattctgatagaaacatggcagtagactggtttcaaagttgttgttagctctgcagtgggcaagcatagcttcctaactttcacagccattcagtagatttagtggatgcccttttgaaaaattacagttagctaaaaggcaattgacaccgttattctggttattggtagagctatcagcactggtttttttaaataagttgagctttttagtatcctgatggccttcagaatagctgttttgatgcctacttttagatctagttaaaataatcaggtactctgtagctttgaaaccctcttgtcttacagatgtggttaggtgttgatgtaccaaatcaaggtagtaaacaatccaagatgcagttggaggccatcctgccctgccctatgctctgtgaactgacctagctaggccttgttcctctatctgtgaatgcgtgactcatcgatatgggcgtttgtgttgggcccataccaaccttgtttagtcccacagtgttttgttcgccccacggaggccaagaaagccgcagatgaggccaagatgagatttgcccacatagatggagatcatctgacactgctgaacgtctaccatgcttttaaacaaagtaagtgtaaatttgattggagacactcttgtctaaatgtcacttgcagtgtataagatgtttctttgtcccactttgatttattatccgtgacaacttatattagaaacccagaggtacttttgaaaaactcctgacgagcatttaaaatagaaattgccaatctttttcaaagttgtttatgtttataatcaggggataaagcaccaattgtagaaaacctgaaaaataacagtgataaaaatgacagacttgtataacatgtatcactaacatacacgtttttatatacttttatttctgtgcattttacatttttaagaatagttttatattgtttatacaatcattactctaacatttttactaataaagaactttttacaccaaaataaaactaatagaaaaaaatggacaagtatgaatgatggttcttaggctaccagtggtctctaaacatgatatggaaaagttcagctctactgttagcccaagaagtgcattattattttggcattattattgataatgaaaggcattaccattttctcacataaaatttgcagatattgaaaaatattccttagctgtatgggagtggggttagttgtggtctttatgaaaagttgattttatgttaccaggaactttagcaactgt

SEQ ID NO: 110894 - DNA, 1590 bp, Homo sapiens
gttgatctaataacagatggttgctaagtgacaaatgggtgtatagtgtatatagcatactactaagaatggtgcacaatttaaacttgatgaattttttctggaatctttaaaattttttctgttgacactgcttaactgaaaccatggaaattgcgagttcagatgagtgaagactactatacgaatttctttctgcagttgcgagttttatggacagtagcaaacactgaatactataaagatagttggagaaaaatggtttctctctagtctagcctacaagtatttatctctactgagacagtgtagaagtaatgccaaaacaaatagctcaggaggcagcagatttttgttttctggaacgaggagactgaggcatttttaacataaccaataaatgtttttgttctttgctaggataacacctatcctgagattttgcgttctaatttaggatcagttgtgttacaattgaagaaacttggtattgatgacttggtacattttgattttatggatccaccaggtatgacttatcaaaacacatttttatcagatcttttaaccaaaattgactcttagtgtttttctccatcctatttaatatatgtattaaatacattttgctttttccatccagtatgcatcaagattaagtcttacatgatagcattaaaactaaaaaaggtgacagttatatgagcacattttttttttttcttcaaaagttattatgggggggtttgggtaaattgaattatcctctgggcatgaaaatgtgagaattcctaagttttctttggggaaaaacagtttgataaacacattgatgaattagcaattatttaatgtatttcggaagaagacagttttgcctacaggaaaattttgcaatgtttttatgattcattgtttgctagatctgtataattgaattggatgacagtttgagtttgagtttggtccactgcaaaatgaaaaatgagattgcttataatagtttgtactttgtcacatttttgcttgcttaaggcaccgtgtctaatagattgtcttttaccactagctcctgaaactctgatgagagccctggaacttttgaattacctggctgctttaaatgatgatggagatctgactgaattgggatccatgatggcagagtttcctctagatccacagctcgcaaaaatggttattgcaagttgtgactacaactgttctaatgaggtcctatctattactgctatgttgtcaggtaatagagggaaaggaacaaaaaaaagcccagctcttcaaagtttgggtggacttcacttttgtttttgttttttaatttttagtatgatagtggattttatagatggttttaaggaattaattttgttttctaaataccttgtaaatagcttcgtaatgacatagtgcttacaaaagtaaagtaagtcattgtgcacaaaagataagtaaagcattggctctcttgagtgctaataaaaattgcagtaagtttgagcacagttgtaactgaattctttggttaaaggtccatcactgctatctttgtggtttttttgttttttgttt

SEQ ID NO: 110895 - DNA, 1159 bp, Homo sapiens
acatgtcatcccgttgagaccatgcacttaccgaaatatttacatttgattctgctgatctgtccattcttactggattataacttgagtttttttccatgtggcattttgtttaaaatgttgagttgaattttggtgatataaataacgaagttttcatttgtaaatattgcccaaaaacattgaaatatacacttgtggaaatttgaatactaattataagggctgttttatcagacgttttgtaaggcacgttatattgcttcatcagtatttttctttttatgctgtccattaatttgattaagcaaaatgtaatgcggttgagtgataacctgaagtaatagctttgttgagaaagaagttgctgttgtggtgtaaacaaaattttggttccttaaatattaatttacctttttaaagcattggccattgaagatcaaatgatatttctagtttatttgctggcttgaaattccttgtgtcagtgaaagttagtggctgatctttaacagtcctgttaattttatttgatatgtaatataatttatatactctatttcttaacaggtagttgtgtcaactaacatagcagagacgtctttgacaatagatggtgtggtgtttgtgattgatcctggatttgcgaaacagaaggtacatatttagtggatactttataaattagagttggtttaacagtacttacaaccaattcatttaatggctaaaatttacctttcagaattattttcctatctttttttttatttgcaaatttctgctgtatgaaccctttatgttttggctggctctcagaaattaagacagtatttaatatgtaattctaggcttttttttcttttagagttgctttgctttctttgtttcagtgtagtgacggtgggtgttttggcttgtatattcatttaacagtatgggtttagtaataaagtacaggatttctatccctgcagttcagtcacttctcccaacattattagagttactgctgtcaactaggcacactatttgaaaacagtactatgttactcctctagtttaacagtgctgtatactaaatgaagtgaaatgcaggtgaagtggctattcaataaatacgttttatttttcaaatatcttttggataaattgatta

SEQ ID NO: 110896 - DNA, 1036 bp, Homo sapiens
gcccttgtggagatggtcctgtagttttaaagaaagacttaatgatccaggatctgaagatagcttactgtggtgctgctgggatgtttataagcaaataagttgatgtccttgtgttggagaccaccacagagttccctggggactaaaagtccaaattagtttaaatgcattattgtgtccagacagtattcaggtagggcaaatgaagtactgcgagttctactttgaagtggagttattgggggcggagtggggggaagtggttctattagaaaaaaagtgagttctattagaaggcaggttattgagggaggaaaatttactcttagcatgtcctgacagtgatgccaagcttttcaccatagggtctgttccatattagtcaatgcggtttgaacactttttaaggctctttgaacgcttactgcagtgttgcagtctagaaagcatgtaacaattatattgattcttactggtcataatgtaaatcccttgacaaattcaaggtcattttgtctcctgatgggttcctggttgtatggtgtgccatttacaattagaacatggttagggcttgcctcactcaactgctgaagtaccaaagaagcttttatcttgtcatttattagttcgcttttgcattgtgtgtgtgtgtatttagccttagctatttttagtccttgagaaaggcctaaaacttgtgcttttttgttaaggactcaatttaacacttgtattttagggtttgacttttggctggcaataggctcttactaatatcaataatgacgagggtttgccaagttggcataaatcatttgattcttaaacacttgcagaatcatgtatccgcgaattgttaagtattacagaatttaatacactcacccagacaaaaaacatacacacaggatgaaattattttgtggagaaaaattaactttttataatggtaactaaagagttggtcacatgagaaatttttatcacattgtattatgttatagaagaaatatgtgaaatgtattttttc

SEQ ID NO: 110897 - DNA, 1505 bp, Homo sapiens
cccgcctcagcctcccgagtagctgggattacaggcatgtgccaccacgcccagctaattttgtatttttagtagagacggggtttctccatgttggtcagggtggtctcgaactcccaacctcaggtgatccgcccacctcggcctcccaaagtgctgggattacaggtgtgagccactgtgcctggcggtttttatcttttataccatatttttgccatgccttttgtttagatgaacaaacacttcccattgtgttacagttgcctactgttattcacttcaataacatgctcctcaggtttgtagcctagggagcaataggctatacagtttaggttcgtgaatacactagaatgtttacacaacaacagaatcgcctaacaaatttctcagaacatattcctgtcagtaagcaacgtgtgactgtagttttctgagaaaaaaatttgtagctgcctaagacatttgggttagcctagttcttaaatatctgtgttgatactgtaaaggtgtttgttctcattaggcacaatgaagcaaatcttccatataattgcattagtgatacgtgacattaaagcctaattggcttatttaaaatgtctagcacatcaatttcttttagattgtgaaaattgaaaaggtcgtgagtgcatttaaatattcctgagtgagaaatttcaattttagtacaatttgttgagaattaattaggaaatctgactctaagaaaaggggtgtggaatgcaaataaggcagttatatattcatttgaatacaaaaatgaaagtttcttggattgttttggaaatcccattgaaatttgctaaattagttttggttactaaattgaaaacagggtatccatgaagtgaaagaagatggcatacataaaacagactgcatagaactaggattataataaatactttaaaatgtttcagtattcgtttttagactcacttttattttgtaggaaattgatgaagcctgtaagagaataaagcgtgaagttgatgatttgggccctgaagttggtgacattaaaatcattccattgtattctacacttccacctcagcagcagcaacgcatttttgagcctccacctcccaaaaaacagaatggagcaattggaagaaaggtaacattagaaatgctctttataaatatttcactaataatgatttatgagatataaactgtattcagttataaaggactaagttatgggtgattgtgatctaggttttatacaacaaaataatatccatttgtagggttccgcatatctcttgaccctaaagtaagaatgagtactgcttcttctaggtagtgcctccttagcaaatggaagattagttaggatgggttaagaaaggatgttggccaagtactgtcttttctcctattaaatcacttgttataaagtaagcactttttctttggtgccttggccttctgcccataattttgtttaaggcttcccaaatgtaatgtct

SEQ ID NO: 110898 - DNA, 1067 bp, Homo sapiens
tggaggaacctttttatatctggtccacttattttttttttttgcattttctgttttttcctatttgcaaagttttgttttaataatggtagcaataattatactgcatattaatgttttcttttagcaatctgaattacatataattttataaaatctgattttaaggtattttatgaagaaatgctgtagtttgtgcatttattttttttctaaatttttaaaaatgtaaataacttttactatagttcagccattatgtatttgatttttcatttacagtttatttgaaggttttcatgggcatttttatagctgatatatgtagaatagtaaatattgctatactgtaagaccatgtaagaatccttgaagacagcttcaaataatttactgttttctttcaggttatagttatgagcgctactctagatgcaggaaaattccagatttactttgataactgtcctctcctaactattcctgggcgtacacatcctgttgagatcttctatactccagaaccagagagagattatcttgaagcagcaattcgaacagttatccagattcatatgtgtgaagaggaagagggagatcttcttcttttcttaactggtcaagaggtattgttttaattttcttcattatttagcttttgacatactgtttctaatatgcagcaaccttaatcataagaacatgttaatcatattttttatttcaatgttcttcaacctgattgtattaatatgtaaaatatataaccccttttatctgcatactgtaggaatacttctgtataccactagagtttgtgttataattattttaagagtgttaaatgcttttggaatttcaagattttgcaattgtagtttaagagatccctgggatataagtgctattatgctgaagcatgaatgtgcatcacagctgctttgaaatcaggttatcttcatcagtatttagcttgtgagtgaacttgggtgcctattcatcatcaaaacacttcagtttggttttgtcttcccatatgctcatgaaatttgggaaggattactaaa

SEQ ID NO: 110899 - DNA, 2025 bp, Homo sapiens
tatgttatgttctgctactgagatcatgtacaagagtattgcctctctcgtgtctgtgatatatcggaagacaggaaaaattaccaaacgtcctcagatcaaagaaatttcaaagcagctaagggctatagtgttgctgattcttgcactatgctttactgtctttaaggcactgagtcataatttaattggcagtgttttttctttcctggtcttacataaaataaccttatagctaatgctgtttgtccctcccaggaatgtggtagtttatttttaaaaatatgaccaaggacaagaagcataaagcatataaatgagttaagatggatttgtttgccaatagtttatgaaatttagaattaagtttaggtgaaataaagagaattcacttctttttgttgtacactatcaatttgctgaacttaatgctccagcagatggcatgagctaaaaatatccagttggtccatgaaagattaggttagactaatcataaaaagagccaaaatggtgaattcataaatgatggcttcagattttttaataccacttttaaatccgtaaataaaataatgggtttttatctaactggatgagctgtgacttaagcatctaaaggcatcctgtgttttgtccaggtgccaaaaggaagatagttgtttttcatagtgacatcagtaaccagtgtggaatggacaggagatagctgacccctgcaaagttatacaatcttgacccttgatctcattgccttcattcttacgtggcgcctgtcttgtgataactggagtccatattagcagccttcacttgagccatccctaactaagcctggtttccctttttggttcattgatcaatctgacgtcatttgtttttatcttccatttatgtatcagcatttgtttagtgttgatgctgcccctcagtcccacttcttttattattgaattccttttgtgctttaagattatttctttggggtgggaggactcacgctttcagcccttttgaaccaagagcctgttgttagcttattaagtaaggaattgttaaggcttaacaaaaaatgtttatttgcatgtggtaacattttagtggtgtgacatgaagcaacttaaaatggtttattagattttgcgtgttgaatatttgtatgtttttaaaaggtttaagaaattgaaaatgacgaattttgccttggcattcatgtgaaaccatgtgatcattatgttccataattggtcatatcatgtcttcccagtacatttcagtattacatttttcaagaattgatgaagcatatcttgtttcattgtatactcttaaaagattttcttgaaacttaattttgcaattgatcatgaaacagtagcacatttgtttggggcagaagtttatttttaatttaccttatgtctttgcatttcatttttgtcacgaagtttggttttaaaatgacctaacggaacctttaaccaacatgttctttggaatataggtatatgactgatgggatgttacttcgtgaagctatgaatgatcccctcctggagcgttatggtgtaataattcttgatgaggctcatgagaggacactggctacagatattctaatgggtgttctgaaggaagttgtaagacagagatcagatttaaaggtgaagtaatttcttctctccatttaactatatatgtgtgtatgtgggcataaaaatggggaatacatactgatcaataaccaactgtaagaaatcacctgtaaaagaaggaactagtaagtaccttcttgttttgtttctgctttgctgtgctttcattttagactttatttctccccctttatagtaatgcatttttaagcccaatcttctcaatttgtaacccacctagttcttttataatctaataacatatatgtgtaactgtgctactcactgtacccttcattaagtacagaggcttattttacttaaggatcaaatctttctccctcagatccatgtccttgtctcatcacaa

SEQ ID NO: 110900 - DNA, 1048 bp, Homo sapiens
taaagttccttttggcacaataattgaattacaattggggatgtaaacttaaaccttgacgtgacttgtcaccggaatgaatcaattcaagtattcttttagggctggaggtaaaggtgaaacagatgtggcactttaaggaccattaattatacaaacaattataaactaatttattgaacatctgttatgtggcagtcttggttctagttcatgtgtagcacataagttaggtaagggtaattttattggactcttaaaaagaggtgggaataaaggataaatgtggttatttaacactgaggcagtttctgccagaggactaaaaagttactgtggtcaccctagaagtagaattctattggcttttgctaattcctagaaagctaacttggtttgctgaggctctacatgttttgttaaatttgacctttgtacttaagtatttgtgaggattagatagagaaggctctctttgtttatacagtgccaatatcttaaaaaatattaagtagaacctacaccctacacattcattctagctttctgtgagttctgttgaggatgaaagaatattccctttaaaacttgtgaaaatttgaggaataggcaatatatttttagttgtctttattttctattgttaacttaggcattttttcgtgattaggtatctaactctgaaatacataccaaatgtattttagctgtttacactaacaaagctgtatggtttgattgtggtcttaaacatttcagctctctttaagagtccagggtttgatgtttcctttttgccctgtttgatgtattgaacattgaaacactgtagattctaaattattcaaaatatgttccctttccttgtgagcatttacatctagtagtttgttgtcattgtaaccagtattttgctatatgtagtgctattgtgattacagtaagttagtgttgctcatgttgtgtaatatggttgctaagaacataccaggttgaactagagcctgtctttgtttattccttcaccaataaaagaaacattatgtaa

SEQ ID NO: 110901 - DNA, 2128 bp, Homo sapiens
caggtaatgtcaaggacttgaggataataagggggagattttactcatctttaggaggaatatcattattctgacttgattcacattgcattgaatttttttggtaagccacagttgagaacagaatttggaaattgggatacaagaaagttatgcaatattggtgctgtgtgtatgtgtagtaggaagtgggtggaggataggctttcaaaagatgagtacctctgaaagattttggttcacttcatagggaatgacaagtaacagattttatagttcaaatgaagtatttttggcattgtgatttttttaatggagcattttctagaggttataactacttgtaaaagcttacttaagacagggtaagcttattggggtttcttctaggagctaacctggtgttgcctttaagtaatataagtaaaggagtgtattattacaataagttagcttaaaatttaaaaatttcaaatgtaactttgctatttgataggaagaacttaactaatgggaatgcttcattaaatgtagctcttatcatatatagatataaaatgcttatatatccattgtgtagccagggcgaactttaattttcactctagggtggtaaagaggctaacttaggcagattatgtttgaggagcacagaatttaaccatagtttgagagcattttagctaaataaagtatctttaaattgtccgcatatagattaagggtctataagatagtttcttcagtgtttgggatacctattcataaattttaggttatagatctgacactgtgctcttttcggaagattggatctggtataacttagtgcacactctgttagtctagccttaaatggctaccccatcccagtgaacaagtaagtttacaaagctgccactcctaaatggtttttatatttccttttttatgtgtttgcttgtccccatccttttcttctgaagcattctttttgcaacatacttactttcctgttttcttggagtggaaattatgaagaaaaaacccaaagagatacctaaagagcttaccagtcagggaacaatatattgctgtatttgtgactagtcagtgtaaaataccttgattcattttgatgtaaggaaggagaggttgttggcttctggtgtagcccttttgcagtggattttaagaagcatttgtctgtggttgtaactttttttttttttttttggagacggagtcttgctctgtcgcccaggctggagtgcagtggcacgatctcggctcactgcagcctccacctcgcgggttcaagccattctcctgcctcagcctcccaagtagctgagattacaggcccccgccaccacgcccagctaatttttgtatttttagtagagacggggtttcaccacattggccaggctggtctcaaactcctgaccttgtgatccgcccgcctctgcctcccaaagtgctgggattacaggcagccgccaccacgcccagcctggttgtaacatattttaattcaggaaatcaccttcagttttttgaaggagctgataattttttagggaagaaaacaatttgataatcttgtaagcgtagaaaaacgtaataattgaagttgttaatttggtaggtaattttactgttattttaggtgatatgcttcctttttattttttcgtaagctgtaaaattagagatttttgtgttgaaggaatctaataatttgtacacataatgattagtcattcagtcagctaatagttaagtaccttctatgtgttgggcagtactaggtataatgaaaagtgaatctagtccctgttcttgttaaagcaaataaaaatgtaaataaaaagtttgacattgtgattaaccttctgaagtagaatatgggtgtttatatgaaagaatgatttgagaataagtttaggtgggaagatgttggatttatttatttatttttgagatagagtctcatctcatctgtcactcaggctggagtgcagtggtgccatctcggctcactgcaacctccacccgccgggttcaagcgattctcatgcctcaccctcccgagtagctgagattacaggcgtgtgccaccatgcccagctactttttgtatttt

SEQ ID NO: 110902 - DNA, 2648 bp, Homo sapiens
agaatcgcttgaaccttggtggttacagtgagccaagattatgccactgcactccagcctggtcaacagagtgagattccatctcaaaaaacaaacaaaaaaacaaaagatctgaacattcttgccttgagaattttgaattaattttaaatatctttggttcaccagtgagtgaatttcactttctagatctttgaaagtacattttgcctttgtaaaagggttgccgaattgaggatatatcagtaagtaaggctttatagcctgactagaaaaccacttaaacctaggtctgtggatttacagaacccgatagatactacttctttagttatttttgttcatttaaagtgttttaaagatatatatgattttagagaatcagcataattaccctccctttcagatatttgttagtgacaagttacccccaattgcagaagcaacctaactaaaatgtaataatagtgcagccaccaatattccttatcagttttactgtactgatactgtgcagaaaactccatgtttcctgtagcattagagtttgataggcgtttggaagctttgatgtaaaccagttatgctcttctagcagtggatttccatataatatggtgagcacttacatttttcccatggttcttttccagttaagtgactggaaaactgtaaaattggggaatccattagcttatattgataatggaactgggggaaaatgtactgccgtcatggcaaccaatttaacttgtgcttgggggtcccccaaccctttggctgcccttaacgaagtggtgctgctctaggtcctgttaaatttgagactggcagttcttaaaattgattttaagatggtacctaaggtgctaccattgtgcatactgctcctgagggggaaaggataggattacaaaagagttgggtgctaagagttaggttctgctggcttataaaccaaatttgaattgaattaaataaaagtacagcttcagagttacaagggggtatgatttccacttgattttgcaactcaaattatgtaagaatttaaaagttacactttcttagaaacgtttgttataaagtagaatttgttgtaagttggattttttaaaattgcatagagaaatacttcatgatgggatagtcacactgtcgagtgtattcctgattgtgtctacccaacttgggtgtgtgtcatatcagtattacacataactgttccttggtttagagagcttgtgttgttacaagttttgaatcacaagtcttatagtcatttgcctaattggatttggttttaaatcattagaatgagataaagtgctttatgttacatatacttgatatgcaggcagaatagaattaatttaaatgtgaaattatttgatagattccacagtggtgtgtggagtacatgcgatcattaccaggacccaagagaggagttgcctgtacccaacccaggagagtggctgcaatgagtgtggctcagagagttgctgatgagatggatgtgatgttgggccaggaagttggttactccattcgatttgaagactgcagtagtgcaaaaaccattcttaagtaagtactatatctttaatgacgcttttagtcctctgcttgccattttctgctattagatagaagactttgctagtgcaggcttatgtcatccaaatttagaattatccaaagtaggccttcttagacttaccacatgaccttagtttaattatatattattggtaatctatagttacttggtagaaattgaagttcaaaggtcagattttagttacttggttctgcattttaggtgaaatgttactgatactgtaaaatgtgtggttttagtagacacaatggtgtatgacttaattgtgaaagaaaaggaaagtgatatgtcttacttagtaaaagataactacttttagaaagaagaatgtataggatgggatgtgatttatttaggggagaggggacttttaatgttaattatgcagctattaccgtgcatctgttataagctaaaaagaggaatcttttgttctgtaatacactgttagagctgcctctaggtccttgttcctctatagctatggtgcagataattgactactgtattgagctttctaatgttttaactctaccaactttttattgtcttatacttgcattctgcataagttatgatgtatgctacctgatgatgattctttctcaagtcttccctctggttgcttctgcttattctgtatttatgtgatatttaagtccttttaaatgtgacttgtttgagtggggctcagtggcatatgcctgtttattcccagccacttcgtaggctgaagcaggattattgcttgaggccaggagttcaaggctacagtgtgctctgatcatgcctgtgatagctactgcatttgaacctgagcaacatagcaagaccacatttcttttaaaaaaaaagaaaaatcatatctatgtgatcttctccctgaggtttttaaaaaccattttggagcgttgtgtaggcagtgatatgagtctttgttgtcagagtctttgttgtcagagagatatatagtgttaatgggataaatgaaacaagagtctctctttttttttttttttttttt

SEQ ID NO: 110903 - DNA, 1980 bp, Homo sapiens
ttactcaatttggacctatcctttcttcatcctaccctcagtatctgatttctgttgtctaagtaggaggggttttacttgcagcagactgagttcttgtgttacctcacctaatgttaaaagttaaggaaggtggggcatcagcaaggaagggaaagatgtttgtggtggagaatgggaaacccttgattgtagggtattttttattatttctgatagttacataatccattggactttttattcatttgaacgttggacatttactctctttgtgattataacgctaccgtgaacattctgcataaaattcagaatctgaattctaaatttttgtttttaggaaggatcgagatcgagaccgggatcgtgaagatcggtctaaagatcgagaccgagaacgtgatagaggagatagagagcgagagagggagaaagaaaaggagaaggagttgcgagcttcaacaaatgctatgcttatcagtgctggattaccacctttgaaagcttcccattcagctcactcaacccactcagcacattcaacgcattcaacacattctgctcattcaacgcatgccggacatgcaggtcacacgtcacttccacagtgcattaatccgttcaccaacttaccccatactcctcgatactatgatattctaaagaaacgtcttcagctccctgtttgggaatacaaggataggtttacagatattctggttagacatcagtcctttgtactggttggtgagactgggtctggtaaaacaacacaggtgagttattgtataccatggtacatatttcatttatgtttaagtttaccaaatgttgcatatttgattctggtggtcatttcccttgtctgtcctatagaacatcttgaagaatagctgatttgatgtttaattggcactctgaatttcagagtggaaatcctatagagaatacctctcccctgaatctaggggaaaatagtggtgctcgcttttcaaattttgttaccttatgtatggcagaggtattttgactcccggacagtacagatttagggacccacagtttgttttctggtacttgggtggagaaatcactggggtagatttttgtcgtttgtatttaatatggtattttgaaccatgcaaaaaatgaaatgccaaagtaatataaagtctataccggtgacttttgtccatctagtcgtcctccctcccatagaactaaacactgttactagtgtgttatttgtaatatagctaggatattttttaaacatggatgggctattattaactagacccctgttgatagacatttagactgtttcccatggttgttttgcatgggtcaagtgtttctgtaggaagcagaaattgctgggtcagaagatcatttgtaattgtgatacagaaagctggatagccttccagagggagcgtatcaatttacctttccatgagcatgtaggagaacacgtgggaaactattaaaacgtgaatttttacaaatccaataggtgaaaaattgcattctaatgtactttttaatttgcattttcttgctgtgggtgagaagtaactgtctttatacacttaagcctgaaccatcaattaaaaatttctggtttcaaaagtagcagtccctgatcattgtagaaactttgaaaaattcaggaaagtattgaagtgaattacctgtcttaccatgcagagattgaacataccgcatacacaatttatctttttctaaagttacatgtgcatggagacattttgaaggtactgtagcaaccaaaataggaagcttttattatagactgagccttagtaccattcttcttttcttttcttttttttttttttaatttttgtgttgttgttgagacagtctttcacccatgctggagtgcagtggtatgaacacagcgtcaacctcctgagctgaagcgatcctcctgcctcagcctcccaagtagct

SEQ ID NO: 110904 - DNA, 1623 bp, Homo sapiens
tagatactagcaaacttccgctctctgcctacgctcccgccatctcctgtatttcctgctttggttaaaactggttactgaacatcgtcccatggggagggattagaaggcattgtttttttttttcatcatttattttctatgcatgtcccacttttcttcataagtagcttttgaaatacagggatcatgttcaaaacgtgtttttagtatttatggcgaaacaccgcccatgtggaggttgagagttgaaatacttacacaaactcttggtgttccagattcctttccttaaaggtacagaggaatttagcagttaatttaagcaatttcgtgaaaatcatttcttgtcccttgtgtgttttcattgatgaagtacaaagacctgtttggataattcaggcaaaacccacaaaagcccgagtagccaaatactttgcataattgtatcattttattgtgtacttgtgatacagaatcactgtgtcaagtcacctgtatagctgttttgaatttttcagctaaagttcttcattgaaattgatttccagggatatgtttagtgtcattgtagagtataagccaggatagggtgtactttttgaggctttgccatatgttgaattattcaatagaaagcaaaagcatgtcacattttaattttgtgagttatttagtttacgatattaggcattgtaaaaaagacaatgacattgtaagacagactctctttaggctatcaccctcccccaccattacgccccacaaaacgttaatacctctgagctgtatgtcacagactcagagctggaagcaacttaaaaaagactatacgcggctccaatcaaggaatgagaagtggagaacagagttaaggtggcttgtgcaagtttacagcaggatctggaaccctgcctttgtcattttcactcagcagcacacagttcagtactgtagttaagagtcattacagcctattttaatgacatttataatgcgttggtaaagtagggaacacttagttcttgatttctctaaggcaaaaataaattgctgtcatctggaactgatgtctctcacaggaggtcagattggaacaaaatattctgggagggaatgaatgaattcatttgtatttgtgcatatgtgcaccatttaaaatgttccccttgggattagtggtcccaccatatgtatgtgcgattgtttactttctcttgcaaaaacagatatccttagtaaaaaggttgacttttggagtctaatggtagctttatgattcccttgtatattatttagaatttgcctatggataaaggagagttcatctttggaataatgcccaagttataagaaatagtagagggaagtttttatactcatttctatgtcatttgagtgccatttatccttgaactggttttatttaacagtggacttaaggtgtttatcggcctcagaattttttcatactcgataattttaagtcacttgttgactgccatgcaatcctgcagattttttttttccctgataagcaagtggttttattggagagcataagcttgtcagtcttacaaactccactgccagatagggtttctgcagtactgagaagggaag

SEQ ID NO: 110905 - DNA, 1051 bp, Homo sapiens
ggtaatagaaatgaataggatttcctaactaggactagactttctcaatttcttgactcagaggggcaaggatagcctgaaatggaaagtgaaggccttcaggttcttcctaacagccgctccgaggaggggaaagctacaggaagagggaggagacccaagaaaggtcggaccaatgaggcagcgggcgggacaggagttcccgcctttgggcgtcgtgcgcgcgcacctcgctcacacgcacactcgcacgcacgcacgctgcggaagcgcgcgcgcgcgcaggcccagccctcgtcgccgccgccattttagctgttggttccggccgcaccgtgtgggctgtagtagcgggaggggtgggggtcctccagagttaagtggctgtcctcgactgtgcccatacagcagccagctttcttccttaataactgcccgttcgaagagtgcgaggatgtccaagcggcaccggttggacctaggggaggattacccctctggcaagaagcgtgcggggaccgatgggtaagccaggccgggggcgcgaggcggcagctcgggctttgttggggtcctggcagggagcgggccggggctggcctggccgagcgggtcctggagcccgagcctttgtttctctctgggctgggttcactagcggcgggtaggagaagcgcggcgcccgttcggcccggcaagggcgcggggggttgcgtgcgacggggccgctgcccagcccagtccggagggtggagaggcctgcagtagccatgagggcgcctcctcccccaggccgaaccgagcgggagtcatttgcgagggcgtcgggcgggagtgaaccgcggacctcgtggcctcggttcccgaggaaggcctggagccggaggagagggtgggggagggcgcggtgggagtattcgcttccaagggcagcaggcacttcccagccagaggggccgtggggagggcctgggtgggggcgcggccaggcactccagacgggaaaggcggagggcggaaagtgagagcagcgcgtggatcataatgtagg

SEQ ID NO: 110906 - DNA, 1017 bp, Homo sapiens
aattcaggttaggaaaatgctgccggacaacctgttttcttcagtaaattgcaagaaaacacataacgaaggaggtgtcaacagattaaaaaagatttaaacacctatcactaccaactgaaatttatagcctatttagatcctaagtctaaaaaataaattaaactatcctgagacaattggggaaatttaagcagtgactagatatttaatcatatcaagaaattattgctaatttttaagatataataaatgttaagaaagaaagactaaaatttttacagattgaaaaactaataatattcccctaaataaatatagcaaaattccatgtattatcctaatagttctctttttggggggtagaatgcgttggataaaattattttaaaagccacatggaaatgtaagtgcctgaataacaaagaaaatatgcagaagataaataatgagagacttgccttcaactgaaagccactgtaataaaaatcactggaatacaatcaacgtggtattggcataagagtagacaaatcagtggaacagaagagtggatccaaaaatagatctcagtatatatcataatttaatatgtgacaaaggtagtatttcaattctgtgggaaagaatggcttacttaataagtattgctggcataactgcctattcttctggagcaaaatgaacttgtatctcaatttcacaacaaatccaaaaataaattccaaatggattaaaaacataaatgtaaacaataagtttaaaaaaaatatttaggtgactacatgcaaatctaggggacagagaacatcttttaaactaaaaccagaaacctggaaagtataaaaggtagacatatttgattacataaaaatttcaaacctttatatggtgaaaggtacccaaacaaagtcaagagtcaaaatgcatttagaaaaatatgtacaatgtagataacagatattgggttaatatttcttatatataacaaattcttgcaaattgataagaaaaaga

SEQ ID NO: 110907 - DNA, 1031 bp, Homo sapiens
tttttgaagtgagattttatgaagtcaaaggggactttacacagatctcgacctgctttgaaacctagaggtggccctttgatttgtgcgtgtccttgccctctggacaacttaatatttcaagtaatcgaataccaacttccctgccagcccacctgccttccgccccgcttgtgtaacagtcctgttttgttgagttgctgctattgcactgccagtgcagcccacaccaaatcacaacccaagatactcagataggaagactccttcctctcccagtactttaccaaaggaacccccgccaggacccacatggggccacgtgttggcagtggaatcagcctgtgcaggctggggatctcaggctgatcagtaggggccagctttggagccagccaagctgaatcccacactccaggtctgtgctcaagagaccagatggtgtatttccaaatgggcctctctggtatgggcaataggcaagctcctggggtctggttatgtggaagattcttagtggatgttccgcctggttagctggttctcttcagagaatataaagtgaatgcctttaggggtagctctgaaagagaaacccaacaacttcattcctagccatgaaagtagcacgatcatattgtactgtattgttattgtaaaatgactatttgccatgtcatgagtaggtagatgttttgccacaaatatgaatgtgtttgttgtttcctgactttaagcaatgaagattgagacaataaatagcactcagagaatgaagcattgatgttacatcagcactcttgggtacattctgggactgtaggctgaggcttctagcctcagaaaccacggattttaatgaacgaactcacccacgcatagtagtgttgttacttgaaacttctgcaaaataccaagcaaacaggagaaaagtggtttgttttcatttttaagtgcaaattacttttcttctgcacttttttttccctcttggtttctttgaacaggctacaaatgcccaggtcccccca

SEQ ID NO: 110908 - DNA, 1076 bp, Homo sapiens
ccacagtttataaatggaacagcaaaggattctattcttaccagtcactgcacgagtggttcagggacacggatgcggagtttgttgatatcgatggaaaatcgcatctcatcctgtccagccgctcccaggtccccatcatcctccagtggaataaaagctctaagaagtttgtcccccatggtgacatccccaacatggaggacgtactggctgtgaagagcttccgaatgcaaaataccctctacctttcccttacccgcttcatcggggactcccgggtcatgaggtggaacagtaagcagtttgtggagatccaagctcttccatcccggggggccatgaccctgcagcccttttcttttaaagataatcactacctggccctggggagtgactatacattctctcagatataccagtgggataaagagaagcagctattcaaaaagtttaaggagatttacgtgcaggcgcctcgttcattcacagctgtctccaccgacaggagagatttcttttttgcatccagtttcaaagggaaaacaaagatttttgaacatataattgttgacttaagtttgtgaaggtgtggtgggtgaaactaagagaaatgtagcattagctctcacaaaagaggaccaagaaaaatcaacaaacaaatcaaagccaggctcagagctctgaaattaaaaagcactgaaatagttagatgttttcaaacttttagaactcacattttaatcagggattgcatttattggctaactgcatgacatgcccattctaccatttaaaaaaaaatcttaaagcctgtaatttctgagaaaagagtacagcatttactcttatcatctagaaatgtaatatgcttcccccccgctttttgatgaggaagaagacaattggataagatgggacagcacttataatgaaataaaaaaaaactttgagcccctctcattccactttagcaatctttttggtaagaactcttaaagccaaaagtctgctgaaaagatttgctgattattagtttaaaaatcttgtaacactcagcagtgctattttgagtc

SEQ ID NO: 110909 - DNA, 1027 bp, Homo sapiens
tgatagatacaagaaacaggagatattaattataaaagtttttaaactccatttttagggggttttaaatatatcaggatgttaataattctggagtttcgtgttactaccaaaacatgtcagacacatctatttctctttgtatgtgtttgtgttttattttgatttttagagatttgaggggtaataaatttgaatgtgactgcaaagccaagtggctatacctgtggttgaagatgacaaattccaccgtttctgatgtgctgtgtattggtccaccagagtatcaggaaaagaagctaaatgacgtgaccagctttgactatgaatgcacaactacaggtattcagagcctatctcatcagacacggatatttagaataatctctttgtctttcttttacactgtcaacagagactggggaaaagtgaatatagaactgtttatcaaaattgttttagagaaattttaaacattctaaagaaatgaatcgatgtggtaaggaaaatatctcaaaagtttgggagaatttttgttaactgccctggctttatttttgcttctttacgaaattcaaatttctgtaagtgtttcattttcttaagtcaaagtataaacttgtgggtttggcaggagaacattttcaaatcaatctaggtttcatagaaggccactgcagggaggcttagattactcggttgagactgttcttttgctttaggaagatgttcattggacatttaactaacaaacatcagaattttttttttttttttttttttttttttgaggcagagtcttactctgtcgcccaggctggagtgtagtggcgtgatctcaactcactgcaatctccacctcctgggttcaagcgattctcctgcctcagcctcctgagcagctgacattacaggtgtgcaccaccacacccggctaatttttgtatttttagtagagacggggtttcaccatgttggccaggatggtctcgatctcctgatctcatcatccgcccaccttggcctc

SEQ ID NO: 110910 - DNA, 1098 bp, Homo sapiens
caggactgcaatgctaaatctgactaaggtctatcaaagcacatacatagccaatggaggtagcagttgtaaagctatgagttttctcttacgatagttcatcttatggtcaaggttattggagaggaagttagctcatcagtttatgctgaagtctattactgaaaagacatctcagttttaaaaaccatcagtgagttctcagtgcaagaatcaagaactaattcgttgatgatgttgtgtttcaaagccccaaccatggagcatctcatcaaagaccctcttatatttgacttaatataatgctgtaactaaaatttagttctccctgagcctagagaatagtcgtagtgaattcacatcaattatttcccacaaagaccttaaagcatggccagtggtattattgcaagatcccatgtgccaaccctgtggggttttagtacagagaaagaagtttggttcctactcaacttcattatacttcctacttcctagtagcttagagagcttgagcttttcctgccttgtcacccatttgcttggtgactagatggtgtaggacacgataaactcaaggttgctgaaaaccaagcttgatagaactctcccccagcaaaaaactttaatgtggagatgtaaaacaagagaaccctctcaagggacagtgacattaacagaagtatgaatagccaggcaccgtgaaatgtgggattgagtagggaaaatgtctggaagtgctccagtcttgcagagatatgagaatttcttgcctttgtatagtgctttcttctttatttctccccaggatgtttttacccatgttgccagctcagaattctttggagacttccatgccacttctggaaggagtgcagaccacacactcccgtgcacgcatttttgcatacatcctgctaccacatggaatttggtgtagctgacctagtcttcagagatcaattcttataattcaggaatacttttagattttattctgaaagcttaccaacatagtttttttgggatactaaggagagaaaattcattttaattatacaacttttcctcttaggttcattgaagggaacaaaatag

SEQ ID NO: 110911 - DNA, 1038 bp, Homo sapiens
catgacctgaaagtcacctaaatgcactgtttcccaaacacctcagtttaaaagaaaacttcattttaaaatcttaatgttactctggaaataggagtgtttctagtttgctgagaacttaaaccagtcaggcagcatcctatgaacttacgtgcgtaattttatttcatcatcacttcatcggtatgatgaaggcatgcttatgatcccatttgatagataaggaaactgaggttcagggaacttaactaacttgtcccaaatcagagccagattctagtccagggccaaaagcccacactcctaactattcctcatcccatctcctctctgtgagcaatgctcaagtccctgtggtgatgctcatgttgtgccctgtaacccaggctgggtaatgtgtgctgatgaaaacaaatgtccaaaaagtagttttcaaaagcaatccagtgacaggcaaagtaagagtacacacctcattctcttgatctgtgttggtttcttaaatttgagatgagactgaaattaaaacaagcaatgtgctatagaaaaatttggataaatggaatataggagagcactattcatcctcaataaacatactcttgatacttttgttcttgaaatcttatatgcctacttttaacattacacttaacattttaaaatctgaggcctcttagaaattgcagtgctattaaaatatacttttcatataatagaaatacaattttaggtattcttttgccagtagacttgggtgatgactcaaatagaaaactacgtagtaacagtctcctgaaagtttcttaaacaaacttttttttttttttttttaactattgttatgggtccagctgcatgactttggtcaagtcacttagcttctctgggcttttattttcgtaaaaatagatttggattagatctttttagatctctaattttatgattgcttgtgtaccataaagcattcactggctgtttagtcgtgctgagcattataatgttttaaagtcacagctatcagatcatatttac

SEQ ID NO: 110912 - DNA, 1067 bp, Homo sapiens
cccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtcactgacagtacgttattttacctaatcattacgatagataaaatctgaaagtacaaataactgaactaaattacttgcccatttttgattcagtcatcagtatcagcttgtctagaaatcagcaagaaaagtcataccttaatgagaagcatgagtcatggctgggggctaaattaaaacaaaaaaaaaaggaaagagacgatattccagcaatcattttgcaaaggatctattgactgtagaaagtacttagaagcatttaatcttttctaaaagaaatactatcttttatttgaaaataggttaatatcactttctcctttagatttcacatctaaattgtgctatttgaagtttgcaggtagtggtctttgatttggaatttgatctctgcactggtgcttattaaccatgtgaggccacata

SEQ ID NO: 110913 - DNA, 1047 bp, Homo sapiens
taaaatcaaaagagattcctagagcttataggtctttaatagaagttaagtaaacgataatcacgaggcaggacttttttatgtaaaaaagcagtgtattatagaatttcattttaaagtcgatacagtctatttttgtaggccatgatttgtggctgttttaaacttcgtaataagtggatgtaaggctttgtaacacatatcttttgtttatgggtgacattgtgttaccattaccagacatattaaattggtaaatctttcttctttcagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtata

SEQ ID NO: 110914 - DNA, 1161 bp, Homo sapiens
actagaatgattggaaaggaggctaatgtgactggtgtgtagtgactaggggaaatgatagtcactaggttgagtatattggctgggtcacattatgtggggccttagagatgaagagtgtggttttctaatagttactggaggaagtcatcaggggagaagcatgaactggtatgcttttgaaagacctctctagtctctgagtgtagaacagattacagaagggtggagaacaggcagaaaaatcatttaggatctattgctgtgtccagggaagaggttgatggctacgaggaccagagtggtaggtctggaagttctgagaagaagatggatttgtgatagatatgtaatagtgaagggagaaaatgtgctggttctttgcctttactgaaatcctgtggcttctgatagttgtggcagctttgaatttcactgtattgtggcaaaggagagaattggtcttaaggcacatggatgagttaatttaaaatgtagacttcataccaatcagatttttgtcttattaaatctggcagtagatatttgatttgttttaaatgtgacattttgttgttgcaggaaatgttttcatatttgtccaaccaaataaagaagttgtcagaagcctacaatgaaagactgttgcatacacctcacaatcccatatctttaggtaatttcttttttcctaaagaaaaacaaatacttatgatccactctaggaggaagctgatacttctagaaggagagaaaactctttctagttataatgatatttataaattcatcacagtattttaatttgtaaattgaaaaagtttagttaggcttttgaaatgctctaatgtatttctaagataaagcctatacactgagagaataagaatcaatattaagtattataacaaaaatgcagaaaataatacttaaagtcctgtttctaaccataactctatttataaataattaaatctttctccaggtcgggtttggtggcccacgcctgtaatcctagcactttgggaggctgaggcaggaggtcacttaagctcaggagctcaaaaccagcctggacaacatagtgaaaccttgtctctattatttaaactaaacaaataaacaaaactttctccagttaacaaaaccccaacatatcag

SEQ ID NO: 110915 - DNA, 1006 bp, Homo sapiens
atgtcctccataaaccataattgcatatatgtagcataaatattgtttttttattggatttgttgcagaaataagggcctcttttgtttaaatggacttgcttttgaactgtgaaaatttaattgtgatagtttattggttcagctctggagaagctgaggcaaagctattttgctccagccagagctatttatataccatcactgagagctcctttttatattattggtgttattgtgtactaaaaaaaggaatgttagaagaaaacttagaatttttttcattctatgcccttattcaccacaatgatatttttagaggttatttcatctagctctatctcttcagaaaaggctttatctttttcacagtagtggcagacaagaactcagcttgaagccattccttcttaagctttcttttttgaagggtgaaaggatcagagagagtggagctctgtgtgtgaattgagcctctttgcccttatccccttcctgatcaacacatttgcttcattgaggggagaaataaccatgaatttaaccccttttaaaaaagaggtgaaaatgtaagactgtatcttttagtttgtctatgcagaaagaaagtctatggtcttagaagtttatcctcacttctgttttgcttctggagaagatcattattctgtttagctttccttttagaaaagtgctttgctgaacagggaaggcaggtaatcatttattgttgcaaatatctgctgaattggataagaagaataacagcactatggctgctcagtggctggaatttgtgagctaagaactgggggacaaactaagttttaaaagaacatcatacacttcagtgtccttatagcagagctaagtttgaaaacactactagatttgcagccctgtaagtggagtagttgaatctctgcagaagcatctgatttcaagcctacatatggggccttaacaacttgaatgcagatgggtgtagcctctgaggcaagattcgc

SEQ ID NO: 110916 - DNA, 1051 bp, Homo sapiens
taaaataagtgggattaagtgacttccctaaggtcctgtagctacaaaatagcccatctagttcagtgcgactccaaagtcccatttttctgttaaaaaacaaagtactaaaatactaatactgtaagtcttttcttgagaaaataatattgcaataatcaatcaatgaagaaaagtataaataaattttttttatttttattgttttaacattatgtttttaacttttttgtttttaagatgagaccccagaatgacttaaggctgagcatatagagtattctgtatgcacataaccccacctccaggggaagttagttttgagtaacctatatttctgtttatatttactaaaatgacgaatttaagagattcatgaattatggatgttaggatagattaatggagagggatatagtagagtcacaaaaatatgcatataagactgattattttgagtcacaatggattgtaaagttccaaaagtgtgggaagcagcaactttgcctgttcagaatttgagagaagtaggtattactactgtttattcacaaacccaattgtcacttcattcaacaaatactttctgggttcctgcttgtgtaccaggcaccagggtaggaactggagatgcaatagtgaatccaacaaaatctttaaccctcatagagcattctattttttgtgcgaaagcagagagtaaaccttgagtatgacaagtcttggataaatgctctggtatttggggaggatggatatcattagatggagtgatctaggaagcactcttcaagaagtacatgtgagtggagctctgaatgatgcaggaggaagctttgcagctctctagagagagagattccagtcagaagctaacagccaagactctgaggcaggagcgtgcttggaatatgtgagaaatagcaaggaggccagtatggctgaaccataatgaacaaggtgaacagtggttgtagagctttgaggtgtgttaagggtttgggattttgtttttggtatgatcattggccatggaaggatttcaagcagg

SEQ ID NO: 110917 - DNA, 1066 bp, Homo sapiens
atagataaatgaaaaataaactaactctcttccctattgcttttttaaaagaaaaaattgtaaaatatatgtaacaaaatttaatgtttgtattactttatgcaacttttaagtttatggatacctaaatatctatggttccataattattatttgttgggggacctttgcgtatatactagttaagtgtactgttttaattgaaaatgtgaaaacaatttttatgcaaaatttacagtatacattttgttttcataggaggcttttgtaggctatgagatggatcagtgatccttaggctactgaaatttattatgtttttctttagaggtaaaacattaagtagatgattgtgatttgtttcactgagtgaattgtattattatttatgtccatctctgaaataaaatgaactttaaaataaaacagaaatatcaccagagaatgagtggacttatttttctgtggattgaaactgaactggattaaagtgatcctttttgtcatcagtgtctatgttattacttctatagatatctatttaacatttgttttccttactttccagaattcattcttgtcatatccaagtgttaaatagacttatggtcctaaaattgtgtagtagtccctcacattattttgacctgcctttgactaataccagtactgagccgtgtatttattaccagaggaaggttaatctaccaaaataaatattaagagttcttgtgtagaatagcatgcttcctagagtttcaggatcttcccttattttagttcacactaacattttgttttctggttggtttggttaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggtaaatgatttgtgaatattgtcctttagctgtttatcagtcttttaaataaaatatactaattctcaaatatgcttaaataacacttcacaat

SEQ ID NO: 110918 - DNA, 1089 bp, Homo sapiens
tagctttttggattaactgggctcagcagggtgagtattgctttgggtctgtcatgtagttgcagtcagatactggctgagagtttagtcatctgaaggtttgcctagcatgaaaatttcacacagttacttctgctagattcttcctggccaagcaagttactaaattcagcccagattcaagtggagaggaagtagactccatctcttggtgtgggagtagcatgtgggcatagggagaaaaagaattgatggtggccgtctttggaaactagctatcacagcataattgatgaaattatttcaatttaagtaggagagttccacatcattaatagtttgtgacatatatctgtaacagccaaatattgctcctggtgtttttttggttattacatttgcatatttgtacattgtattactcggaatgctgaatgtatttgtccagtttttggcccattttttgcttaggttcattcatggcattggacgatccggtgatatttctgctgtgcaaccaaaagctgcaggctctagccttttgaacaaaattaccaattctttggtcctggacattataaagctggctggtatgtaccgtcttaatcataatgcttttggctgtctggacacacacacacaccactgactcatttcatttattattgcccctttccaaaaagagtatgagtggcttttgaaaagacttcttttttttttttttttttttttttttttgagacggagtctagctctgttgcccaggctggaatgcagtggcgcgatctcggctcactgcaagctccgtctcccgggttcacgccattctcctgcctcagcctcccgagcagctgggactacaggtgcccaccgccacgcctggctaatttttttttgtatttttagtagagacgggggtctcaccgtgttagccaggatggtctcgatctcctgacctcgtgatccgcccgccttggcctcccaaaatgctgggattacaggcatgagccaccgcgcccggccgaaaagactttttttttttaaataaaaagtctttagaataagatagaaaatcagagccataagccc

SEQ ID NO: 110919 - DNA, 1043 bp, Homo sapiens
ttttccgttttgccatgggtccacaagtgttataaaataattgtgtctgtggttattttggaggtttttacctttaataggactttaaaatagtttctgtgaaaactgtttaaaaaatttttaaagactaaaatgttcatgattgagtaatttaatactttttaagtttagttattttttaaatgactccattaacttcatttgtcctttaccatccgatttccatgaaactacctcactagttccaagaaattcttgcctttagattaatatgaacatcatttatgatgcttaactcttacttatataagcaagaggtttatgtactttagccagtggaagaatgtcatatgtctgttatcttcaacaaggcatttaacaaagcctacaaacagcataaaccatagtgttgttggatcagtgtcaaagtggaaggattagtgcattccttgttctagttattttaatcagtgaattcggtagtaatgacagctaatgcctacatagcagttaatatgcgctaggcatagttctgtatgcttcatatatattaattcataaccaaccctgtgatgtgagtactatttttgttttttttttttgtttttggcagtgggtggctgtaggggtggcagtgggggaacagagtttcattcctgtcacccaggctggattgtaatggcgtaatctcggctaactgcaacctccactccccaggttcaagcgattctcctgcctcaccctcccaagtagctgggattacaggcacatgcctggctaattttgtatttttagtagaaacggggtttcaccatgttggtcaggctggtctcgaactcctgacctcagatgatcctcccgcctcggcttcccagagcactgagattacaaggccaccatgcctggccttgttctcattttaagaaagtatagggagaggctgggcatggtggcttacgcctgtaatcctaacactttgggaggcctctttggtgcacacctgtagtccaagctactcaggagaccgaggcaggaggattgct

SEQ ID NO: 110920 - DNA, 1023 bp, Homo sapiens
agggatgcaatcatggctcactgcagccttgtcctgctgggctcaggtgatcctcccacctcagcctcctgagtagcttgtaatacaggcatcaccaccacacctagccagcttttgtatttttagtagagatggaatttctccatgttgcccaggctggtctcaaactcctgagctcaagcagtctacctgccacagccccccagagtgttgggattacaggcatgagccactgcacccagctaacctggcatcctttctaaatttttacttgaagccttcttccttaaaatgtttattcctaagtctacagttcaatactgttactttgaccactggcaaatttaggcctctaaaaggcttttataccactctcagaaagaaatatgtgcccttcatttaacaaggctttgcaaaattccctggcttttctgttttagattctctggggcctttattacaggattaaactttgctaattttcatcattagagtgagtttcatggtgtatatgaaaagagatactataatgcaaattctaaccatttttctgaattgtatgtttctaggtggtttggcttgtcagtgagacatttaactataatgcgattgaccgtgcaaaatcaagaggcaaaaagtatgctttagaaaaagtgccaaaagtgggtagaaagtttcataggataggactccctcctaaggtaagtttctctgataagctgtatttagagggcatttgggcacatacatcctgagctctaggagccaggcattgtgctattagctgtggatattatagcacagatttttcatcttccaggagcttatagtaaacaggtaattttagtgtaatataaagctgttgagatgacggtaagttcagggagctctaagaggatagatggatgcctaacccagtttagagggatgggaggtgtttccaggaagaggttgcatgaaaggcttataaagtaatgggtaaaaccacaggtctggaatcagacctaatcccagcctctctgc

SEQ ID NO: 110921 - DNA, 1023 bp, Homo sapiens
agtcatgtgccaccacacccagccagttctgttttttcttttattaattgttgggcagctttattttttatttcatattagaatagaagaataatacctgcctagtacttttttagagtttgagaaatatatggaatccccatattttgcttttatgtaataaaggcttctgggatttttgttcaccatgtttgtattttactaattcactttcttctgagtcctttcattcagtattagataatacaatattacctaataaatggaacatgtgtgcttaacctgtgaatcttgtccactgaacttaaaaaaagtattaaatacttttgctatttataagaagctggttttaacatatataatagactgcatagagcctcaacactgatatgagagttatagattttagagtaattgctatcgactttgagtaccaagttgaagttttagatatttacataagattttttttataaaatacttttacaagtttaaaacagtttgtacatttgggaaagttttaagtgattaaaaatatttcttcaatatttataatttatgttctcaagtaatgacttaaagctgttgcatcatttttaaaagtttgtgcttttaaatgtttatcaaggatatttaaaaatacatattcgtagcacttagcaataaaaaggaacaaacgatacaatagcgtggatgaaacttaaaattatgctgagtgaaagaagctacacataaagggaacatattgtatatttatatttaaaaattagaaaatgcaaactagtttctagtgacagaaaacagaccagtagctggactgcagagggacacaaggaaactttggcgtggaagtttcacatatgtcaaggctcatcacattgtacttgttaatataggaagttaattgtgtataaattataccttaataaagttgtaaataggaaagaatagtagaaataataataaatggcagttgtagcagaaatgggcttaaaatacaaacataaatgctcatatgtataa

SEQ ID NO: 110922 - DNA, 1057 bp, Homo sapiens
ggtcctaggtcatacgttcttcaaaattattatgattgtactattgtacttgaaattacagatgttattataattacagtcaaatgtagactatcaggccaaattaaaggggagcatggcagataaccataaagtcatttatatttgattttgaaatgtatttttgtactttattttgaatatcatccatatgtctgacattattggaatttgtaacattgttaatgcactaagtgatttaaattcaattgatgaagatgtgattttacagaagcagaagtttcattttcttgaggcttaaaaccaatgtcaccacttgggcttaactgggtaatttgtggtctaggccttttgttttctaagcttactatcttgtgtttgtttatttgcttttaatgaagtattttgtgtagaaggttaaattaggatgcaaaacagatctgccattcctttttcccttatatcttccttttggtcttcatggacgagatgaatgaggattctgctgccctgagggagttcattggaaacctgcgttctcctacctcttccaaccctccattagctcaattttgagataatggaaaattgactggaaattcaaaactcaaactactatctttagatataaacactagtaattaaaatgtgccttttgaagatgttttctaagagaaaggaaatacgttgcagtgatgtgggtactgctttcataaaacagttttttcagtattttgagaattgccatattaatttttataatggaaaacttaataaattgctactgttttatatcataaaattaaaataccatggtaatatttgcaaaaggtctggccataccagaaaagtacagttgagatagttaagatataaccacaagtcagagtacattggttgtattttgtaaactttcatgaactgaattcttatttaaatagtatggttttttttcaataagtatatttatagtgacaaatgtggtagactaaaggtaataaaaatcattgtcttaagattatgttcttctgtatgtacgtgtttggaatatttagaa

SEQ ID NO: 110923 - DNA, 2097 bp, Homo sapiens
gtgactccatctcaaaaaaaaaaaaaaaaaaaagatatgactcttcccaaactataaggattgtttagtgcattatttattttaacttgcttagttttagacatttctgactctccatgttcctcaatcatattatttatttttcttttgttttcttactgatatcatagctggcatcacatgtacaaaaccagcagtttttaaacatactgaccatgattattttctctctccaataatctctaataaaattaaaaaagaaagaaaaaagaaatggtgactttgaaattggatataagggtgacttggaagaaatcaaatgggatattcagtgtagtcttttttaaggctttgaatattgtcttgttgttttggaggtgagcttataactccatcagtactgctaagaacagaggagctttgagaaacatcttttcttttaggaggtaatttttcttgctaagtatgtcataagaacttgaagaatgatcttaatttctcattttaaaatgactgtcaagtgagccagactgtttaacagataaaagttagacatgtggatttgtcaataaatttaaacttgatagtagttgtcattactactaagttgtttgagtaatatattatgttcacattttaaatggatattgatcttcattcagtgactaaattggagtgtctcaattcttatgaaattgctgatccttttcctctttgtaggtatgcagccagacataaattctagccaacattccacagatttcttcctacttttcttctttacgcagtactctttaggaagtaaaaatactttttggatgctaaaaatagcaaaacacattgtgtttacaacaataaacttaaaatatatttctttgtgttttattttgtcttgaaggtacttgaagtttattgagttgcccttgactcagagaaagttttgtcaaacatgtcagcagttgttgttaccagatgactgggggcaacatagtgagcatcaggttctgggtaatgtgtccattacccagttaagaaggcccagtcaactcctttatccactggaaaacaagaagacaaatgcccagtatctgtttgctgatcggagctgtcagttcttggtagacttactttctgccctcggattcagaagagtactgtgtgttggaacaccaaggtatgtcatgtgattttttaaagaattatcttctcaccactattgaaactgtatgaagattttattaagtagttacttactctgtgcaaggtatagcatgaagctttgagtatttaaaatgtaaagcacagtccctctcttaaggagtttgcaacctgtattccatttgagaaaaatcttcatagatttctttctgatgcatgagagaagattctttctgatttaactgctaaattgtttataattttagacctctctgtttcagataagttctgctcttaaaaaatatttgcaaaattgaaaccttgattatacctgccaaattctcttcagtgtttcattgaaatatcataaataccagaagaacattgatggttttgttgtttgtttgtttattgtctatgacatttgtaatatcttattacatttgctttcactaattgctttaggttgcatgagctgatcaagttgacagcatcaggtgacaagaagtctaacattaaaagccttttattggatattgattttcggtaggtttacaaaatacagtatttcctttcattgtctcctgtttctttttaatgtttttctgtttttaattgtttatactctgttacaactctttagtttacatctagaagtagtaatttgttatgaggaaactttttagtcgaataaattcaacatgtaatctgtatttcaaacagggaggcagttgatttctccttttgctggtgggcttcctagattttctctgtgaatgtggctagttcgtctttggcttataatctacagatgaatctctattgagtgaggtttcttctcatatattatgttcaaagataattctaaactgcctcatacttaatcagacttccaggattttgtttcattagatctttgaagtgtgagaactcagacat

SEQ ID NO: 110924 - DNA, 1189 bp, Homo sapiens
tttcagatgaatcaaaactggtttctaggttatttatatttttagaataaggcactcaggatttttttctttggagacctggaaatccaatcacgtaaaagagaatttattgatttacattactgaggtctgggatatagcaggctttagtctagttgagatagtgagcctcacacaatgttgctagggctccctctttctctctccacctctcattctgtctttctctgtgtattgatttcattctgcagacagcttccttcctactgccagggacgttggtggcagcagctttaagtttatctagttttcagcttaactgcccagtggaaagaggcagtttttcctgagaactccagcagcaaaactccagagagtgttctgattagcctggctggggtcacttgcctattccagagccatcactgtggcctggcagatggggtactccagccagcctctgaccaatcacacagagttggttctccacaggaaacaggtgttcgacttaaagagtagggatgtaggtgctggagagacaaaaaaccagatgtccataactaaactattcaagacaatgtatacagttgccagcagcactcatgttcctaactttggcacttttacttcagtgaaaatggtacaatgtgatctttctaatagtatggttttgaatttacattaaaagttatataatgattctaagttattaaagacaagctttttcaagctatttttagtggacttacttacaaacagagactaggtgataccatagtgcgtcttctcaaagaacttgttaaaattgcaagaatccttggtttactttgtttttaaaaaaggaaaaatgatctttaattctgccatccaaaacattatgggttttggctttttaaaccttttttatgcatataaacattttaaaaagtagatatataaccttgaaaacttttcctgctggtgatattttaggtatatttctttttgagacaacatcttgctctgtcacctaagctggaatgcaatggtgtgatctcagctcactgcagcctcaacctcctgggttcaagcgatcctcctacctcagtctctcccaagtagctgggaccacaggcgtgtgccaccacacccagttaatttttgtatttcttgtagagacggggtttcaccttgttgcccaagatagtct

SEQ ID NO: 110925 - DNA, 1871 bp, Homo sapiens
accacgcctggctaatttttgtattttttgtagaggcaggattttgccatgttgcccaggttggtctcaaactcgttagctcaagcaatctgcctgcctcagcctcccaaagtgctagaattacaggtgtgagccactgtgcccggcctgtattaaatacttaaaaaaaaatcagctacagaagaaaataaatgaacagctgtcaagcagaaatgttgatttagtattctccttaaaattattaaccatgagggatgtatcttaattgccaacccattgcaagcttaaattgcataatcatctgtcagtaacctgattgtttatgtataacctcctggtacataggaacatgtgtgttttatatatgagtattctttggttttactactggttaattaaacatgggaaaatcacttaagtttgttatttattcactgttacagattccctgaaatttttgcaaattattctttatttcaaaaaactaaaaaatgaaattttttaaaggtgtgattttattgttttaaaatttagtttatatttgtctactctatagctgtgactgggcaaataactctgtaattattttacaggtattcacagttttatatggaagatagcttttgccattataatatgtttaaccatcatttctttgatggaaaggtaagagctgtgaccattatctcattgttctcttattgtggaataacagatttcagagtgcctcctttgttctttttctaaattccctcaaggtcaaattgtggctgttctaccatttactgatatttatttttgttctttcactgtttattgagcacctagaggtgattttattattcccttgttaagacttctcactactttttggatgaaggcccacattcttagaaggcccgtggggctctgtgtgatctgaccccgatttccactctagcctcccctctccctgtttcccctttgctgtctgtgctcagggcacagggctttcatctggaactggtcagacgcctttccaccgcagggaaggtccatgctgttcctgctggtttctgctgtcttttgccttgataacctccactcatgttttagaactttgttccaaatcacttcttccagcctcccccgacccctactccccaaagggtcaagttttcctttgtagacttaccacactgtaattaaatgcatgtgtcagggctgggagtgtacggaaaatctctattccttcctctcactttttctgtgaacctcaaactgctctaaaaaataaaagttctttaaaaaaaaaaaggactgcagtttaaaaaagcttctttcaatttgaggttaataatgtcactgagaataaacagcatagtagagctgatacatttagtttaagctctttgtcaggcctattataaaataaaatctgtaaccaaccaagtaatcacgctggccaaaaatattgtgaaattatcaagacaccttgaagcatacccataaatatatgcatatatatcaattttgtaaaaattctgaaccatgcttactatgtattgtgctttgagatattaactaatgataggaggatgaaaaccaagcaagactttaaaagtcagcgttcaggaaatgaaaacaaatgttaaattgttggttgggattgaaaaatgagtcccctgatttagtaagtatagcactccttccatttgaatcaatttagcattgggatatatattaatatttttcagctgtgaagccattaaaacaaggtattgaaataaacagcagttataattagatgtatttcagctgtttcccaaagcgtttatgtggttgctaatcactaagaattgagaactgttgaggtgaatgtgaaggaaaat

SEQ ID NO: 110926 - DNA, 1029 bp, Homo sapiens
cctcagggatactgaggggactgtacttgaaagctacttgcaagtcagttgagtggagatactgttatatggtatctcttaataacttcacttatagcaaaaaccattaaatgtccctgttaatgtttactttgcaattactaaaaaagcttaaattaacctttgggaaaatgtgttaatagcatggtttcatggaccagatgcgctttgtcgtttgtgaactttcattttttatttacttacagtgcatgttcaaatatgtctgcctgatactcaaaaacatatgcatgtttaactgctaatttgtagctgttattaaactgaactcatggcattggacaaaccagataggaaaacaatgttttcttcgtctttgtgtgcccagtgcttagcaccatcctggcttctgtttgttaaattgaatttaacattttagatagttttcatgggtaatgagtttcttttaggacattaaatttagccttttaatttaaccatttgaaatgtgtagtcttctgatagtgatggtgtttgaatttgcaattttaaaaacctgcttatcaaagaacccaaagataaaatctcataggagcaaagagaggcttcagaatgtcactgaggaatgctgcggtggcaagatgacttggtaaagtttccagtattaagagagagactgagtctaatgcattctcctccaaataggatgaagtgcctctctctagtcctaatttagaaatgaatttttatttgttccagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaaggtgtataatttattactgcaaaataaatacatatctatatatctacttcctgtcaaatattagctgagctcagtgaatcagagcagtgatagaatatacatgtcttgagttctctttttaaa

SEQ ID NO: 110927 - DNA, 1022 bp, Homo sapiens
gtacttattatagcttagtgtaagcactatgattaggcttgcctctgattaaggcttttcagcctattggaattttagctgtaatagtgctataatgaatactagcctatactaggtgctttgtaagtaatagctgtgttccctgtctctcacaaacactaattttggtaaaactgttttgaagaatcttccatgatgcagacaaggttgattcatccctgaaaactaagataatgagttgtggcagagctgggattcacaccgaagacctactgccttctagtccagaggtcctttcactgcatcatgactacctttgtgcctcaaaagtggcactccttttctattttcaactttttaggtaacatctttgccttacctagacaatagtaatatacatataagggttacttttacatactcttagtagctatatttcgatataaaggaatatgtccactgacctttgggaatagacaggtttgaaatggcactctggtaaatattttctgtttttgtatgagatttaaatgtgttgaatcattgcaatttcttatgctagcggaagtttttctactgtagccttctattttttctttaatttactattattttttcctttttgtgatccattagatgacagtcacaaagaactacccattttctggattttcccctatttttttgaatcccgaatttgtcagttttttccaagcttccagatgctggattaccaggtagagtacatattctgttttctggcatggttggggaatggagattctacttgaatagatataagactattcattgattttagtaaaatacaatgagctgtattaaacactaatattataccatatatagctcagtccagtgttttctaaatatcagtaatccctagagtgcatgttgaaaatacagattgagtaccaaaataaacccactaaatcagaattagaggacaaagccccaagaaaaaatatctcaccaagctccttgggtgactccaagtgtgctag

SEQ ID NO: 110928 - DNA, 1010 bp, Homo sapiens
agatggctaccaaaattcttaaaatttaatctgtaataaacataaaacatgtagtgggtttgaagtaaaaaggggtataagatgtccgcatgtcaatttcaaatgagagcttatgggatatgggtattatgatagactttgctgctgtggtagaagctggttgctggagcagaagaaggtactggggactttgtgtgtgtgctgaaatccaatagaacacaatccttagggagttacagaaatgcaagtactctgtcttatttaatctttctttcctggcctgatacctggaacatagtaggcacaaaataaatgttgacatggacgtctcggtctccatttaactagtttcagtctcatgttacagaagacatttgcgtatagataaaattaaaaattggaaattgcagagattttgtgctttccctcatttctatacagtacttcatcacattaaatcagttccatgggagaaattttctatttgaaaatgcctctcatcatcattgtgagtgaaatgtcagggataatgatgggaaaatggtgtatcagctctactactagtgataggcaatttgcaaaattgtgtttgctttacagcacttccataggaggtttatttgtgtggctgaagctatgaaatatggatatatgttagaggtacattaatttactctagcagcatgcattttacataccatatgtttatagttaattagcacaacaaacccgcatttaaaaataataataatctcaattaggttatgcaaagtcaagcaatcaaccaccttcctgacacatacattcgctgactccttgggtaaccataaagaaattgttctttttttttccctctcttccatctgctatctagtatattgcatagaatattccatgtactagaaacctttctaaaatattattctccaacatttgaaaagcttcatatgaatctcttgggaagaatttttttattatgacactcataaatgctcaaaatatctttgttg

SEQ ID NO: 110929 - DNA, 1057 bp, Homo sapiens
tctgatttcagaaatactgaaatgcaaaaaaaaaaaaaatcttagaattgaggaaatagttataatcaggaataatgtacttatttattttgagacagagtcttgctttgttggacaggctggaatgcagtggtgggatctctgctcaccgcaacctctgcctcctgggttcaagtgattcttgtgcctcagcctccctggtagctgggattatgggtgtgtgccaccacacccggctaatttttatatttttgtagagactgggtttcgccatgttggccaggcgagtctcaaactcctcatctcaggtgatctgcccgcctcagcttcccaaagtgctgggattacagacgtgagccaccacacccagccaggaataatgtactttaaaactttattactgtcttagaaagttaaaaataggaaatttggtgattttacacttatattcaattaatactaattttaaggacttaatctctattcctttttcagagaataaactaattggtagcctgtaaaaatgtgtctctgggaggtagaatgtgaagcgggatgaggtcatttgttcttaatagaaatctgaacatcttaacattaagataccttctcaaaatagcaatagaagaaaatccctaaaatttgacagataacattttctaagctttttaaaaggacatttttaataaatacagctaaatttcattcttcttatattatgaaatttaatgagaaacaaagtctttttgtaggctggatttcatgttttttcctaattagtccagtacctagactagtttatcactccatatgccccattcttttcatccgatactgttctttctgcttggaatatgtccctccatgtggccactccgttctcttttgggaatcttccacgagtccctgatactgaaaccttctttggccccttggtgtttgataccacatttaaggcctttcacatattattctgtgattatttttactgattttatttccctcaaagatttaggtctcttaatgtcagcacccatttcatctgctcttgtgtatc

SEQ ID NO: 110930 - DNA, 1031 bp, Homo sapiens
cccatccttccgggtggtgggagagaagcagctcccgcaggagattattttcctggtctggtcgcccaagcgggatctcattgctttggccaacacagctggcgaggtgagtgagccggcgggagcccgcctgtgctgggtctgctcccggggggcccaagaacaccgagcccgagcctgttcattcgggccacaggcggccggagcctcagtttccccttctgcagacatggctggccacctgctaccccttccctgcctcccaggacggcagtaaactttaagtatatatgcgaaaggtgatgtctgtgctattttcggtacttttatggctaaagtaacagttttcacacagcttaacaccgtcacgcaatcctgcttccccaagtcttcttcactcattggtttattagttaaatgaactttttaaaaaagcccactatgtgctgctcatgagctagacataatggtagatgcagggaccctgccctaagtttgcttacagttttaatagcagtaggaagagttattgtcaaacttcagctgcaaatgtgcctgcatgtagctgccacacaggatatatttaagaacctggcttctcttgtccacgttttatagtacgggttggataaccaccctccactaaaaatacctctaaattggacaaggaaggcatgcattggattccagacagaacgtgcatgggtgttatcagcatttcttgttcacataaaacttcatcgagtataaaccagttgtacccaactttctgctgagagttattacctgccagccattttgtaaggaaaccttcacctgtgcatctttccgcctctggcttgagagttatctggccatgtgagagttgtatagagccaaatttggaaactaggtgataaggaaatcttagcaccctgcagactgtagtctgcaccatgttatctaccatgatccagtcgccagggtattgatgtctaatttttcagggccctccatgaaatctagctagtctccctccgctgccgggatgc

SEQ ID NO: 110931 - DNA, 1050 bp, Homo sapiens
gtttcccaccatcgtttagaaacataaaagaggaataaaaagcattccaagaacaaagcagatggaatcattgcttaccttttagacatgtgataacatataattgtttatttgttgaagcctcttttgtattttctgcttgacaacagggtttcaagtctggaaactttgatgtgtaagacgttaagtgtgctacgtgagaaagtagtagatctcctataaagtttgagcacttgaaaataagcttagttaatgtaactacaatatatgcaaatatttctttttttagtttttaaaatattgaaggatgtttaggtcaaaaattgccatgatgaagatgcacttaaaagagtaaaactgggcaataagggaaatacccatttatttttctcaattgttacactaatttattctgattgttttttcttgttttagttttggcctttgctcttgctgataccaagaaaattgttttgtgtgatgtagaaaaacctgagagcttacactctttttctgtggaggctccagtttcctgtatgcattggatggaagtgacagtagaaagcaggtaattagaaaaacttatgtagtcatagggtattcatgagatttttattttttgaaatggaaacttaggagtatctgagtattgggtgtatgtgcgttgtatttaaattttggtttcagtttatcaagatgaaattttttaatgctttcttagattttttttttccttccgataaacatctataggcatacctcagagatattgtgggcttggttccagaccactgcaataaagtgaacattgcaataaaagcaagtcatttgaatttctttgtttctcagtgcatgtaaaagttatgtttatattatgctatagtacatttaaatgtgcaatgacatcatgtctaaaaaaattaagcatgtaacttaattaaaatatactttattgctaaaaaatgctaacgatcatctgagcttttagtgagttgtgatctcactgaaggtggaggattttgccttggtgctgacagctgctgactgatc

SEQ ID NO: 110932 - DNA, 2099 bp, Homo sapiens
ctcataaataaaagatagtgctactcttagtagtcatatgtttggtgtgagttcttaaatgagagttaagaaatcataaattctcagtatctgagtacatatgaatgcatttcatatgctaagaaaagtgtttattaatatcatttctctaaatgtaacgtgtgcaggctgatgttttttttcccctaaaataacagaaattcctacttttcaatttcctatttgggactgttaaactgactacaactgtatagtatttgtgtcatctatttacttgataatgttgtaaaactgggtatcttttttaaaaattagcatttttaatggcaagagaagtaaaatctttggtgtttttataatgcttttattttttcctttttagtgttctcacatcattttataatgctgaggatgaatcaaatcttctcttacctaaactacctacactgccaaaaaagtatgtatcactggtttctttgaaattaatcttgcagatttctctttcttctgcttttaacactgtgacaattttctcatgcgttttaaaatatgtatttttactaagagtattttttaccttaatctctgtttccttctagctatagcaacacctcaaaaatatttaggtaagatacgccttttcttgttttcaagtaagataatctgctattatttggaagacagaattgaaagatgacccaatttacttctatattttagtgaagaaaattctgatgaaattattaagctcttgggagacgtcaggtaaatcttacagataaataagtctaatttcttaaagttatttcatatttgaggcagttttcagaagctttaagagcaaatcctttatttgccattttatttcattgttttttgtttttgttttctttttgagatggagtctctgtcacccaggctggagtgcagtgtcgtgatattggctcactacaacctctacttcctgggcacaagcgattctcctgtctcagcctcctccgagtagctgggactacaggcacgcgccaccacacccagctaattttttttttttttttttgagacggagtctcgctctgttgccaggctggagtacagtggcgttatctcggctcactgcaacctccgccttcctggttcaagtgattcttctgcctcagcctcccgagtagctgggactacaggcacccgccaccaggcctgtctaatttttttatttttagtagggacggggtttcaccatgttggccaggatggtctcgatctcttgacctcgtgatccacccgccttagcctccaaaagcgctgggattacaggcgtgagccaccgcgcctggcctaatttttgtatttttagtagagacggggtttcaccatgttggccaggctggtctcagactcccaacctcagatgatccacccgccttggcctcccaaagtgttgggattacaggcatgagccaccgcacctggccttatcgttgacattaataccttcaaacaatatatagaccttaatatctattattgtttttattgtgtggcctttcgttttatgaagttttaataataatatgatgtacatatgtttattttaataagttaaaggatataagtactagagtttctaaaattttaagtattcatgttttttaagcccatttaatatatttagcatcataaccatgataaaactgatggcactttgtattagttggtaaaaggattgttttgttattgagagtgtataaatatagttgttattaaaataatgtattcttattttactgtaagctgatttttttttaggctagaggaaatttgtgttctttgaaaaaaggaatgagcctgatgtgactgaatattgagtgttagtggatttgatgtctcacttccctctgcaggggagctttagcatgtagattatatgaaagcagtaataatttatatctcgctttaacaatgcaatcatctgtgttgttgattggttctcagcttgttgcattgtttttaattaggcttaatattctcgtccttggaggaagctctggatttattgagctttatgcttatggaatgtttaaaattgctcgagtcac

SEQ ID NO: 110933 - DNA, 2330 bp, Homo sapiens
ctgtgattccttgtctctactccacatccttcatactccagcgagccagcacaggcttgtccacatggtggtggtaacggggcatcgagggtgcaagtggaagtgtacaaagacttttgaggccctggagtcaacagtgttatttctgctgcattccgttagtcaaagcgagactcaagggctgaagaaatggactctgcatctgactggaggggctacaaaagattgtggccatgtttttcattctaccacagtcattaatttatttgatattaaaggtttctagagatcagtatctttttaaaattgaataattgaccaaaccagtattttgacagttagtgtagataagacatatcttatataaaaagcttggagatatttgtttcaccagataaaaatttaagaatgttttattatgaaattctaagaatcaatggaatgtttcgtagttaagtgatgaccaagctgttgtctttttctccatcttaactgagttaaaagagtgattgaggctgggcacagtggcgcacacctataatcccagcactttgggaggctgaggcaggtggatcacttgaggcttggagttcgagaccagcctggccaacatggtaaagccccgtctctactaaaaatacaaaaattagctgggcatggtgacgcacgcatataataccagctacttgggaggctgaggcaggagaatcgcttgaacctgggaggcagaggttgcagtgagccaagatggcgtcactgcactccagcctggacgacagagcaagactctgtctcgataaataaataataaaaataaaacagtgattgaaagtaaattctagatttctttgagacacttgatcataagcacatattatttagatagcaagttggtttaaatattttttaccatttcaatttttcttttttgctaatagtatataaatttgtcactaacatgtatgtgtgaagcatgggaagaaatactaatgcagatggattctcgtctcaccaagtttgtgcaggtaaagcagctgaagtttcccatggagagagttaaagaatgcatgatgtatgtctttaccttgaggtacatgagaaaaatcagtttgattcataaaaggctaagatcataatttctttcaaatggcttcgtctgacttcaaactgcttcctcagatttgccaaaagggctcttttcccattgatacaacttaagtggggacaggattgtgaagtggagctggtggggctttggcaataagggcaggtgttagaacagctgattggctatcttctagtcactgatgttcagatgatcactttatggatttgatggaagtctaaggcaaggaaagggagtcatgctcctataattttgaataaatatgcttataatttaagaaatacatatatcacaatttttttttcacttttttccaggaaaagaacacaaccacatcagtgcaagatgagttcatgcacttgctattatgggggaaagcaaggtaataaactcagattaggtgctcctgtttttgcttcttttttaacagtaattatttatttgaaaagtagtttatagtcatagtatgtgatttttttaattgatacataatattttaattgatacataatgtgttacatacttacggggtatatgtgatgttacatgcgtagaattttttgtggggctatttctttattttgtttcttgtttgtgcttcgaaatttaaaagttgtaagtgatgcattcagatttccaatagagaagtgactaaaaatactttgtttttcattgtagtgctgaacttcagactctcttgatgaatcagttaacagtaaaggtgcagttaatgtatctatgtattcaaatggctatgaacacattcttaattttttttttcgagtggcatataatatcctgattgtatgctaaatatattttccttttttaattagggcttgaaaaagcttggccagtctatagagtcatcatactccagtatacaaaaattggtcataagtcatttacagaggtatgaaggtgacgtagaattttttggtattgtatccacacatacctggcgttggccttctttccgccgccttttcttcatctggcattctctttttaagccttttctagctaaaattgttgcatggcatttgagaagaatcttcctatacccaagattgaaagagtcaataataattctgctttatgaagtaattttccaacatcttttcaccaggctagactctatctgggtttttttcttaatcagctaagcatgaagtatattttgaaataaggcatatatcttttt

SEQ ID NO: 110934 - DNA, 1067 bp, Homo sapiens
atatgctcatgaaaaagaaacacaatttaagttcgatttgtgatctctacatctacaacataataatcttttaatactttgtggtttgtttagttgcttgactaaacaaactaccaactgttcagcagtttctttaatttttaagatagtagctagctaacatttatggagggcttaattctgccacatacacatagcagattttggctacctcacttagaatgatagtaatgcactttcagaggacttggcaataaaacaaagtaacttattaagttaaaaaagtgttaaaaataaaccgattttaggccctaagtctttgatttactaaacttaacttttttttgtcttttactttttttctttttccattttcccttccaggtatgaataaacttaaatttctaattctgtatttctagtacttgaaagatgaagatgatgatcttgtgtcaccccctaacacagaaggaaaccagtggtatgactttcttcaaaatagcagccaccttaaaggtacttcatgaaccaaccagattttggccatttttgtttttatttaagactaggtcttgaatagttctgctaacagttttgctgaaaacttgctgaacacttacctaagtttattagacttatatttatttgattataggaacagcaaaataaccaatagtgtatgacatcaccatgatagatagaagacactctgaagttaactacgctgtaggaagattgcttattcctaagtgttctcatataagtgttttgcaccctgtaaaaaataggattttgagggaaactatagagccaaatagtgagaaaagtcttttttgccaattccaatttattatcttctgaaagcacagggatgctcaactgtattctcctcgggttgtagttggtgtgtgtgtgtgtgcatgtgtacttgttatacctttcattttctagaatgtcagaatgttaataccgtaaagctatccagcattattagggatgcagcacataatagcaaccattaaatatgccagcacatcttaccattttagatgaaaatattttaaagc

SEQ ID NO: 110935 - DNA, 1031 bp, Homo sapiens
catttaattgttagttttcatgtcattaaaagggtaacactgaattaggaagttatatgatcttgttttagattatttaatttttattggcatataatcattgtaggactttttttagagttaggaaaaatatgacagctcaggatattatacttcattttttagaagttaaaaacttccgaaaaactaaaagttaaagaagttttaactttttagaagttaaaaacttctaaaagtggctgccttatagaaatgatttttgcctagggttaagtatgcttttcattaaacaagaggccttgcctaacagagacttactttgaaattgaaagtagaagttctgaaaaataaatcatatttagaacgccattggtagcttaaaaatggttttaaacctgaatttgaagaaaatgttgagaccacgatgtaaccaaaaagaaataattgggttatttctattccaaatgtctttggtgactgtgtgattttaaaccaaattggtttatctatctaggcatttaaacaagttctcagtgttctaaagaagtacatgtactgaccctgacaatcatgttcttttaagcctttagattattgactatccaggttgttccacagagtctctttttttcccccttctttcttgaagatctgtgagtaatggactaattgctattaaatttgggagctttacatatgccacaacagaaaaagtcagaagaaggtaagtcttgaatcttgtttggatgaaatgtagatacatgtgatatgtgtatatgtttaggaataggatcagactcagttacggtggtaatataggtaaaagggctttgccacttcccacatcaagggcaggattctttgtgtatttatacatagagaatgatttgacttgtgattgaatagaaccttactgccctgcagtttatgtcgtacggtttcctataattaatactcctgagctccctgttgacaaagaaagtaatgtggttcccatgggcagatggcctgcagggctgaagttcttgtta

SEQ ID NO: 110936 - DNA, 1152 bp, Homo sapiens
tagcatgggaactgaatgggtaatcagaaactgggtccagaatgaagtagcaggtgaatttcagcacagcattctccttgtcctttctctgctaagacacagaaaacattagggttttaggtggatggaccacctgaggtcaggagttcgccagcctggccaacgtggtgaaaccccgtctctactaaaaatacaaaaattatccaggcatggtggtggatgcctgtaatcctagctacttgggaggtggaggcaggagaatcacttgaacctgggaggtggaggttacagtgagctgagatcacaccattgcactccagcctgggcaacaagagcaaaactgcatctcaaaaaaaaaaaagaaagaaagaaaagaaagaaaacagtagggttttacagtttttcacatcataacagctggtgtcaaaatcaaaattagttactaaattacctgaaattttggaaattcgtatttctaataatctgttattccagaaaaaataggaatttactataggagagttatatcacattgtcttatgttgtagaacctgaaacataaccatatgtttttcttgtgaatttgtattgttgttgacttttatttgtgttgatgaacagaaatagaacatatgatacttgggttttgccctgtctgattcccaaaagttaaatcagaacacagtgattgatttctttttgtgaaatgtaacttagagactattgatctgttttccttttttttttttttttgagacagagtgtcactctgttgcccatagtacagtggtacaatcttggctcactgcaacctctgccttctgggttcaagcaattatcctgcctcagcctcctaggtagctgggattataggcgcccaccaccacatctggctaatttttatgtttttagtacagatggggtttcgccctgttggccaggctggtctcgaacttctgacctcaagtgatccctaccctctcatccttccaaactgctgggattacagtcatgagccactgcgtccggcctattgatctgtttttcattactatgaacaactggtcaggctcagtggctcatgcctgtaatcccagcattttgggaggccgaagtgggaggatcacttgaatccaggtgttggagactagc

SEQ ID NO: 110937 - DNA, 1041 bp, Homo sapiens
aattttgtaactgaaattctgttcatctttgcatacttgatggcatctatgtcaatattgattgactatttatgagtagaattctgaaacctaatttaaaatttagtttgcccttttttttttaaaaaaaagtattgccttctgagtaaatgatggtagtaacatgaagtatagtttaaaactatagtatcgcattggttgttaagtataaataaataaaatctaaccaaattcgtctaaaacagactgaactctatcttttcatcaaaccaacatttttgtaagagcaatttcactttgtgttttagagtagacatttttggaaatccttgaataaaaagctcttattaaatctccctggaatagctcataaccaaagaggaagaaaaaaatagcttatggtgtgatatatttaggatttatatatttaactacttatttgtctgtgaagaagtcttcctgactaaagatggctttcagataaattttaatttctctatgagtcttttgctattcctataattcatgcctttttgttagaaactaatataggttttgtgtgattttttttttcaatgagcaaaaataagttaaataagtaagtaagtgaacaaataaacaggtagtttaaagcaaaggaagggcccagcgtgatgactcacgcctgtaatcccagcactttaggagactgaggcgggcagatcacctgaggtgaggagttcaagaccagcctagccaacatggtgaaaccccgtctctactaaacatgcaagaaattagccgggtgtggtggtgggcgcctgtaatcccagctacttgggaggctgaagcacaagaatcgcttgaacctgggaggcggatgttgcagtgagctgagatcgtgccattgcacgccagcctggggcaacaagaatgaaactccatctcaaaagaataaaaaaagaaaaataaagcaaaggaagtataaacggttcttaaattgatggaaatatgcccaactttactcataataagaaaaataaactaaaatgacattgagct

SEQ ID NO: 110938 - DNA, 1050 bp, Homo sapiens
attaatcaagtatttaaaaaaattattctacttccccttctgttagctttttagttatgcattcttaaactattattttagtagttataaatctaaagattataacagactagctcattactaataaacccctaataaattagagaacaaagcaaaatagggaaagctaataataagtcagtaaacatgacttaatagagtactagaactcttggtagagattatattttttcatattggtggatatatttcattatgtatcttacatgtctttgtttccataaaagacaactcctaatcattcataagaaagggcactaaatgaaaagctctcagaatgcattttctttaccttaacattcagttctggtttgttgctctataaaaattctaactagcaaaatattccccaagtgggatttattgagagcatatgaagaaaaacattttattaaatttgccatggtttgcgtattttctcttcccttttttttttcagatgggcaaaacatgtagctgagaaaaatggctacttgggccatgtcatccgcaaaggcctcaatgcctacctggaaggttcatggtaagcttgggatccacgttagagcaaacttttttccctgtctgtcagtatagtcttatgaaatggagtcttaaaatgcaactgagaaagcaatttgcagggaaatcacagctcccagtaatgatattcagagtatcatggactgattggctgttgattggaaaacatagcatttccatgtttaattatacacaaaaatttgttctctaggggaattgttcacactcatcaagttgagaaagatatacaaatacattgatttctctttcctttaagcttgcccctcttggttttagagtctggtctggagacagcataggggatcttaggtgagactctctgctttttatttccaggccacagaaagtccagaatttctaccttgttcctagcaagaagagagatcagtgtttaaggttcaggccacctcttccatagatgttttactgcatctgccatgactagga

SEQ ID NO: 110939 - DNA, 1083 bp, Homo sapiens
tcaaactcctgagctcaggcaatccggctgtctcagcctctcaaagtgttaggattacaggcatgagccactgcacccggccttctgttctatttctatgcttcctttttttcttcttttctgcctcaagccttctttattcttctcttcccgctactagtttgaaagttttaaattctatttttgttcttttataaagtttagagttagtcagtgtctttacccttgaacaatacaaggtccttataatgccttaacctttgtcccatgcacctgacataatatatttgtcctgcctggtgcctgtgactcagcaaatcagttaacaccatcactattgtatatggtcactgactgtttatcttcacccgcgttctttactcaccgacgctgcttacatttcactcctttctagcttcagttttctcccttctgacatacatctgttactacttctttggtaagaatttgtaactgggaacctctgtttttgtctattggaaaatgtatagaactgcaggtcttctgccatggtttttgaaaagtttgtcacgccatccaaatttaatcatctcacttgcttaattacagtgctccagtaaccctttggtgtcttggaagtccagccagtggagggttattgaagtatagtcatgtgctgtatcatattttggcccgcgatagaccatgtatgacagtggtcccataagattatcatggtgctgaaaaatttctgtcgcctagtgatgtcctgatgatcctgaccctgtgtgggcctaggctaatatatatgttgtatcttagtttctcacacaaaagtttaaaaaggaaaaaataataataattttaaaatagaaagatgtctatagaatgaagatatataaagagaaaatatttttgtacagctgtagatgtttgtgttttaagctaaatgttactataagagtcaaaaagttttaaaaatttaaaagtttataaagtaaaaaagctagctgaggttcatttattactgaagaaagaaattttaaacaataaatgtagtgtagcctaagtgtgcagtgtttatagagtctgtagtagtgt

SEQ ID NO: 110940 - DNA, 1135 bp, Homo sapiens
tttgggaaagcctggctgcccagcagggataggcggaaaattggtggggaaagtctccaacctgagcatgcatggacagagctcagagaattcaatgaggccagaaggaaagagaatcatggctcccattttctgagcactcaacatagccaggcacctggtgccaagatgtggcaacctacgaggtcctacctatttcaccagtgagcacctgaggctccatgaggttaaggaaccggccagcgcgggcggaaccagggccttcaaccctgtctgagcccacagaggtaatccttagtcaccaagcgccgctgtgtaagggacaaagaccgcacaaacggccggagaagacgcgagagatgtggcccaaagagaggggacgggcctgggtgattttacacagagaggggacgggcctgggtgattttacatagagaggggacgggcctgggtgattttacatagagaggggacgggcctgatgattttatatagagaggggacgggcctgggtgattttatatagtgaggggacgggcctgggtgattttatatagagaggggacgggcctgggtgattttatatagagaggggacgggcctgggtgattttacatagagaggggacgggcctggtgattttatatagtgaggggacgggcctggtgattttacatagagagaggatgggcctgggtgattttatatagagaagggatggtcctgggtgattttatatagagaggggatgggcctgggtgattttacgtgcggatgcagaggaggggcagcgtcggggcggcggagtccgacctcgggggattcaccctgagggttacaggcaaggccgctccaggcacgcagcacctgccgggcgccacccaggagggggcagcagcgccattcgcaaagccggcccgctccgctccgctctcaggctcagggctgcggagacaggaatcgcagcttcccctggaaggggcgtcccaggggacctccgccaggccaggggaacccggcctccgggcctgggtgaacgtgccttccagaccatcctggcaggccgctgctccctagaggcctaaggcgcttgggacagcctcccactctactcctgaatctctcctccatcccg

SEQ ID NO: 110941 - DNA, 4248 bp, Homo sapiens
atcttgtaacaggtacctacctgtaatataaatattctatattgtcaattaattaaggactttgctaaaagagagcaaggaatgccaatataaagttaaagaaaaatataaaataaataagttaggctgggcatggtgactcatgtctgaaatcccaggactttgggaggacatggtgggagggttgcttgaggccaggagttcgaaaccagcctaggcaaaacagcgagaccccacctcccatctctacatgtgacttaaaaaacttagctgggcatggtggtacatgcctgtagtcctagctacttggaagactgtgacaggaggttcacttgagctcaggagtttgaggctgcagtgagctatgattgcaccacagaacgagaccctgtctaaaaaaaaaaaaaaaaaaaagtaaaaaaagttagaccgcatgagctgtaataaccctttttggaccaatatgctgtgactctgtggctttaaggatgagatgccaatatgcattcttgtcccagtagagagccagcccagtttggcctgggtgtgagaagcaaagctatcaaaagctttggccaattttttcccccaaaaggaattccaaatatatccaagcttctatgttagtgactgattgaaaccaaagctttataccatatgacatagaatcctggaatagataactttaggctgaagaaaaaagaaaagttaaggcaggtgtgagcagctgtccagttctgccataaaagaaatcaagtttaacttcagcgataacatgccttcttttaagcactcgagttttgttaggttctctccagttggctgaaaattacaccctaaatattcctctaaaagtagataacttagtgcacttttatttaatattacagtacttataaaggtttctattaatgggtctcctccttcgagaagagaatcgtaaatgaaatacataaagattaatagcctttatttatttcttaaaccagctggtcttcctctaagaaagcagatatgctaaagtaaataatccttcattttaaaaaatagaaagcattccccttgaatgctgtttactggctgtgagcaaataggtattcacttagaaggctttgctctctgtttattacccatatttctataatacctgcttcagaagtgttgcagaaagacaaaattaatgtgcatggaaaaaaagcagagaaaatgagtgttaatctttgtggaacaatccagagtccagagaaagaggcgagtagggggagaagccacttgttggaatgactagtatattaagattctcttctgggttatgggttaacatctgcatcattgaggtctattcacaacaggatattgttcagtataactttttgcatccaacagaaatacaaatattaattttcatggcatagagaaaacttcaaaatttgggaaagtactgaaggatgttatcacaaagttgtcatttagagtccaagaacagtcttaacaattgtacaagcttcagagcaagggcagaaaatcaagacatcaaattgtcatgtgggaaatctattctggggagttgtagaataaatactcactaataagaaaaggtggggaaggtccttctaagcaaaggaaatgagtgacaagacaagcaggtatgaatgacttttttttttttttgagatggagtctcgctctgtcgcccaggccagagtgcagtggcacagtccctgctcactgcaacctccgcctcctgggttcaagtgattctcctgcctcagcctcctgagtaactgggattacaggcatgcgctgccatgcctggttaatttttgtattttaatagagacagggtttcaccatgttggccaggctggtcttgaactcctgacctccgttgatccacctgcctcggcctcccaaaggtctgggattataggtgtgagtcactgcgtccagcccttcagtttgttttttaaggttttacatatatttttattttttccagttttattgaggtatacttgacaaataaaaccatacaagtttaacgtgtacaatgtgacgatttgatatatgtacatattgtgaaatgattaccacaatcaagttagttaacacatccctcacgtcacacttttactttttttaatgtgtggtgaaaatatttaagatctaatgtcttagcagatttcaagtgtgcaatacagtattggcaattattgccaccatgctttatatttagtctccagaacttactcatcttataactgaaagtttgtacattttgaccaacatctttccattttccctactcctcagcccctggcaacctctattctattctctgcttctatgagttcaacttcatagattttacataaaagtgacatcacacagtatttgcctttctctgtgtgacttatttcatttagcataatggcctcaagttgcatccatgttgttgcaaatggcaaaatttcctcactttttttttatgactgaataatatatatatttttatgagatggagtctagctctgttgcccaggctggtatgcagtggcacaatctcggctcactgcaacctctgcctcccgggttcaagcgattctcctgtctcagcctcccgagtagctgggattacagccgcccaccatcgggctcagctaacttttgttatttttagtagagacgaggtttcaccatgttggccaggctggtctcaaactcctgacctcaagtgagccacctgccttggcctcccaaattgccgggattacaggtgcgagccactgagcctggccaaaatcctaacagaataacattctattgtgtatgtattaaaaaactgtggtgtgtgtgtatgtgtgaggtatatacatatatatatatatggtgtgtttatatatatatatgtgtatcacaattttttaatccattcatccatcagtggacacttaggttgtttccatgtcttggctattgtgaataatgctccaatgaacatgggcatgcagatatcactttgatatatggtttccttctgatgttatacccagaaatgggactgctggttcattagggtagatagcatatttggatctgtatactatggacacttggatatagctggagcacaaggtacagggaggggagtgagaatgggagagtaggctggaaaggtaagcagaagccacactctgaaggggctcttaggccagttggggtccttctactgcataacccaggttcctcctcaggcccaagtaggctcttagcattcccttttcttcctcagctgcaggcctcagggctttgctaggtttcccccctttactaggtgttaccactcaccccatctcttgcatctggaaggtggtgccctcagcttcctttttttttttattttgtttattgcaagacagcacagagtcagcttggcatgatggctcacacctgtaatcccagcactttgggaggctgaggcaggaggattgcttgagcccaggagttcaagggcagcctgggcaacatagtgagatcctgtcctcacaaaaaattttttttaattagccaagtctggtggcacatgcctaaagtctcagctacttgggaggctgaggcagaaagtttgcttgaacccaggagttcggggctgcactgagctgtgattgtgccatagtactccagcctgggtgacagagtgagaccatgtctccaaaataagaaataaaaaaataaaaagcacagagtttttatattaaaagattttccaatgctaattatgatggcaaaacaattcaggaatgacaaaaataatagacatgtatatgagaagtgtttttttcttctttttttgagatggagtctcgatttgtcaccaaggctggagtgcagtggcacgatctctgctcactgcaacctctgcctcccaggttcaagcaattctcctgcctcagcttccccagtagctgggattacaggcatgtgccaccacactcagctaatttttgtgtttttggtagagacagggtttcaccatgctggccaagctggtctcgagctcctgacctcaggtaatctgctcacctcaacctcccaaagtgctgggattactggcatgagccatggcacccggccaggaagttgtttttgtttttgtttttgtttttgtttttgtttttgtttttgtttttttgagatggagtctcactctgtcgcccagattggagtgcagtggcaccatctcagctc

SEQ ID NO: 110942 - DNA, 4449 bp, Homo sapiens
aggctgatttgggacttggatgagggccgttaattgtggatcttcagccactcagtgtgggctggtccaataatcatatgattcaaggatgtttagggatttcctgcctctacaatctgagcccctctgctgaatccactctcagattttgatgctgtagttaacccctggggtgaaattagaggaaggatataattgtataaccacagtaaatcacttcactcctgcaatgctcatttgatatcagtaatggagaaaacagattcctcccatttagaactactataagagcacctgaattaatgagcccaaatgagttcataaatgtgaatggagagaaagcacttcctctacctccactgaatgtctttcctttgggcctgtcttaagtggagtttagagggactattggattccttgaactggcaatttctgtaattaccagtagttgctgagcttcctgatgtaatttcttctgtagaacagaaaagttcctaatatttggcacagcaatctcccgctataattacaggaacacaaggctgttagtcacatccctacctaccccacctctaacaatgctctttttttctttttttagcattaggtagctgggagaagacttgagcttaaaactctgctgttgaatgtagctgctgagcataaagctacattcaacagcagaatgtggctttatggacggtggatggtgtccttaagttagggtgatattaatcaggttcaatgtcaatcaaatggtttagcaaagaaggacaatacttagggcatttatttaatgatttattcgccgctctatttcatacaagttttaaggaggttggcatatatgactattaaatatcttattctttactttgatgaataacaaatagttttattttaataagttccattcatgtttatattctatttttgaccaagtagaatagttttctttgtacctaatatacgctacatacttgtcattggttacctaccacaccctctctgaagagcaaggtcaacaataaaagagcttaattcagaggccataattcattctgtattctgttaataagcaacatccatttaaaatagcaattgcgctttcaaggtcctggtattattcaggcaaagactcaaaatgatcactttcttggcatacatagaagcccaaatgttaagatgtgttctgtgggcaactctctgcttgttttctttcctagacaagtggttaacccgtgttgcatatcctgtgtttatagaattccagaaaggtcgtgtcatgtaaatcacttgtggactgggcacggtagttcatgtctgtaattccaccattttaggaggccaaggcaggaggatcgcttgagcccaacaatttcagaccagcctaggcaacacagcgagccccggtttctatgaaaattttaaaaaattatccaggcgtggtggcagacacctgtagtcccagctacttgggaggctgaggtgggaggatcacttgaacctgggaggtcaaggctgcagtgggcagtgagcacaccacagcactcagcactctagccggggtgacagagtgagaccctgtctcaaagataaacaaataaatttaaaaaatcactttgtgtgtgtgtgtgtgtgtgtacgagagaaagagagagagagagagagagagacagagagagacggtgtatgggggggatgtatagggagaatgtaaacagaaacatcttgaggagaaatccagcagtgactgagaatgtcgatggaagatgctggccttcgcttccacgtgttattgtgtttctgtgttcattacctgttaccttttttataagtagcagagggtaaaataatatgtccaagtggcgactggctaaagagacagagcataaaacagctggtcagacaccctggtttagtctatcatttataaagttgaaaaacttgaagttgaaaccagatgcaagaaaattataatttatcaaagaaaaaaagaaagaaaaagaaaaaagaaaatttttatctatttttaaaaaacaattcattttgtcctaaaatctctgccagttgtttaatgagcagcagcttctaaaataaacaaagaatatgagaaaaaaacaaaaaacaaaaaaaaaccaccacccagaattgattagtaggaaaaagtcccaggagagctttctaatgttgccttaatttttttttaaatgctattatactgttcatctccattaacttttcttttttggaagggaggtactattttaaaattcagggttttgtctctaattttaaaatgacaattagcacaatcactgatacaaatgtttcttctgatttccatgaaacggattaatgttttaattcacctgaaccaccaactgaatgccgtaggccattttgaaaacattcactaatccttgaaaatagcatgctttccctcatattttttttcaaacactaatccttgggaaaaaaaaataccttctctcattttctattcaatgtttgctattgttgtaacctaagtaggacctctttgaacaaatgcaaaattaagtttaactcacaattgagtctcacatcctgtggtcttggaattttaaaatttcattcaaaacacacattataaacaaagtctcccaaatgaccatctagagaggaatgtggcaaaaatccagaaactattgtaatatttggaactagcatagcacaaataatcagtgtgtttttttgaagaggagattatgggttgcagttttacaaactccacgggggatctgcacgagatgggcaaagttaaattagttgtgtgcctcccagagaacctaaactctttacagtaagtgaagaggaagaagtattaaaaggatctttttaaaacctagtatttgttcattataaccataattggagcaaacattctggcttacaaattcctataaactcaagatcaaagcagtgtgcttgacaagcctgttctttagcacattagtttggtattattaacagtggagactgattcagggcgggttgttggggggatgtggaaaggacaaaggccaacgccaaaacttatgtcatcaagccaggaaaatccaaattttagaggcaggaagaccagaggagttatcaacgtacaaaataatattctgaagaagtgcttttgaatgaagaagtaaacctgtgaaatcaatttaagaactaaaactaaccattgaaggcacatttaaaatttacgcttcaaagaaaaaaggtaggtcagagaaagctgaattcgtacctccgaaaatgcacgctttcctggggcagcaacttgtttctctccgattccaaaagaatgaaataaaagaactccaaaaaaggaatgtagcaaggacatactttctacctcaaaaaaataaaggagttggggtcagggcagagccaactaagaagatggaaaccaatcacatttcaaaatgattcttactttcttaggaaagtttaatatgatgatatcctatgcgtttctcattttatccctcagttaattttaatggtttacaaattcatcaacttttctaaatctgtttagaagaacacccctatctagaagattcacccaaatttcatgcttatttttaatatcagtattaacacatcatgtagatctgtagccactgatatggtagctaatatttttctgcccttaagtaattgagtataagtagatttcaccacctctgtaatgtttcagtttcagttttcatacaccattctgagaaattttgtgaactaatatagcattttaggctgttttcctcttaatcatcataaaaatgcctcatgtgggagaaagaaaggaaaaagattttcggcatataaattgtattaagtttataatacacaaataggaattgctttatcctggcaaataacgagcagattttaagaaaagatagttaagactgtgtgctttttttttttttttttttttttttgagacagtttcgctcgtgttgcctaggctggagtgaaatggcgagatcctggctcactgcaacctctgcctcctgggttcaagcgattctcctgcctgagccttccaagtagctgggattacagatgcctgccaccacgcctgactaatttttttttttgttttcgtatttttagtagagacggagattcaccatgttggcaaagctggtctcctcacctcaggtgatccacccgcctcggcctcccaaagtgttgggattacaggcgtgagccaccgcgcctggcccagttgttgttttcaacacaaacctcttaatgaagaagcaaggtttttggaggagtggaaatggcatgaaattgttggttaacagatataaattaaaagattcttgacttggaagcagaaagatggcatcgcaccttatctgcccacttctgaccagagtgtccttggccaaatca

SEQ ID NO: 110943 - DNA, 1467 bp, Homo sapiens
acccatcctcctgcaccacgtggcctctgtttaaattcctttaataactgttctgggtccaaataaaaaaacagggatagccgggcatggtggctcacacctgtaatcccagcactttgggaggctgaggtgggcggatcacgaggtcaggagatcgagaccatcttggctcacacggtgaaaccccatctctactaaaaatacaaaaaattagccgggcgtggtggcgggcgcctgtagttccagctactcgggaggctgaggcaggagaatggcgtgaacctgggaggcggagcttgcagtgagccaaaatggcgccactgcactccagcctgggtgacagagcgagactctgtctcaaaaaaaaaaaaagaaaaaaatttaaattttttttacatgcatgcagtaaatacatgcagtattgcccatttttaaaataatagaaaatttcaataaaaagcagttttgcaatttgtcacatttttagaggcaatttgggctaatccctggaagtaggcatgatataggctgaagctaaatatgaagcctaaggataatttatatttatttatttatttgagaccatgtctcactctgttgcccaggctggagtgcagtggcgcaaccttggctcactgcaacctccacttcctgggttcaagtgattctcctgctgcagcctcccgagtagctgggattataggtgtgcgccaccaggcccagctatttttttgtattttagtagagatggggtttcgccatgttggccaggctggtctcgaactcctgacctcaaatgatctacctgcctcggcctcccaaagtgctgagattacaggcatgagaaatgagcccagccaggataatttttaaaaataagtataaaaggacaaaatttgcacagattgttagaagagtataacaacaaggagaaagtctgatgacacacttcctgatggaaccttagccattggagctgtcaaggagttacctcaatcatgggtcccagcacaaggctaagtcagaagaggaacttctctgaattgtagggtatcttcagctccattaagatagagccttaaattggctgaactttagagctggaaggaacctttaaggtgttcttttctatttcttcatactttcttctacatttgaaaacaaggaatttctatttccaactccattctttcccctctccccagtcccgtttctccagctctctggaatggcctacaagtaatgtactagatcttaggtcctccaggtaacatcagcatgcttattacccttcaagtctccccagcgttggggtcctaattcacaatggtaataagggaggaagtgacccagcaggcctagcatagggctggttatagagaaatgtcagaggagtatccagcattcgcattctagcaatgtctgtaactgtgagtatgagctagggaaagtttcttcatttttctg

SEQ ID NO: 110944 - DNA, 2145 bp, Homo sapiens
ttttttaaatactatataaaaagcaaagcatgtaattgaataaagttaaattaattttttctgctctctctcctgtctttgcttaacagtttcattgagatgcacttcacataccatataattcactcacctaaagtgcaaattcagtggtttatagtatattcagagttgtgcagccaccaacacaatcaactttgaagacttttatcactccaaatgaagtcctatatcctttcacagttatccccacatacacactgccgggccctagacagccattaatctgctgtctctatagatttgccttttctggacattctagaatcccacaagatctttcatgatttgctgctttcatttagcacgttttcaaggtccatccatgttgtagtgtgtttcatactttatgtctttttataaactaatagtattctattttctagatatatcacattttatatcttcatcagttgatggacatttgcattgcttccactttggggcttccatgaataatggtgccatgaacatttatgtttctgtatggacgtgttttcggttctcttaagtttacacctaagagtagaattgttgggtcatagagtaactctatcgttaccctttgaagaactgttaggttgctttttaaaatggttacatcattttacattctcaccatcaatgtatgagggtttcaattttccacaaccttgtcaacatttgtcattatctgtcttttggcttattgccacactagcaggtgagaaatggtatctcattgtggttttgatttgctttttccatgatggctaatgatactgaatattttttcatgtgatcaatggtcatttgcacatctttggagaaatatgtattcagatcttttgcccatttttaattgaacgatttgtctttttattattcagttttaagaattctttatatattctcgatactagacccatttcacatatatttgatctacaaatattttctcccattctgtattttttttttttttactttcttgatagtgtcctttgaagcacaaaagttttaaattttgatgaagtccaatttatctatttttttaatttgttgcttgggtttttgtgtcatatctaagaaatcattgctaatccaagattatgaagatttacccctatactgtcttctatgagttttatagctttggtttttagatttagggctatgatctaaggtaattttttaatatgttgtgaattacaggcccaatgtcattcttttgcatgtagatattcagttttcccagcatcatttgttgcaaagactgttccttttcccactgaattcttttgacactagtcaaaaatcaaatgacctaaatgtgagggcttatttctggactcttagttctattcatttgatctgtaagtctgtccttatccagcaccacacagtcttgattactgtagctctgtagaaagtttgaaatgcggaaatatcagtcctccaactctgttcttctttttcaagattgtttggctattgtgggttccataaaattgtggctgtccttgtcagtttctacaaagtggccaactgggattttgatagtgattgcattgaatctgtggaataatttggtgagtgttgccatcttaataataataccttttgatccataaacatgggatgtttttccatttatttagatcctttaacatttctttcaacaatgttttgtagatttcagagcataaagcttgcacttctttttaaaaatttatacctaagtactttatttatttaatttgatactctggatatttaatactcatgctattggaaatgggattgttttcttagtttaattttcagatggttccttgaaaatatatagaatacaatttttttatattaatcttgtattctccaacttggctgaatatatgtgttagtggtacagataataattttttagtggagttcttagaattttcttttctttttttttttttttttttttttctgagactgagtttcactcttgtcacccaggctggagtgcaatggcatgatctcagctcactgcaacctccgcctcctgggttcaagtgattcacctgcctcagcctcccaagtagctgggactacaggcgt

SEQ ID NO: 110945 - DNA, 1656 bp, Homo sapiens
cacatcactagagtaaatggcccattcattttcttgctttaccttcttgaactgctgcacatattaacaagctaagcaaaacttaacccaggcctgcaaaaaactcaaattgccagggccaaaaaatcctgtgaaaaattaaacacaattggacagaaaacggtgaatatttatttttgtttctcaagttctcctgaagctgtgattcattttcagtgttctatttcttttaatcctggagttcgagcttattttctatatggaattgcagagtctgatggaatccttcttggcactctttcaatttcctatacattttattaaccttgatgaacacgtggtagaaaatgacagggataatgttatgaatataagagaaccataaagatgaacaaaaaaaacatgagttaaacatttgtagagtgagcggctcctagtttctaacatgggctatcagcagggctgtcttaggcccagagcccctgcacaatctgataacaagaaaccttgctttgtattctcagaagctcctatcagctatctacagtgggtttcccaaacattttgtacatctgatcctcttggaaattaaataacaaaaataatattgtcatttctgagtggggatatgagaaaaaaatgaattaacaccaatcaagataaaattatgactgtatttgcctgttttaacttttttttttttttttttttgagacagagagtcttgctctgtcacccaggctggagcgcaatggcacgatcttggctcactgcaacctccgcctcccgggctcaagtgagtctcctgcctcagcctcccgagtagctgggattacaggcgcctgccaacgcacccggctaatttttatatttttagtagagacagggtttccccatgttggccaggcttgtcttgaactcctgacctcacgtgatccgcccgcctcagcgtccccaagtgctgggattacaggcatgagccactgtgcccaaccgatgttgatttttgaagtacagccattttgacatgctttgcaagaattttgatgagatgaatgcaagttatggacttgttgagtaatgataaaaactaatattactataacaattgtgttatagcactgttctatgtacttgaaacagtaatactttgaattctgacgatcctatgaattagaagctacaatctccattttataggtgaagaaactgaggcactgacaagttaaaaaacttgtctaagatcacacagctagcaatgttgaaatgcatcactgtggggccaggcgcggtggctcacgcctgtaatcctagcactttgggaggtcgaggtgggaggatcacttgaggtgaggagttggaaaccagcctggctaacatgatcaattcctatctctactaaaaatacaaaaaaattagccaggcatggtggcaggcacctgtaatcccagctacttgggaggctgaggcaggtgaattgcttgaacccaggaggtggaggttgcagtgagccgagattgagacactgcaccccagcctgggtgagagagagagactcggtctcaaaaaaaaaaaaaagtgtcactgtgtttaaaccaccacagcaaactgtaatgtccgcctctcatgagccactagctgcttcacatgcctttg

SEQ ID NO: 110946 - DNA, 1112 bp, Homo sapiens
gttagctgggtgtggtggcgggcgcctgtagtcccagctactcaggaggctgaggcagaagaatggcgtgaacccaggagacggaacttgcagtgagccaagatcatgccactgcattccagcctgggtgacagagtaaaactccgtctcttaaaaaaaaaaaaaaattagcagggcatggtggcatgtacctgtaatcccagctactcgggaggttgaggtagaagaattgcttgaacttgggaggcagaggttgtggtgagacaagattgcaccaatgcactccagcctgggcatcaagagcgaaactttgtccccaaaaaaataaataaataaaaataattctactaaagtagaaggaaacaattttatttggtaaatttttgtcttcttgcacatttattccatttctttcttttccctcctttctatgttttatatttataggaaatatatatacatagtacaaaattcaaaggatccaagatagactgtgaggaaagccactctctcacctatatcatccagctgtagagtcctttataagaaagcagtcattcttacaatttctagtgtgtccttccagagacattttagacacatatacgcaaataagtatatatatatcactgttttgcagttttttaaactttgtgatctttccgcaaaagtacataaaaagcagcctctgcttattaataaatatactctttcattctatgtataatttaaaaaaaaagacatctcttgatgtttgttaccagtatttttttttccaccatcagtgatgctgcaaaatataggtaattttacatgtgtgggcatattcataggataaacttctagaaatggaattgtaggatgaacaggtagtgacaaattttgccaaatggtttctgatatgctttggatctgtgtctccgcccaaatcttaggtcaaattgtaactcccagtgttggaggtggggcctggtgggaggtgactggatcatgggggtggattttcttcttggtgctgttcttgtgatagtgagtgagttcttgtgagatccggtcatttaaaagtatgtggcacctcccttccccgccttggtcctgctgctcccatctaa

SEQ ID NO: 110947 - DNA, 1958 bp, Homo sapiens
aggattttccgtccaattgtatcttgggtgtgagaaaggaggcaaggactccaaggttcttgacataagtggaagaatggagttgtcctttcctgagatgggggagggctgcagatggagcatgttttagggcaaaaagggggagctgttattccctttgtggttaccatggcttcccaaggtcgctggggctctcagaaggccatgattccaaattagatcagtggtctggactaggccatgactgaaataccttcttgggatgacagctccaaggaatatgtgccccaagggctttgtcctcctcctgagctatcctgttccaagccagacttgcactgagatattgcaccaaatggttttaagtctgtttttttgtgtatataatcaataggcaaacacaaacacacacacacgcacacacacacacacacacacccctaaaaccttgaaaacaacttaaaaaccagggtttcctattagagaactcactgtcctccaaatatcaaaattcaattcaactctacatttgcggggctgtgacgtgagcaggaagacactggttcctagataatgccaggctaaggctggtatagaaaccacatcagggccaatctgaaacgtggctgattgaagaatttacgtaatcaggaactcattggatgaatgatccaaaaggaagggctgcatttaaaacagtagtcactatagcacctgccgcagccatacgtaaaatggaatattgcaataaaaatacggaaaggtgacggaaagcaaaaaagccatattagtgggaggaaaaaacagaaactgatttgtaagattacttcaaaaggctaagaagagactgacaagaaattttaaaaatcgtgtccttaaacgggagcaagaatctatacaaggcaacaaggcgagagcgcagagctgtttatttatttatttatttatttttctacccagctcacagggccagcgggtagattagaaagaaaacaaccaattgctgccaggcgcggtggctcacacgtgtaatcccagcactttgggaggccgaggcgggcggatcacgaggtcaggagatcgagaccatcctgactaacatggtaaaactccgtctactaaaaaatagaaaaaattagccgggcgtggtggcgggcgcctgtagttccagctactcaggaggctgcggcaggagaatggcgtgaatccaggaggcggagcttgcagtgagccgagatcgcgccactgcactctagcctaggcgacagagcaagactccgtctcaaaaaaaaaaaaaaaaaaaaaaaaagaaaccaattgctaaagtagagtagctaaggaatcagaacttgtttcaaagtaagcgaagtagtggccagactaggtgactcaaggcatgactcaaacccgactctggaggctgtctgtcagctcccggaggcggggggcgcggtgtctaacacgttttaggaaagtaccaggcttgtggagggcgacaggaaacctccccgggagatcggcctggggctcctcctgccctagagcctgacctctcactctccgtaccggcagcgacttccaacctcctggcttccccttcctccgttcgaggctccccacccctcgtcttccatccagcgtcacagggcgtgtgcgtgttgtgtgcgagacgcgggtctcctcccccgccgccctccgccccgtgctcccagccacgcgccttcccgccccgcctccgcggcaagccgctcccttcccaccccgcccgcgcccgccgcccgccgcccgcctcccgggcacgcgctgcacgaacggcgcccggagctggtctaggcaaacacctgtcctgccttggctccgcgagatttggggcgaaagcttaggcaacaggggcacgttctcgcgaggtttaggaaatttcccacggccgtgttgtgtctgagccgagtagtggaagg

SEQ ID NO: 110948 - DNA, 5834 bp, Homo sapiens
cgggatcaggccgcctgaagcgcgattcgggcagccggcagcgtcctcggctgtgccaggccctcgggtggcccggttccctgtgcagtagtggtctcaacacacacctgggctcacacacggtggtggctgcgatggggtcttagagaggccatgcagcacgcgagcggcaagagctttgatcgggtcctctgggcagactcggaggtgggagaatgtggctctcaattccaaggcagttttcccttctggagagaactactccgcgctctggcgtgtgtctgcgaggtggccattaggggtgtctttgctagaggccttggcttgacctcatttcacacccaaggagaacgctaaggcgagagagctcaactgcaaaagttttccgcttgaggagctctggaagggcctcctcattagcatgggggggtgtaatgaatgaagacagtccccgacgtgtcacttgcccgaaccccagacatctctggcgctcctgcaccaaacgccgagattagcataaaggaggcgcccagggaacgtttgaatgaatgaaaatagctgggaacccagagtgagcgggaagccgcttggaaaacacccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggtaagtctgagggaatcggagcgccgggaaccgggaaagttgcgggcgtctggcagctcacggcgggcagcgggttcgggggccgcggcgcgcttggcgttcgggggcccgcgggggcggcgtcgcgtgcgccgagcgcggcggcggcggcgtgtggccgtgcgctgccgctctgcgctgccgtggctcaggctccagcgcgtgagggcgggcggcggcggcggcggcgaggccggcgggtgcgggcgtgagtgcggcagggcgcgcggggccctcgggcgccgtgcctcccgcgcgcctccagcgggctctgcctgggggccccgtgcatctttgttcctcgcggccgttgtcgccgcttcgccccgctagtgcccccggccccgggcgctttgtctttcaccgctacccgctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgtatggtcctggatcaccccccgaggctttgtctcccccatccacgggcttattctctcggcacccccttcctctcccgtcatcggttgatttatccacaacccacggtgtacgtctgctgaactgtctcagccccggggactccatctgctgcttctaagtgcacacaagactctacggtttgttgttttgtgggtctgaaagatgcatgggatacttagttttctcctccgcacctctttttctcgggatttcttgtaccctcccgcccccctatcgccacccctttctctcgggattaaagcgtctccaattttcatcgccgtctttttagtgccgtgggttgttttgcttggaaacagtagccttggaaaaagatctggtctcttggtggttcttgcgccccccggcccccgcccccctcctggttcctgacggcgtaggccaagggcagctgtctgtcgaagctttgcaatctaggctgcctgaggatgattggagggtatcgtaggacggttagaaggaggctcaagatgtatatatgtgtttttctgttagtgtttgagaatagtttcagatagccacaatggatattcatttggcgtgtgagtaggagttgagtgaatttccatgttaaaaacttgtgagtgttggggcggagaatttcagcattttctagaaatctggatttagaatttatcagtaacttctgcctcataaggaaaaggagaggcattccgcttgggaattttatataaatgttttattttttcttaatcattagatagtttacagttatgtgctttttgctgccctgtagatgcgtgacaacccttctgtcccatcattggggttgaaatgaggacagcaccgaagagtgcagtttctggtcgatgaatactgcttctaagatctttgtggaagatattaatcaaatgcagttaaaaagtatacgtataatatgtatattatatatatatatacacacacacacgtaatagcctgtagtgagattattttaaagacacttcctagtgttaaagaacccttgaagtgtttcgagttcttattgttttggtaatgctaaaagcttggggttgtgtgaatgggggtggggggtgtggtgtgatgtattctaatgacttgagttattctgggtgctaggaataagagttattatatttaccaggattactatgctgaaggtattcttcaagagtttgttttttttctactggttgatctctacttttagaaggtatgttacccataaaatcatttggagtgtcatttcatttacaaactgaagttctacaatagtgaagtgttgttgataggggacatacgagatctactctaacgagtattggagcattggaaaatacttttttttctggctgtgattagaattagtagtttgagttttaattaatggaaaaccatgttttcatgattgatacataagtttttttgtgaaaatctgcagtctgggtcgcttgagtgggttttaccaataatcttatgtctcccttacttgttcttgtacataatcattgttttgaaggtaaaatcttgagctcactggttctctgactgggagcaaagtgtaaatactgtgtagtaatggaaggtattttgctctgacttgtacctgtaagaatgattacacagacatgataaaagcgcttttaccatttgagttgcgtttttctttctaaatcgtgtaatacttttacttacatgattggtgaaataaaactgcttttaattaaattataacagcagcatatttcgaaatctggatgcgttgtggctggagaactttcattctgagtattaactgttaaagctttaaattttattatccatgcatattgctgatggatctgtgagtatattttcagaaaacaggagacttgcaatattttcaaatctgtactaatacacacttgtaggcattagattttaagcagttaggtttgttaaaaagttatctgttgtcctataccaacagatttctatcaatgttttttttaagtgggtaagatcaaaattggtttggttgacaggccattcttgccagatgtaattcattaaataacctttggcacccttgatgggtaaggcattaggaaaaaattgtttcgtttgaaagttattatacatctcattcttctgttcatttttagaaataagacccaggacttggctttaaagcattattttgcattttgcttcctcctaatactaaatttcatgttatctcaactaggggcagtattttctcatggattgactaaaagttgttatttttggcatctggctttgtgattatttccaagttactctacttcccctgggccagtttcctaactatgtagtaaaatgggaattataataacttgccacatctgcacaggattgctgtgccttaagattcgcagagagcatccttggatgaaaactgtggggaaggtctaggaattgttactgaaataagctaatgtgaagtaggtcatattttataggaagtcaaataggaggtttttaagttcttggcaagacacagtagcgatagtgggattttttaaaatcccaaatatgtattataatatgggtaataaaacagatacctttattcctgccccccataaacttatagggaaagggacaaataaaacaaattacagggtgatgtgtcgtgtgtgagtgtgtgtgtgtgtgtgtgtgtgtggtgtaagagattgaagttctgtcaaactcaaatgtaataacattataaaattatgggatgcctttcctcttttgttttctgcatgtagcaatattctatttatttattttattttattttttgagacagggtctcactctgtggccaggctggagttcagtggcacaatcttagctcactgcaacctccacctcctgggttcaagcgatcctcgtgccttagcctcctgagtagctgggattaccagcgtacaccatcatacctggctaattttgtatttttagtagacatggggtttcgccatgttggccaggctgatctcaaactcctgacctcaagggatctgcccaccttggcctcccaaagtactgggattacaggggtgagccaccatgcctggcctgcatgtagtaatatttaacaaatggtagtacaacatgctttcactggactctaagccaagtctgttaatagcagtgattaattttaaatatgccttatattttttagtgctttgttatttgctcttaagaataaattctaataaccatgactataatttcagatttgactcttggccttagaaaagtgttttgcatttgaggagcactctgtagatacgtattgactgaatgaaacctgttgcttctctgttcttggtagatgataccatattccgtttggttcccaaagccacgattcctaattcctctctcaccagcctttacatttaattactgagaactgatcatttttccttctaaaaaatctcttgaatttgtttcccttatcctcactgccgaagttcatgctgtcatttctcacctggtttactatgacgtactgacagcctctttctgcttctagagtcaccacctttatccagcttctacatgtagcagagcagtctttctaaagagcaaatctgatcactgcttaatctaaaaacctttcaatggctccccctagcagcgttcattaagagaggcaacagagtggagggttatgagctcacatttagtgtttaatctgaactgggttccaattctgtctctggcacttaaaacccctgccagttaaaacccctgtaacattgacaagttaatctctttatcaattgcaagataattattcctaactcagaaagttgttgtgaagattaaatgagataatgtatgaaagcatttagcagaattcctggcatgtagcaagtgctcaaaagatgttagctactgtggcgcataggatcctccataactatttcatctgtctcttctccagctgagttgtttgccattttctctccataatcagtgcttcagtcatattaaagtattttgacatctctgcatgagcccagcagtttaatgcgtt

SEQ ID NO: 110949 - DNA, 4496 bp, Homo sapiens
gttttaggaaggcagcaatgtatttggtgcagaggaccgcaacccttgaaatatgtgctttggcattttaagcagacatatttgttaaattactgcttgaccacgaatgttgtcattgagtcacccccagctttttggggtctatttcttactgctctcttctctgcttgggcagctgtaacaatgtaggaatgttgaatgtctagctgctactatctctcagactcttatcctgcccacagttctgtatgcctcttaggcctggcacaacatcatggtgttgcttatgcctcattagacctgctgcttaagggaattaaatgataccctaatggtctaaaaagggtaatgtatttccgaacatgtcatatttactgtaggaggttggggaaggcgtcacaggcactgtaagtggtagtaattacctatccgtatagatatttgtgtaattttgttgtgttgagacaatgcataatggtaagtttgagagcttttcagtcatattggtgaagtttacggcaatcttgggaatatttatactattttaagtttacaaaaaataaaatatagaaaacacatttttttaatgcattctgagttgcaaaagccttgcaatgaaaactgcatctatttgatgtgaagcagaatacactagagaatcaagttgaccctggaggttttttttttttttttttttttttgtattcagtagtcttagcctaagagctaatgattatctgtgcattgttaatgagatgataatcagagttgtaagtgataagagtagtttctcataaaaagtttacataacaggagaaaaaatatttaatgttgggcgcagtagtagctcaggcctgtaatcccagcactttgggaggctgaggtaggaggatggcctgagcccaggagtttgaggctgcaacgaatggtgatcatgccactgtactccagcctgggtgacagagaaagaccctgtctcaaaaaaaaagtttttcactctataaaacttttttataagtatgatattgtgttatagaagtacagtattgctttatgaaatataaatgtaatattgtagtttttttaaaataatgtgaacagtctattatggacatagcttaatttcctccagtacaaactagctttagactggtttgcataaatagaacaaaggtatatgttcccttttggaaaactgcagatctgcaaagattgtgcctgattttgccagcatgttttttcacatctttttttttttttaatttgataacatttttcatgcaaaaaattacctagatctgtacaaagctcctaatccatacaccatttggagtaagcagaaacactggggtcctaagacatgtaggaggggtgttaaggaaaatgttaatagtataaccatgctttagtggctctccttttagtattgttttaataacaatatatttattaaataagcagttgaacacttattaggtataagacactctttgtgctggtcctataaagatggctaagaaatggtttggtgaagctcatgacttggtagagtgtacacaggtaattattgtgtaagggagattatggtaagtgctgtaaccgatatttagtgttggtgggaacacagatgtaaatgattatcttcatttggagttcatagaaaaggtgagagttgatagggagtgatgggaaattaagctggaaaagtaattgggagcctcttggaagaccttgagtgctaacctgattatttggttttttggctggttggtgttttttagagacagtctcattgctctgttgctcagcctggaatacagtggcaaagtcgtacttcactgcagcctcaacctcctgggctcaagggatcctcctgcctcaccctccccagttgctaggactataggtgtgtgccaccaaacccaggtgtgcgccagcaaccccagctaatttaaaacattttttttgtacagacagccttgctatgttttccaggctggtccagagctcccgggctcaagtgatccttctgccttggtctcccaatgtggtgtgattatggatggcctaaggtgattatttgaatattaatcagggatacagaggacaagggtaaggtattgaggtttttgtttgtttgtttgttttgacggagttttgctctgttgcccaggctggagtgcaatggtgcgatcttggctcaccgcaacatatgcctcccgggttcaaatgattctcctgcttcagcctcccgagtagttggggttacaggcatgcgccaccactttcagctaattttgtattttcagtagagacggggtttctccatgttggtgagactggtctcgaactcctgacctcaggtgatccacccgcctcagactcccaaagtgctaggattacaggcatgagccaccgttcctggcggcattgagggttttaagatgaggtagggctggatgtaaacagtgtaaaatagattggaattggtggacaccataagagaaatataatcaaaatctgattttggtggtgggcctaggaatgaataggccaagaagctctttttgaggcagggtgatgtagggaacttgggaataattgtactgtaagtcactaaaataagtttgtggctatgagcatttcacttaagctaggtcttttcctttgtctaaaaaatggaagaaaataatacctcatggtattgatgtgaggattaataagagatagaaaatgcctactgggccggctgggcgcggtggctcacgcttgtaatcccagcactttgggaggccgaggcgggcggatcacgaggtcaggaaatcgagaccatcctggctaacacggtgaaaccctgtctctactaaaaatacaaaaaattagctgggcgtgttggcaggcgcctgtagtcacagctacttgggaggctgaggcaggagaatggcatgaacccgggaggcggagcgtgcagtgagccgagatcacgccactgcactccagcctgggcgacagagtgagactctgtctccaaaaaaaaaaaaagaaaatgcctagcttggttctggtaatagtaggtgctcaataaataggttctccttaccccttttctgaagtgtggaatttaaagggtaagatgggagtggggtacacccccttcagaagggagggtaggaaaaaacctgaaattaaaacctggtgataaaataatcagaaaagggaaagttctgagtaaggtgaacagatacaagagaacctttttaacaaagtgttgtgcttattgtaggtctttaataaatgctggatgcttatttttgcatacttctgttacacttaacattgttctgcaattatataaatttatctgtaattgattgtttaatctgtcagtgagcttcataagaaaaggagcaattattttacttaccttgcacaattgtggagcacctaccatctgccagaatgttatttgctggatgaatatggcttgagcagatttggtaatatataacacttgccactaggtggctcttggtcttgataaagctgacattcagcatagataggtttttctacctagaaacccacgtagaaactgacccccggattatattcacttttttgccttttctgtacctatattttttgaagtggaatatgaaacacatatcatatagaaaactcatttagactgttgaaaattagaaaagtgtaatgcctttagaatatgtcctgtagaaagaagcagaatggaagctcaatgaaattcacaagtgaacaaagcacatttccccatctctcaatgtgcttaaagtgaggcatgatggtttgattttaggcattgttttttgttgttatgactgcgtaaattgctttaaaggaagatattgtgaggatttgtttctcagaggatttgatgaacgatgatgaagcgtggtgtgtactgatgctaggctatgattctgtgtgctcttatttgtattgtactcttcctattgagaagtaacataccatctaatggtaacttacataacatagaaaggtaactacatcctgtgtgacacgtgtgatatatattattaaatccattagattcaggaaattttagagccagagaagaccttactaatcatatattctaaaagtacccattcatttacacagacaggttagataatggctgagacacattcagtgactgagctagttcctggtttgttttagggggaggggaaggcctgtgttagtcttttgtttttgaaacagggtttgctgtcacgtaggctagaatgcagtggtgctgtcatggctcactgcagcctcaatctcccgagctcgtaatcatcccacttgagcttcctgagtagttgggactaggtgcacgccaccatgcctagctgggttttgtagagacggagttttccatgttgcccaggctgatcttaaacttctgggcttaagggatctgccggcctcagccttccaaagtgctgggatta

SEQ ID NO: 110950 - DNA, 1346 bp, Homo sapiens
cttttaatgttacatgcatttttaaaaaatagccctttttctcatatgtgcagacttagagcaagactgtaaatccctcagcacccaagccttgatgggtagagtgcggcggccagtgttgcttcattaaatggtcagctcggagcctgcctgctctttcctcgtttgctgtgttcctgtttttggtgctgcttatgatctttgtcttgtatttctaactgaccaggtggcctcttcaggaacatagttgtcctcctcactgcacacctccttatccactctgcttcagttgctcctactcgagaactggctggacgcagttacctctggcttactccagtctctgcctcttttctctctagcttcttggttatgccacctgcaataaattgcagctggctgtttccacagcctctggaagggaagatggaaggacagaggagagtgaaaagaaagaaggctgtcatacagagaagagaggctacaacttgaaattttatactgaaagatgatctggtttatgaacatgatgatgatgtgtgtagtgaattttttctagtgtatatgccaaggcaatattattctcttgactatgggattcattaagtctgttgtatctgtcatccatgcttatccacatgtcaaggaagtgaattaatttcagcattcccaagatagaagtgatagtatatggtaatttacttacagcttataataatgagtgtcattatttgattaaatggatattactaattaatgggagttgccatgtcactattgtaatgttaaaaaaaaaaagacctttcagaggttatttcataattattggtaagtaagccattctttgtcctggccttcctcccatgtattcaatgtgatatgtacactttgcacacaggatttactgacatgtcatttacttaaacagcagtttcttaggtaccctaagtcctggaaattgtcagttgcttaaataattaaatacaaataaatcagctgtccacctaagctaccatatacatttttgtttaaattctaatgtaatttaaaaggcatttatttaatttttagcttgttttcatagttatttcagggaaatgaccatcttgatatggaaatttttcttagaaattaattgatttcacatctgtataaaataatcatcttgattatttttcttgttggaaaagtaatgtttgttataagaaattcagaagttatttatttacttcttgagacagggtctcgctttgctacccagactggagtgcagtggtgccatcatatcccactgaagcctgaaactcctggactcaatccttccatgtcagcctcccaggtagcta

SEQ ID NO: 110951 - DNA, 1625 bp, Homo sapiens
ccaatttttaggtttttaaattctgtatacatcctgtgtggccttgggcaagttacttaattgcattgcaacttaagttttcccttttgtacaaaggagagcatacatgagaattcttctgaggatcaaacgtgtgtatgcaaaggggctgcaagactaggcctggtctataaggattgcttaacgtccgtttcctttcttaactcaagctactgccatgccttttattcatctcttgacttggtcttgtttttattttcccttatgcttacatattaaaacctgattttcaccccaggccatcagtaaataacctccttttaccagacccccaaacctcatttcagtcatcagcctatttcatttttctgcatcttgtgttttgttttgttatgttatgtctttattcttgactaacaagctactatctccacttcttgattattccatcttctctttgctacttctcttccaatcttaagtattgtgatttgcagtttttgtcttcctcttgctgtattctttgactttatgtctgtgtcattagtgtggatgtttagattcgcattttaaaaattcctactggttgttctgcaggctcattaaacttgccttttccaaaacaacttgttctttttaccacctgtatctgtgataccatcctataaaatagacttgatatctgttatagtgctgttgtccatctggctgccacaggtaaacgttaacttcagtaacttccttatttcctcccactatcagtttttcttattttcttattattattattattgttttcgagatgaagttttgctctgtcacccaggctggagtgcagtggcgtgatctcggctcactggaacctccgcctcctgggttcaagtgattctcctgcctcagcctcctgagtagctgggactacaggcgtgtaccaccacgcccggctgattttttgtattttagtagagacagggtttcaccatgttggccaggatggtctcgatctcctgacctcgtgatccacccgccttggcctcccaaagtgctgggattacaggcatgagccaccgtgcccggcctgcatccattatttcttatcagatattctgcgttctcttctttttgctcgctgccattgccttactctccaggctgcttcatctcatagactattgtcacagccatgtcaacttccccagcccacatatgcttacttcttttttttttttttttttttgagccggagtctggctctgtctcccatgctggagtgcagtgctacgatctcggctcactgcagcctccacctcctgggttttacgccattctcctgcctcagcctcctgagtagctgggactacaggcatgcaccacctacgcccggctaattttttttgtattttcagtagagatggggtttcactgtgttagccaggatggtctcgaacttctgaccttgtgatccacccgcctcggcctcccaaagtgctgggattacaggcatgagccaccacgcccggcaatgcttacttctttagtctgtagttttggtgtttgttctgcatgtgagtatttgggggtttgtagggggatctggtcacctaattttgttgtaaatggtgccc

SEQ ID NO: 110952 - DNA, 2052 bp, Homo sapiens
gcttgtaatcccagccatcccagaggctgaggtggaaggattgctggatggcagatttggaggctgaggaaggatagctggagattaagagttggagaccagtctgggcaacataggaagaccccatctcttaaaacaaaacaaaacaaaacaaaacaagtgttgcgtgtgtctgtagtcctacctacttgggaggctgaggctggaggatcacttaagcccaggagtttgagattgcagtgagctgtgattaaaccactgcactctagcatgggtggtagagcaagaccttgtttctttaccaaaaaaaaaaaaaaaatttctttagaaatttaagtaagcttttgatgttttcacatacattaaaggatatgggtaggtttttctctttaaaacactgtatatgtagtttttttctcctgataacaaaaataacaaaatataaaaaggaaaaaacgtaattctaccaaaacacattaacattttaaggtatatttatcctttcaaagttaaaaataacttttaccacctccctaaattataaatatattgtaaaaaagcctaaatggtagcgtagtgcttccttgcttctgcccctgatggtctttgtttagcgttttttgtttgtttgtttgttttttgagactgagtgtcgctctgtcgcccatgggcgatctctgctcactgcatcctccgtctcccgggttcaagcgattctcccgcctcagcctcctgggtagctgggattacaggcgacagccaccatgcccagctaatttttttttttttttttttttaaataaagacagggtttcaccctgttggccaggatggtcttgaactcctgacttcaggtcgtcctcctgccttggcctcccaaagtgctgggattacagacgtgagccaccgcacccagcctgtttagtgtttgatgcatagtattttttagatggctattgaatgcatgtaaatgcgtacataatcttttttaatcttgttcttccatctgtccttctgttggtcctcctttcctctacataaattgaattataccaattcagcagcatattgttcttcttgttgcttgggtggttaaacagtatctcttctgtagctctggctatccacaggtgtggctccccatgcttactggctgctttgaggttgtttccaacttttttttttttttatactgctgccacaaacatatctgtgcatgtgtgaaggtaaccaatatcttgatacctttaagtggaatcactgttttttccatgaggttattggccatttgtattttccttgtgaaatatatacttataattctttatccttttttttttttttttttttgaaggacagggtctcactctgtcacccaggctggagtgcagtgctacagtcatagctcactgcagcctcaacttcatcggctcaggcaatcctcctccctcaccctccccagtagctgagaccacaagcatgtgccaccaggcttggctaatttttaagtttttgatagagagagcaactcaccacgttgcccaggctgtctattcatttatgtcttttctcattttgtatataagcacttttattttccacatattacttttgtcaattctatggttttttccctagtttttcatttgtcattcatttttatttattttttgtcatacaggagttaaaatttttaggtaggcaggtttgtagtttttcttttggctttgtgtttttttgttgtttttttttcatcttcctcaccctaacattatggaaacattcttatgtgtatttttctttcttttttttttttttttttgagatggagtgttgctctattggtaggctggagtgcagtggcgcaatctcggctcactgcaacctctgcctcccggattcaagcaattctcctgcctcagcctcccgagtagctgggactacaggtgtgcgccaccatgcccagctaatttttgtatttttagtagagacagggcttcaccatgttggccaggatggtctcaatctcttgacctcgtgatctgtccacca

SEQ ID NO: 110953 - DNA, 1431 bp, Homo sapiens
tcctttctcccatgcgtggttaacttagtcatctgacaacacatgattgagtgtgctcactaaccagacaagcctctcagtccaggcagattatagatctgaggcaggagagtaaagttgaacagggaataggtttatgtggaattttttttgtctccctgtttcactatacaattttggaagaagggtttgtgcaaaaaacacaggttgctagtcatgaaacacattctgttcaccactaattaatttgggtagtatctctgcttcacttttcttcagtgtaatggtatctctgacatgctagggagcttaggaaaatggttctagcattatataaatgacaggtattgctattagcaatgactcaagattctcatgttttttggtattctacatgtcatccattctttctattatactggagtacttttgttttatgtaaaactgttgtataaatgtcattttaaagtctctgctgtcaaattttgttgttattctaagacagcagctgtggatgtggcttaaaaactgatgagtttctacaatgatgagcctttatggagcaatgaaaggctgcttgtaaattgtagccacacttgcaatgaattctgtgtttgttattgtgaatccctaagggtgactgttttttcagcagggcgagttaggacggcacaaactgagagtttctgttctggtaatctttacttcttatgactttaaggaatttggaatatttttgcttgactgttgtaatgaatctctaaacatattatttggatatgtgggcagataaattgtaagatatgttatagacgtggtttctgtcatcaaatatttttgctcacagtagctactgtgtgtaatagcatttatagatgatgctttacctctagttactgcctaaagatataaatattgggttatttgaagctacatatttccagcttatacatatgaatagtttaaggcatagtgtatgtacccacttttatttcagaaaaatacaggttgtttgtttgtttattgttttttttttgagatagaatctcgcgctgttgcctaggctggagtgcagtggtgtgatctcagctcactgcaactgccacctcctgggttcaaacgattcttgtgcctcagcctcctgagtacctgggattacaggtgtgtgtcaccatgcctggctaatttttttgtacttctttctttcttcttttttttttttttttttttttttttttgtgacggaggtttgctcttcttgcccagactggagtgcaatagtgtggtctcggctcactgcaacctccacctcctgggctcaagtgattctgctgcctcagcctcccagctaggtgggattacaggcgcccgccaccacactcggctaatttttgtatttttagtagggagagggtttcaccatgttggcca

SEQ ID NO: 110954 - DNA, 1639 bp, Homo sapiens
gaaatgacttttaaagcagaagagaaaaaaggaagggtggaatagcaacaatggaaacaaatgaggaatcctgctccccaccccacctcaaagcccactgtatatgtggggttatggtcagtatttctggtgttagagtgtatatttgcaaatctctgaactgtttatatgtatgaatctcatcataatagattcacattcttcttaaaggcaatgcttaacatgtttcctgatcataagatgttcatattgaagattttaaaaaaatacaggttgaatgtgctgcttaaaatgagctgctgctttatttttaaacatttaaaaaattttgttaaatttagtctcgttcttcctacaaaagagcttaaactttgacagtaacagctgttcttttgtgtgggacatgttttcatgaggatttttgtgcacattaaaaataaccatttttgtgaatcgtagttattattcatagtcactttataagagatataaaggttttccagtgagttacttctgattcataaccaaattatagcagagcagatgtagactaccagtggaataattagccaaaaaatattagggggctagagatctctttgtgtaacatttaactttaatttcttggacagcttatatgaataattaaagtgttgaggcagttaaaatttattttcctctcttgggatttcccagttgtcatagatagctgtagtcactagggaagtagaaatattatttccagcaaacagatggctttcctcgtattggtccccaaaagcgcctactgaggtttgtgtttctgttggatgatttcctaatcacaccaactcagtatacttttgaaagatcacacctggtaacagaatatgatgtaaatattaatatgacttagtgaacttgagagcatccaaaattgtaagtttatatagttcctacatccctggggagagtagtctgtccaatgagaggaatcgcctggtagctagtactttacttttcttatcacaagtcccctttctgcctcagttgtactctcagggattcccaagctgctacttctgctttttaactctcattaactctgtcatctacgtgctattttcatttctgcttagtcagatgactaccccatcccgtactttgaggcattggtaggtttttgttagaattaaggataggattctattatgtatggggaagattttcagagaatacagtgatgctggggcttaaaatgacaaaatcacatcttttctaagctctataatgaagcttttttggagatttcacttgttactaatctttctctttttaaaatgtctgtttttcttctcccattggaaattaaaacacacacacacacacaaacacaaattgggaatctacatgtatatttatgctagtgaaatttcaaaaatagtcaagtattagtgaagtggccacattgttggagtaaatacttgggggttcatcatctcactcccaaaaaatttaggacatggacatgcacgaggagttcaggagtggaggtttaataggcaaaagaaagagaaagagaaaggaaaacagctttctctctagtgagagagaggggacttccagagaggaaaagactggcgactgcggatgtactgga

SEQ ID NO: 110955 - DNA, 1645 bp, Homo sapiens
gtgtatttttagtgtattaatatatacaaagttttgaattataaatgtgaattttgatgtaaatacaattctcaaaatattaatataatccaccaaataagttaattttaaaatggaaaattggatataccaaaaatcattttagattcttaatatcatttagcggtgaatgtgtgtttttccctatcctgcctggaaaagccattcctaaatattttcttccattcattcaacaaatatttgtgtacctactgtgtttaatggcatatcagatatacctgccatcatgaactttctatatttagcttatcaatcatatattcgaagtacagtcgtaacattttcacatatttagtagtttctagtgcctattgtgttgcgggctttggtggtaaagtgatgataggtttacagagatgaaagacaaaagttatacccttgggacctcacagcataaaggaaggagactgtagtaactagcatggaagcggaatgttttctagacagtttcataggtgcttttttttttttttttgagacagagtctcactttgtcacccaggctggagtgtagttgtgtgatctcagctcactgcaacctctgcttcccaggtcctgcctcagcctcctgagtagctgggactacaggtgcgcgtcactatgaccagctaatgtttgggttttttttattttttttttcttttggtatttttagtagagatagggtttcaccatgttggccaggctggtctcaaactcctgacctcaggtgatccacccaccttggcctcccaaagtgctgggattataggcgtgagccaccgctcccggcctcatagggtttttaatacacattactgaagataaaaatagagtgcaactagataaaataaagatttgtagttctgtgaaggatacatttgtctggaggagcagagtgtaggaaacaatgtgatatcctttcaggagtgagtgtgtgtgcgtgtgtgtgtgtgtgtgtgtgtcacattcagagccattaggttgttttaaggaggaatgggaaggggccagagggatggactaatgggctaaaatcatcagtttgaaaagacggttgtggctacaggcagagatttcactggatcaggtctcttgtttctgttcttcattagtttcttcccacctactctggtagagttctttcactatatataattctgtcgccattatcagctttctgaagagtgacctacattttatagtctgcattccccacaatctacagtaaatctaaatcttaaaaatacataattttttctgacagtggattgaaagattttcatcagttacatctactctttcaaccaggaaatagtttcattttctccttagcacttactttttagccctagctgggaaactttcatctttattctttacacaagctgttccacatgcctagagtggaacagcttgtgtaaagctgttttcatctacgtctttcctaggaagctctttttatggcttgcgtgtattaaaaatttgccttatcagtcatcttaaagtaatttaaattgctttatgacagtaaatgaatatatttattgatcagttatcagttttactttgtgtagcttgagtgttctttcttgtagctacatga

SEQ ID NO: 110956 - DNA, 1024 bp, Homo sapiens
atttaaaaaattaatattgtgattattgtttatttaacaatgtatgtatgcagttattcatgtgtttgtggtatatagttttgctgttacttgtggttactagtatagtaattctagtcttcgtaatacctacttaatcaaaaaccttttaagtttttatttttataaaattttgagtgatgtaatgaaaattttcttaattatatgaaatcttggaaacctgattttcatactgtgtgtttggtattaaatgttctttttaaagagtagtagaagtgagtgaagaatgctgaattcattaatgttacatcagattcagaactctcttttaggtaataaaagaaacaatattgggaagacaggtttaaataaatcatgggtagataagtgtaatagaaatacactggtatagtccatgatttttgtcagttagtctaccttaatgttaaaatccttttggtatgttagcagttatattcttaatggaatttagttgttaaagtaagatgaaactgctttatattaaactctagtctataacagtgatctaatcaagttccaagatagaatcatctgcttattagccaaggcaatcaattagttcaatcaggaattttatgtctgatgggacagaatagtatccaccctccaaaaagatattcttggacataatggtttcaggatagtgttcaatgtgttgtttacaaaattgtttctttataatacttgctatctcaactttaacatttctttttggggtagcacttgagaatccatttgttttgttttaactccgcagaggtttttgatgtacagctagattgggaagtcctgttctatttggaagacttttttttttttttctttttcattttcttttttttttttttttcttgaaatggagtcttgctctgttgctcaggctggagtgcaattgtgtgatctcggctcactgcaacctctacctcccggttcaagcaattctcctgcctcagcctccccagtagctgggattacaggcgcg

SEQ ID NO: 110957 - DNA, 2251 bp, Homo sapiens
tgctttgtttcaccagattccccctattccacattaaccccttgtcttctcccagattatccaactcttcctactcttttccatagcgttgttttggctttttggcattgtaagaggattgctttttttcccccttaagttatgtttactcacttcattgtcactgctttccacctcatactggttatcctgttggaagcacgaggttttgtgttgtctctctgtggaatttgtttcttcaaagctttgtgtctttcctttggttgtcatcatgcatgatagcagcgtgtattctttttctttggtaaatttctccgcctagagtgtactttagaaggaaactaaactgcattctagtttagttggccccaaactgagatcagtagccagagatggcacccaagggtggtgaggggattaaaaatgcctgtagaagtgttggtggcagcagctaagcagctagattaatcaaatgtgcatgaaatttaactttaaataaactcctttgttgttgaattttctgtggaaaaactaacttgagtgagaaattctagccctggggcagggataggccagagataaatgacacaaatatgcttataaaatggggggtgactgggtgcaagcagaacacactgaaagcattcatatttgaaataaacagtcactatctctgtagggagccaattttcaatccttggtctactttccaaatctgttctttcccctaccctcattagcagattttgcttattttgttgactcctgtaactccatcccctgggacagtgaatagtcataacaggtattcagcaaatattagccaaatgaatgaacttttgatactactaggtttttaagacatgcatctatcttgtcatggcagaacaggtcatactcttatttaccaacctcttaatttacaaactgagagaatagctagatatataagaaggtaatcttattttgaaatgatttcaatttctagaaatttgtcatcactgaactcttgtgaggtggggattggtacatctgaaggccaagaatatctgagtgtgttatgctaacaatgaatcaatattgcgcttacaagatttcccttaccaaatgatttacccagtcttcacaatagctctgcagattgctaacaattaacattcctattttacagagacggaagctctagaataactataaaagtgttgggattttttctttgtttgtttttgtagaaaaacctggattttgaggaagcaaaatgtggaaagagtttatgtaataattcaccagatttttctcacagtggtagatatccaagtgtgagattatttgattgtgatctatgctcatattccacagaagaaaagctctgtatttcaactaaaacatttccatatttggggctgaccagatttggtttgttaggaggtggacagttgcccttttatggtcactagatactccattgctctcttttatttctcttcaacttggtggctgtgacactccctcaaacaatcttttctttctcttttttttcactgctcttttgtactccagtgttctctgctttcctccctctctcttccaacctaccagcccctttctctctcttctcctcccattcctcatttacatgcagcctgaacaaaccaaagagtttgctgtacattctgcctgtaaaagaatagtatgtgaacattgcttttgagtcagcgaactgggcaggtcaagtgagaagttatctgaccaacaaggatcaagtcaggaggatgctgggaatagcataaatcttagatcttaggagattgtccaaaaaggagagagctgatccaggatgagtagtagttttcagaataaaggccttgtcaaatataataactggaccagtggttttaattttggagaaatgctagaaccaaaccaaaacattgataaataataggaaaaattaacagttagaatgactccctttcaacttgatttttgttccaaagttcaaatttttacttagaattaaggttttcttttcaatctgaaattcttctttatatcctgagctcctaacattttaaaagcacaggtaatcaatttgttaactaataacattatgtttaataatgtcattattttcttaaacacagtggtatattattgttactatagtaaagaattgcctgggtgtaattgctggagatctgaacatggtgtatcacattttccaatcaattagttttagactcaacaaaac

SEQ ID NO: 110958 - DNA, 1012 bp, Homo sapiens
aatacaacatggacggcagtgcaggtagctttctatatctagctatggttagcccatcacaatttgttgattgcaggtaagatttgaaagtaaatgcttttaggaaagaattttaaggaaaacagtttttacccattttaagaaaacacacgttttatctatttttaatgagtataagttgtacaatatacattttaattatgaatgttgaaagtattggtcttaaaaatgatttttaaaatttctagcagccagaattgtaaaataaagagacctagttctatggccatgtcctagagtcagtgcaaaccttgcgtttttagcagtttatttttggtgtctttcaagaaaatgagatatatatatatatgtatatgtatgtatgtgtctgtcctttttcttcataaactcaactgagatcacactctatcattgttctacaccttttcacgccacttaacagtacatcttctaccttgatatttccccttaatggctccatggtttttcatagctttcataccacttttaatatttcacattgatgaccatttaggtcatttccaaattattgctattattttaaaaagctgttacacttaaagaacgatggggacctacagaaggatacaaaggacagtttgaaggggaaatctgggacactttggttatcaaggtaaataatgatagtaatggattaaaacctgtataataaaacaacagctttgaagtctatactgagataattaatctcaggataaatattatttatataaataaaagtcatttataattaataaatggggcaaagaggatagcttttccttacagatgcatgtcgcctaataaatgtagaaggacaaaaacctggacaaaatatgtaaaaaccgttttccaggtattgaacatcaggtatagaaggataagtgattcctgagaaactgggagtccacagagggcaagacagttagcagggctgcaaagtggagaggaattaactgtataaagaggt

SEQ ID NO: 110959 - DNA, 1081 bp, Homo sapiens
tgacagacccttagtaacagacccggatctatttcacaccaaagctatacccctaatcactaacggtatgattttgtcctcacaagctaggctacgcagatttgaatcctcactcttcagtatcatcttgggaaagttacttaacctctacccagtttctaaaatgtacataatagtgttaccctcaaggtcattggttatgttaatacatgcttagaagagtactggaagagtgattgcttaattttagctcgtttaatgattataattaaaatctttgtagaaagcatttgtgactgcctcggatattatcaaataccaagtttgtgtcctgttttacccgagttgtcatgaaagggatagaaatgtaaaatatggatcttgcctttaaagactttgtagtctatttgggaagacaagaaaaataaacatgaaacctgacaaacacaatgcagttactgctaaatgatgtaatagagactacaaatacaaatagaatttagtatccggaaatacacttaatggcttaaaactattcaaatatatagtagctcttcaagttttgtgctgggaaattttgtgccagttttgtcaggatattggccttctcttggctttgcttttgttttctttttctttctttcttttttttttttttttttgagagggagtttcactcttgttgcccaggctggagtgcaatggtgcaatcttggctgactgcaacctctgcctcctgtgttcaagtgattctcctgcctcagcctcccgagtagctgggatttcaggcatgtgccaccatgcctggctaattctgtatttttagtagaaagggggtttctccatgttggtcaggctggtctcaaactccagacctcaggtgatctgcctgcctcagcctcccaaagtactgggattacagccgtgtgccactgcgcccagcctgcttttgttttctgattcaccctgaactctatgttcagtcacctgactttgcaacacctcaaatccctcatcatgttaccctctccagactgcatctctggtacccagcagtttggtctccctattccctcccttg

SEQ ID NO: 110960 - DNA, 1055 bp, Homo sapiens
actgaggaagggaattacattattaaactacaaaattactgcattttattaactttataatattttagagccacattagcagtgtatatgttgattctagttattctggaaggtgtaattgtggtttgagttacatcataaattccaaagaatgagagacagtttcttatttttaaagaacaaggaatagaattgaaaatgagcagtattcattgtatcattgtataatcttccaatttaatttatggatttactttgctttattgtttttgtttttaagatttgcttatttaaaaaatatttataagcattcctctcattacagagcgtagtaatgatgaaagatttcatcaagaatttcacctctgtaacagtaatatttgtatttgtttttagggaagctatgcgaaattatttaaaagagcgaggggatcaaacagtacttattcttcatgcaaaagttgcacagaagtcatatggaaatgaaaaaaggtaagattatttttctggtggatagttaattgtagttaccacatgaatttgccaattatgtattaatatacatgtcagaggatggcttctattactgggttcatttgctagtacaaaataaaaaataggggatttgtctcctgaaggggagaaacaaagtgaattgtggtatactgttaggaatagataattggtgctgtgaagaaaagtcagcatggagacagaggacctctcagcaaggcagtctttactttctgcagaaagggtgcccctcgcagatggaacaatggagagagcacacttgaacaaaggaaaagcagacatatttgtcccttacgcatttgggtcatccttactgctgtgtcctgcatccattggctggagctggacctcacagtattaaactgatacctgatttgctactaacataaaactttcctaaatacgttaagtgcaagggagaacaaagaagagaggaagttgcttacaaaaggtttaagaaagcaataacatttccaaataaggaaggggcataagctatgagctaagacttgcctgggcct

SEQ ID NO: 110961 - DNA, 7451 bp, Homo sapiens
ttgcctctaaagtagtctggttagggttgagcaaaaagtaggttccattaatatattttcagtcagttcagtagataatattgtagaggctgagggggaagcaaacaagaagtagatactaccaccttcaggaagacctgagcaccaaatccagcctgctggtgtctgcttgtgtgtgcacatatgcacataaagtttttttcttttagtctgcacgttgttggcctacagagtgttaataagtgtaaattagttgccaaatttaaaaaaacagtatttcatataaaatttgatttcagtcatctattgaacaattggaggacgggaccaacactaggcctgcatgcccatagttcagccacgtgagtgtgagtgggtatatatacactagtggctgattatcattgcatttaagctctgggttttcttatactaggattaagaaaagtaagccattttctgtactaataacagtacaagaagtgagaatgacaatggaggctgtgtgtttcaagaaagaagagaaggaaactacttctttgggtaactaaaggatattcctaatttttttttttttaagacagagtctcactctaacccaagctggaatgcagctgcactatgacagctcaccacagccttgacctcccaggcttagttggtcctcccacctcagccaccagagtagctgggactataggcgcctgccaccacgcccactaatttttgtattttttgtagacatgaggtttagccatgttgcccaggctggtctcaaactcctgggctcaagcagtccgcctgcctctgcctcccaaagtgttaggattacaggtatgggtcaccgcgcccagcctggatattcctgtttattgtacgcgccgttcacccatttatattacttatgtggctactatagttaattcgagttttcaggccctctagagagatatggcatagatgttttaaagtgtgtacaagtcaacattataattgagcaaaggtgaatttacaccctatataaggactggattgatggtctgaactatgtaaaatatgagccttgagctaggctttgcaatagataatatttttaattgctaaataaaagattataagaaaatcattctcagaagaacttgtgaaggtggtttttgacaactagcaaaacaaacctgtcatattctgtgagttgaaagaatacagtgtattgttctttgagcatgagatatttctcagatatctacagcgcaccaggtgttccaagtgtgtataaaattcaaagatatataaaacacagcactgctcataatcaggagatccatgtatttttggctcttttgcttagttttattaatattttggatgtttctactatggacaatgctctaacacaattttccaggttaattaccacattaagttaaatgcagtatccataatagtaatgtcactcattaatgattgtgtcattttgaataggccttaattagtaattacagatttttgtggtggtttatcgtgttttgtaatatgttagagtacactggatttgctgaactctggtaatttagaactctgagccatacaaagagaagttctgtactctaaaaagtatttaatctaactgtatgcataactccaatattttgcctgaacagatttagtcattgtggaagtcccgatttctgtcctgtgggcatgattatttgcattacaaaaggcttcaccaaaatttttcattggggaataggtgcatttcaatatgattttgtattcataatgttcaaggaaaggaaatgctttattgaatctaattgatttttgcttcttgtttttttttttcccctattattcttcaggtttttttgcccacctccttgtgtatatcttatgggcagtggatggaagaaaaaaaaagaacaaatggaacgcgatggttgttctgaacaagagtctcaaccgtgtgcatttattgggataggaaatagtgaccaagaaatgcagcagctaaacttggaaggaaaggtaaatcaagactgctagttcaccagaaaggggcaccatggtaccagaatgtagttttcatattcatttttgtggtggagatttttttctttaataactattggtaacaatttcttgaatatataaactaggaccaaaaaacatgcctctcatagctttggtctagtcactcatgaagcttacgctgctgacattggaaggtggcatgcagtaagcttccccagcttgcaagcagttttagcagactataaatcagatttctattggaagccagtaataaatttaggaggctgattgctcatcttctgtttgacagaggtttatcaacaaaaatacattgttcagtaatgttttactctgctattttaatcttagttttatactagacacgatgatatatacattgtggaaagcatttatctgggttataacgatcataaacgtttacttgacatcagagtgaagcagagtgatactgtagacaagaacagccacagttggctttactcaaattttagtgcgtggcaggggttcttcaattaattttctagagaaaacaatctatcagctagttttactgattatattgtatgaatttagaaagcagtcaatctagatctttttttttcttcccccgggacagggtttttactctgtcacccatgcagaaatgcaatagtgcaatcttggctgactgcaacctccacctcacaagtagcgggaccataggtgtgtgtcactatgtccagctaacttttttgtatttttttgtagagatggggtttcgccatgttacctaggctggtcttgaactcctgagctcaagcaatccatccacctcagcctcccaaagtgctgggattacgggtgtgtgccaccgtgtccagccaatctatacttttagtattgaaagatagttttttattcacttagaatttagctatggttttatttttccttgctactgtactttggaaaatggttagttctgatctcaatgactaaacatcttctaaaatagcgcataaacagctgtttcattatttgatacatccttgttgaatattttagtgtttgctatgttgtagttggcactaggtatatgggttgggagtagtgttggtggaggtgagctaggggatttgtactctcaaattgaattttagtgattttacagatagtactacaggtcttaatgtcaacctccttcaaatttagctgtttgtatgtcatttatatctttatagtttttgtaagtaagatttgttgactatgtattttaaattagatttgggataatacttattacaataaagattgtttcatcttaaaccactaaaactatttctaaattatgatccctgagctaaagtaacgaatatatttaagtggtgggttgatctaatagatcttaagtcttgtctcatctgttttcttgttacctaggaagtctcagagttatatgtctccaggcttcacatgtagacattcagtactatgaatgagtggatcagataggtagtgagaagccagggattctagctacctgtgtgtataactgtttaatcctacttcattgctcattttaaccagttccagcttccagtaattttaaatgaggtgataccaaataaaccaaccagtagtatcactgcttgcctttcgcagcattgtggcttagtagtgccacatcctaattttgtacctttaggggctgcctcaacatggagatctttctgctgtttttcattatatctttcttcaacttccactagtataccctttccccaaggcctagaaactggcagaagaggaatagaatacctgagagcttgagcatttaactagtatttaaaatacctagtaataggttagtacaatgtctgtaagccaaaattatatgttaatatttaattttaaggaaaaattctattagggaagtttatgtaaagcaagactggtgagagttagtagaaggcatcccaggcagaaaaaaaaacaatataatcatgtgcttagagcataaaggtataagaacatggttttgaccaaggtaggcaaagatgtcctgagcagcggattctgagcttcagtgagaggcactttgctcttgtctgcctcacttaaactccattcgtgtaaggaaatagtctgttcattgagtggtacaattagttattgagaaatatgggatattcattttgcaatttttggtgtttatacttattttaaatattcactgcaacaaaattctagtatatctagccctttaaatttatggtcatgacatttggctgtatgtaggtaatatgttggatcttagattttgtgtaatgtttttaatttgttaaaaaaatttacattttttatagtcacagctaggtaagctacgcaacaaggatgacttagttaacactcttgtgtttttcttatttttaaacatcatatactcttggtaacattttgtttctataatttaaacatttctgcagtatcactttgcagcattagatttggtatttcttctttctttcagggaaatgtcttttattgcctaaagatcttgttttcaaagagtatttctagagagatgattatatgccattttctcttctagaattccgttagctaatttaaccttttgcaatagcaaggcaaatgtaattttagttttatttgcttattttctatgagtcagtgactttttccttcttttcttaatggaatttgagtagtttgtggtcagtggccttatagttttttaaaactaatagttcccataaaattatcttgattatgatttttgtggattcaaactactcattgtaattagggatatatttcctttctttccaaggagatatatgtgtgtttgttttttccgaacaaaatgcagttctttttgtgtaggtcttatgatccaaccttcttggttctttttttccgttcttgtttgccaatatgtcttatttatgctggatttcagtattttctctttctgatatggatcttaccttttaattttaacactcaaaagccatctcaacatttttaagctttcccattagaatgtaattaccttcatttagatataaatttcatttttgcttcccatgactgtctgctttagtacattgatacccattttcatagacctcgtcttatgttgcagaagaatttcattgtttaggcttaatttgaccttcaatgctgtctgtcacttttaagagtatggccgacctatgggtatagcagctcacagatgccatctctgagtgcgttagagatcttgggtgcaaggagtgatgtgactgcaaagtactgttgttttttgtttctttatctttattcattttgagacagggtgccaccgtgccgcccaggctggagtgcggtggtgggatcacggcccattacaacctctgcctcctgggctcaagcgaccgtcccacctcagcctcctgagtagctgggactacaggcatgcaccaccatgcctggataatttttgtgtttttcgtagagatggggtttcaccatgttgctcaggctggtctcaaacttctggacttaagcagtctgtccaccttggcctcccaaagtgctgagattacaggcatgagccaccaccctggcctgtttttatttattactatgattggctttatcttatttttgccttctacagagcaaaacctctcaaagcttttaccaaacttttgatttttaaaaacttagttaaatgtataatgttcaagatggcatctaaattttcttatatagctttgctatgagaaatacaataaactattgcagtagttttgtctgctaccgaggctgtctgtgaataaaattttaaagataaaaacctagaagtcattaactgtttcctgagtagcatttgctctgctttttaaaaggaagatacaggagaggcagttgaagaaacttgtttagcttaattttaaagtggaatgttgatcctttaaaaaatataattcgatactttagatacttatgctgtgtttcagcatcatttatcttatctggaaaaggacaataatttagacccctccctgattcacagggatcaagagaataggaaagattttagaattgttatatataatataagcagtagcattttgaagggtctttgctgtttgtaaagtgctatatctctttatcttttcagttatcagaatttaaattctggtaaactgacataatgccttgagcattttctctagtacctttaaattcagttcttctggtgatacatatgaatcgtccttttgggcaaagttaaccattttaaaaatagttctttaaagtaatgcttatataatctctttctggtttaagatattttataatcatccagtttgtctatcattgttttcctcaatcttataagtgattactctagtgttcagctatataaagaaaaatattttatgcactattttgagaagaactactgctaaaatcttttacataatttcttgaattctgatagctttattattattttttttttggagaaagtcattgattttttttaactgtaaaatttattttaaaagttactgctgtaacgttgagtgataattccatgatacagttgtagagctatgtaaaacaagaaaaggctgtttttttaaatggtcttttaaagaggatacaatagatgacaatgtttgtgttctacagactttataaggaagactttgtacttttccgaaatcaatttcagtaatttttatagttgataatttttagagttggttttatcagctatcccttggaattgttttacttattacttaaaccatggccattctgagttttaggtactacataaacaaacaaggttttgctgctgttaaaactttacttttctttcacagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgactgtatgtatgcttttcttatttatccccaactgccaccatgaattaataagacagactcttttttaaattaaaaattgccttttcaatagccaattaattctttactaatatttttgtggccctctttattgtctctctttttttaatcgtaaatcgacagtatgtggtctaatgaagcagttcttaaccagagttggttccttaatgctcccagggacattctggggaaatgggagattttctccttctgttgttacagtgactggagggggtgatgttggctttgggtgtcttgagcctgtggtgctgaattgaatgtcctgcagtgtccaaggtag

SEQ ID NO: 110962 - DNA, 1120 bp, Homo sapiens
cgcccaggctggagtgcagtggcaggatctcagctcactgcaacctccacctcccgggttcaaccaatcctccctgcctcagcctcctgagtagctgggattacaggtgcccaccatcacgcccggctgattttgtattttttagtagagatgaggtttcgccatttggccaggctggtcttgaactcctgacctcaggtgatccacccacctcgacctcccaaagtgttgggattgcaggcgtgagccaccatgcctggctgagactttcaaatttatataaaagggagaaattagccacccagcctcaacaggttttatcaattctgtttcattatctccatcaccaccaacacctcttcgtcttctaattgctggagtattttaatgtaaatctcatcctatcctttcaaccaaaatttctgcaatagtgactaatacatgcccttttttttgaaacatcattatacgtaacagttgacagcagctcttaagtgtcatctaatatcctatttcatgtacagatttatcagattgacccagaatgtctttttatagtttttttgctttgttttgttttacagtggtttgttcaaacatggattcagataaggtccacacattttagtctgtaatagtttcttctcaccctctctcacctttgttttccttctatgtcatttatttgttgaagaaactggatcatttttcctgttgtggaattccatattctgggtttggctgattatatgtttctctgtctctcttactttccatgaactggtggttagacataaagactttcagaactgattggtaagatatacatttatttccattggattggaagtcataatatctgattatccccttttttttttttggtcatgttgagattgattatagtagttcagctgttgtaagtctattccacccataaagttcctcagcaaactttaacctaatggttttaatagtcattgatgatgtttaaatccatttcattaaatgctgcaaaatggtgatattctaattttttaaattctaacttctgcattcgttagctggagttttttctacaaagagggactttgccatatcagctatttgcttcaattgt

SEQ ID NO: 110963 - DNA, 1061 bp, Homo sapiens
tcttggaaagtgaaaatatttgtcaaactgttaaatgataagaaagaataattatacactgccaagcagaatttccttcttttgctccctccccaccttctgctccaatcacataaataagagctgttttttctttgcagtatgcattgcctcaggaacaaaggtggctctgtttaatcgactacgatcccagacagttagtaccagatacttgcatgtagaaggaggtaattttcatgccagttcacagcagtggggagccttttttattcatctctgtgagtataaaagtgtgcatttaatgtttttagtgtgaaattgttaaaatcttttgatgagatacatggatatattaagttttgtcatttgcctaatcataaaataaatttaaaaagatgacaatttgatttatttttccacctactgcagtggatgatgatgaatcagaaggagaagaattcacagtccgagatggctacatccattatggacaaacagtcaaacttgtgtgctcagttactggcatggcactcccaagattggtatggctctacttttgctttagtgataatgtgaagtaaaaattaatttcttaaacaggaaaatcacaacattcaaatggaaaaacacacctcagttttatgctttttaattttaaaaggtatgttagtaatcagtgctgtttataattgacagttatgctctaccttatttcagaaatgctttaaggtaatagccagtttttacaagtacattcttaatgattttttcttaaatgatttccaatatattttggtggcaatttcctttttggctgtttatctgaagatgttcagtagagggcactataaattacatttcttttctttactaatgcggataaaccgtattcatttttttgtggtacctgccatatcccaatgtaggaccaagtttgcaaacagaagacattcttatttcttttgaaatataagcgtaatttttgttagcttactctctcacaagaagatagatttattaaaactgaaataaaattggtatttctaactgggagcagggca

SEQ ID NO: 110964 - DNA, 1521 bp, Homo sapiens
agcagttgtagtggcgtctttgagataaaaggttggagagattgcaggagattggacagtgaggaagaggcgtttgcagaaaaacaggtagtgagagggagggacaggagcatgtagtcagtgttttctttacttttgattttgagatgagagatagttatgtttgtatgttgttggaagtgatcaatagaaaaggaaacagagtaaaagttctgtgtcaaattttgctcttcatcatgatcatctacttagccattaccttctaggtgtcaagtgtcatatagggtttgatagtattatctttcagatattcatgtgttttgtagactagttgcgttataagctttagagatcagttggacaggcagccagccctgggatcaggacatattctggtccttcagctactaaactggtaattttgagcaatttgtctgacctttctaagcccattttgtaatctgtaaaatgagtttgattttgttatgtttttaaatacgtaagttttggataatagatataagacgtttgcactgacagtagccttctagagatttttccctttgatgttggagtatttgtcattttatgcatattattggaaaatatcattagaacttgctgttcaaaatatggtctgtaggccagcagcattaacatcaactgggattttgttagaaatgcagaatatcaggccccacaagagtcctgctagatcagaacctgtgtttttcacaagaaccccagctcatttatgtgcacattaatgtttgaaaaacactgatctagaaaacaagtgcctgcctgcctgattttttttttttagatgttcagggaagagggtaacagtttctacattctgacatgcttgcaatctaaaagtgttttttattcctagtctttttgtttgtgaatgtttttatatatgtaggcataggacaaataactgtgatgtattattatgcagtatatagcttctatgtacttttgatgttttacacaaggaaaatcctttccatgtgtggatgaccttttatttcttaattgttaaatatagataattaggaaagttgataagcagaccgcattattggatgcagatgatcctgtgtcacaactccataaatgtgcattttaccttaaggatacagaaagaatgtatttgtgcctttctcaagaaagaataattcaatttcaggtatgtttttaaattactggtgaaatctaaaatgtacaaactgtgaggttagcagcttgcaaaaatatgaaattttcatttgctgttaattatatacaaatacatgaagctatacacagatatttatctcaggtatgagcatccttaacacacaatcctcagacatgcaagcaatccttcctcaaggaagaactcaaaattatgaaaatgttctcagagaaaacagttaacatctagttccagggttcttaattgaagaacaaagagcccctcaggatatccaaaaatagattttcagtgctcattgaatcctctgaaattgt

SEQ ID NO: 110965 - DNA, 1781 bp, Homo sapiens
tccctggtctaggtgtgttaaggtaggggtaggggctttgccttcccatcttgattccctcccatggaacatgcataagcttctagctgttgcctaagcatgaggagtcccattgtctttcttaggagtccttgaagagttttaaacagccatttacatcacagatattgatctgctgttaatgaaattgtacctgcattggtatactcataatggttgttctgaaaggtattattatttaatatgtcactgaaatagtttgtattataagaaaaactgctgtctatggggtttctgtattagcattctgtttgtgtttatgtagggattggcaaagcaccatactttagaaagtttataagtttttactgagttatcttcttattaactcttgtctgagggttacttggtaaaattttcttatcctattaatacaaactgtataaaacttagtttctaaacttctttctttattaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcaggtgagaacgcctagtccaagttggccttcagctctttgcagctactctcagctgtgacctggcatcatttcatttcatgggagttttgatttttctccaatcgtctgattaggggatttttatatacaccatttgttgatttaaagaaaaaaaaacaaaattaggaggagcgtacttgccagaaaatttaaatgtaaataaacttgtatgttatcttgaaatgtttttagctagctttgtaataaaaaacattttaattgcccttttttaaaaaaaacaaatgaaagttgaatgagaatctaatttgtgtactttaatgaaaaatgaaaagttttctcagtgttgtgattttctgtgaattgcagttgaatggcggtggggacgtagcaatgcttgaacttacaggacagaatttcactccaaatttacgagtgtggtttggggatgtagaagctgaaactatgtacaggtacttgataaaactttttgcatcatccagaggttgtgaggggtgtgggtacaggagattctttcctggcactgattgtaatgtattaaacaaccttgtgttaagtctcatttttaacatgtactttgctttttaaagtgtttttaagtgatttctatttcctcctcaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaa

SEQ ID NO: 110966 - DNA, 2904 bp, Homo sapiens
tagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgttttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgtaaatggtgaaatgggctttgtcactcaagg

SEQ ID NO: 110967 - DNA, 1116 bp, Homo sapiens
cagctaatcatcacaacatcctgcaaactgggtgttattttacagaggcggaaactgtaacacgtttacgcaggtagtgtcagagcctaacaattcgtggttgtaattcgcagtatcattgcgtgccacagtcctgtttctgcagaaattgagaggtggaagagaatgatcctttatatagtaaaacgcacaattctccgtgtcccccttgtgcatcagaggcgctgtggctctgaaagaatgagctttcttgcctttcaaccatagacaaggcaggaacaacggtgtgaaaagcgtcctccccgccccggtctttttccgccggcggaacgcagatgctgtggccttcaggcgctgaggggaccagagagggacggacacaaggctcggcagttgcctggtaacgcccgctggaggagtcccagtgtaataaggtcccggagaagtgtcactggccctgagtgggacccggtagcccgttcgctccgcgccggcggcctgtccccgcggcttggcgggctagggcaggggaaatgttgcaggaggagtcggacctctctctcattattgcccagatagtccaaaagctcaagggctccaatttgtactctcagctggaacggcaggcctgggtaagtgaggccgagtgggaagggatgcagacgggcggggccgcggcgatgtctcttcttcaccctcctcacccaagccagagctcgcctctgacctctccagctccgctctggtgctcaaaaaacaaacagacaaaaacaaaaacaaaaacaaaaacaaaaacaaaacaaaacaaaaaaaccccacctccctgtccggtgcaagctgtgctgcctcagccccaggcgtggttaatagatttttaaagaagggtggggcgcatcacacctttttttcagaccagagaaacgcttactcatttatctattcctgtagtcatttacagggtctaattttttaagctgctggactcactgaaggtagcttggaccatgccttccctcactttttccgtcctgtgggtggacttgggcccccaagtacctttctgctttctcgtcaatgtatcactttcttgcagtttaccctccctgcaattattcc

SEQ ID NO: 110968 - DNA, 1002 bp, Homo sapiens
ctgttacttgtcaattacttattgaatacctaccatgtggcagcaccgtactaagcactgagcatatagtatagaacaataaacaatttctgccctcatggagttcatagtctaacagagttcccaagtctaattgcacgtctgctttttttttttttcctttactgctatcactgtatttatgtctgtagcattctctagtgtttaacattcccattttcaagttgacctttccagtttgttaactgggaaatgacataatgcagcttaccagaattgtttctaaaataaagagactcagatgaacccctatgcacatgtgctttagatacaatttttaaagaattagcatttgcttctttgctttgctcaaatccatcttcccagttggatttgaattcttaaataatgttagatataagtgctatctaataattgaagttgactgtgaccatacctttagcagtactgtgacagtacctttggcagtcaccaaaggaatagatatttatcatgacaagtaaggttttaaatttacaatatgtactaaaggtgcctgttgtgtataattccaaacactggattctcaatctgaggcaatattactgatattcctgaaaattgttctgtgtgacctactgaccttttacttgataggggagggactatgttttattcattatcatattgttggcattctgtacaatagaactttaagtatatattttctgaataactcgttgggatttttttttaagcagtccagtgatattatttttattcctcatttgggttctgaacaaattaagaaacaagataaaacaaaaaagcagatgggagatcaaaattacactttcattaccgataaagactagataggaggacatagcttagtatgagagcaaaattagtctttcagctgaactccagaattaaatggatttaaccttccagtcaaatagcattggatcaggggcagtatgttcagtttattcttctcaa

SEQ ID NO: 110969 - DNA, 1045 bp, Homo sapiens
aaatggtgagaactctttggaagaatttggcatcccactgtaatgcttaccaaaggtataccgataaagggcattcttcccaccgcaaggcacggtacttgaacttgaaggatgcctcctgagtaggaaataatgaattacctggttttataatagtgcttaattgctattttttttccaatgttatattcaggtattactttgtttttcccgggatacatctgtgttgagtcactttgcattcaacagtgcctcgccaccaaaatcatacataagaggtaaatttttaataattttaaggaagtattaagacttacataatcatgccaagaatatttgttttatttttggagatagtggtgttgccaaattattataaattacttaagatttctctcagatgaccgtaattatcctttcatacctcaaatcagtgcccaagtaatttatcacaaatcacgggaaagtggttcccagaagcagcatttcaagttactttctctgtcttccctgtgtgctctaccctttattgttgtttttatgtcatatctgttgacttttctttttctttctaagtttataacacagatttgctttttctactttttttaacaatctatacttctctcaaaacgctccaccacacacaaaactttgatacaatttatatgcttttagctctccaatgtctagtttagttatttttctcctctttatcaccagctgcttataaaatatcaatatcctgccatcatctgaagatacaattaacttcagctgaatgcccttcccaacttttcctttttattaaatggtgaacacccaacactgaaagctcagacttcattgtgtatggtcattctgccatttccatgaagaaagaaactttctcctgtatctcttatgtctgaactatctgcctgattgctccacctcctaccctaggagaggccacataaccttgtgctggatttcagctacccctaacataaggttttcttaggtccattgcttctaaattgaatttatggaaaccttttgtttg

SEQ ID NO: 110970 - DNA, 1083 bp, Homo sapiens
aacttgaaagcgtttgttcttttggttgttttgtgtcgcttctgttgtacttatgttcgtgttactttaattgatgaaagggtttgctaataccaaaagattggctggtacatttttaagttaatttcatatcatgaaatgacatatcagtttatagtagtttttaaaattccgttgttagtacattcacaaaataagttgatttttaaagatttatttacttaatcatattgaaatcctctatggttttctcttataggaaaactaggactggaagaatatgctgtcttttacccaccaaatggtaagagtaatgctattgcttcctctagtgggaagtgaaaaaattacaacttttataatcaaaatgtgactttcttattctctttaatggataatcatttattatctaaaataaaccttccatagaatgtataatttaatgaaatcctccacatttgtggtaggtttgtgctaaattatgcatactctctctgattctccctgggaccaacagtaaacctgtgagaaagctgagtatgcttagatctaagtccaaggcacttcattttcctgtgaagaacactagctaatccaatgcagaccttccttttgggttttttggagctgggctttactcaattgagtggattatcttgtattgcaccttattgttctcataatttgaccaatgtagtatttatgaaacaaaaatattattaaaaggtatcactgaaatcacctattttgatgttataaagtgatcaaatatataatgacctcattagacattaaatattcttttgagataactagacaggttttaagatatgcttcttggaaaagcaatatatagcagtccttatgataatattaagttgcatcctgaagaagttcttttactccagcagagttaagaacatgggttttgtaatccagcagacttgggttcagatcccaattcttccagcttatcctatgaccttaagtaagttacatgacttctctgaacttcaggttcatcatctgtaccatgtggataatagattacatgagatatggtatataaaaccacaaagtgcc

SEQ ID NO: 110971 - DNA, 1041 bp, Homo sapiens
tagttagtgcttggctcctcgcaggtgttcagtaaataaatggccgttgttgttataattataatcatcattcttctttgttagtgaaaatcaagtattgatttgtcacttgtttgccaatttcatatttggctaattatcagttataatagtacatattttctttgtattcaataaaatgatcctttggcctacaatataagaatcaaggaaaagcatatatttaggagttgaacattttaatctgttctcttttggctgttcctttatcatatcttttttttcccttcccataaacctgactaagagcagtatttattttatttcagttatgctttttttccccctttggacctgctgtgggtaacatgactgctactccaggtgaaacattcaattggaatatatgtcagggctactaaatttccccaaagaggcaactgtattattgctatgaaattaaatagctgttctttatccccccattctaagcctatatattcctatttcaccttcctccatctccagttttgctttcatacatcgctagtgaaagttggcaaatcacagaattccaggatgttacagataaacaaatgaagcaacaccagttatcctgggtttcttatctctaagagaacttgattttgttcttatcttactttaatatttaatctggaataatcagaaatatgaccaataattaagattaataattcttttctggccgggcgtggtggctcacgcctgtaatcccagcactttgggaggccgaggcgggtggatcatgaggtcaggagatcgagaccatcctggctaacaaggtgaaaccccgtctctactaaaaatacaaaaaattagcctggcgcggtggcgggcgcctgtagtcccagctactcgggaggctgaggcaggagaatggcgtgaacccgggaagcggagcttgcagtgagccgagattgcgccactacagtccgcagtccggcctgggcgacagagcgagactctgtctcaaaaaaaaaaaaaaaaaaaaaaaagatt

SEQ ID NO: 110972 - DNA, 1140 bp, Homo sapiens
cagttgaaaatatcccaaagtgtagacctttcctccctggcaaacaaacctgttctgtggaagggctgggcaaaccaaacatgaggcagatggaaaggaacttctgtgatgtgacaccaagataaataaaggttatgagcacataagcattttggatgctgaggtcaattagtgaactgctctttttttccccttcttatctacctttggagaaacagtttcccactgtgtaaaactctttcctgctggagcagaaaatttggccagactgtcaagctttcagcaactatgttcaattatatacaaaaaaggaagtagtaatcatactctttaactgctaaaatgcctgcactatataaaatatgattccagatattaggaagtggtaaaaaattgttggtctacagaaatagttttctttgatattcttgtaaacatgaaactcagtgactttaaagtattcatgttttcttcatttcagttaaggagtaaatcctttgttgcagatctcttgtatctactgttacatattcactaactccagctgacttgacttttaaaattttaccattctcatctttttctccagaatttttctctctgacgagttctaatgcttttttgcccgactgtccaaaatctctagtcccctagaaaagtgcctgtgcttcccagttactggttgcacttggcctttatctggggaaattaagagacctggctgctgacttctgttccttaggcacaatgaccaggaccactgtagcagcatccttcatgccatctctggaaagccattctgatagacagcagagccaatgatttttaggaaagcacacagattttcatgtcagagatgagtagttgctgcttactttcagtctcaatagtatcttcacatagtggttagatgcacaactccagagccaaggttgagtattggctttactattttctacctgggtgcctctgaacgtgtcaccccacttactatgcctcactctctatattagtaaaatgggctattaatagtatttaactcacagaattggtatgagaatgacttattctctttgtaaaaatgtattttaaaaaatatatgtgtttgcattaggtatgcagtatacctaggaaccagtc

SEQ ID NO: 110973 - DNA, 1037 bp, Homo sapiens
gaggatgtttatgcatcttgtaactgaataaacattagttccatctcaaaatgatttcctgcagtcagttactacttacactagaataacaggactaggattcataatgtatgcttatttatagaagcaagttgaaatgttaaacctgttataaactcatgctaccttgtatatttgaagaagactgaggctaacatccaggttattttctacagcacatttcagcattttgcacatgtactaacattaagatattctgaaaagagaaggaaagttgtagctttagtattaagatttaggacaaatccaaagaaggagcttagtgtcaaaattacattgtaattatgtttaccttatttcatagacttcgctttgctattaataattctttttattttttgtttcaggcagttcttgctgacctttctactttaaaagttatgcctcttcttcagatttttctgtttgctactgtcacctgatcttcttcacagtcactggcaacacatctagtttttcattagaaacaaatcatgaactatgcaaactctgcataaaaccaaaatgaaactttgcatataagccaataaagatcatgttccctcttcagttaaacctaagtagtttctcactttttgaaacaataactctgcaccaaatattgcatcgcatgctgctgattttcaagagagaagcaataaacacaacttctgctaaattgagcattatatatataatattataatatatatataatcctgacttgtcaatggcatgtaataatatatgcaataagaactaaagatactgtaataaacttcaagaggtaatgtagcttcttggataattcttttatgtcagtttataaatttatctctagataatgtattgttttgtctcataaattgctcctcactaagagccaggggtggggtagggtgtgagaacacttgaaaaagataatgtttttaagtaggaattcaaaagttgcttaaatggtgttttaagcaactttttacaccccagggattttctac

SEQ ID NO: 110974 - DNA, 1084 bp, Homo sapiens
cagcttcctctgcttagaatgccttctcttccctctttacctaactcttacttgtacatcaaaacccacctcaggtattgcatcatcagggaagactgcttctcttaagaatccttaacccctacatatacataagatgtattataatcaagttagcttgtctttcactcccactagactgtgactccttgaggacaaaattggattccttttcagccatatatctctagaatctagcattgtgtttgccccataatagactttagtaaatatttattgaatgaacgaatgacatcatctattctaattcactcatttactgataaaggaatttgcggagttgcctttggaagtccaaaaggaaagaatattttcagaggaaaaaatgaaatggttcagtcactcttttttttcatttaagttaactttattaagtataatttatgtacaataaagttatatgtatattttatgtaaaataaaatgcattttaagtgtacagttctataagtcttaacaaatgtatatacccatgtcaccaccaccacatcaagatatagaacatttccatctcccaaaatagttccttttgtgcccctccccatccaatcccccatacacgcattcactccaaccactcatctgcttctgtccctaaagattagattcatcttttctagagtttcacgtaaatggaatcatccatatgtacttttttgtgtctggcttcttttgcttagcatgttttgagattcatccatattatgtgatagtagttcattcctttttactactgcctaggatttcattgtatgagtatttcacaatttttttatttaccattgttaatgtacattcatgttgttttcagtttgggtgtattatggatacagctactataaacatttgtgcacaagccttcatgtggacatatatcttcatttatctggggtaaataccttaggagtaggatttctgggttatgtgtaagcacgtgtttaacttagaaggaggcctccaaactcttctgaagtggttctactgttttacgttgccaccaacagtatatgagttccagtgtttc

SEQ ID NO: 110975 - DNA, 1046 bp, Homo sapiens
tggggctatcaatttggaagttgtcagcctatagatgatatttaaagctgtgagactggctaagatcacagatcagagcatgtggatggacagagcagccatcagaggggaccctcatactaggtggtctgggaattcagaagaaccagcaaaggaggctgaaaagaggtgaccactgtgagacaagacctagcagaatgtaatgtcctggaagtcaatgaagagtattccagaagaggtttatgcatttttttttctatgctaagaataaactctttttttttttatcctggttgttgtgtgtaacgtaattagttcatttccattgttgtataatattccagtatatgaataaaccatacttattattaaaaaaaagaagaggtttatacattctgtcagtttctgctgctgaacagtgagctgagggcagataacagcattagatttggcaacgtggaaactactagggacttaacagaagtgaaattggagcaaaagactgattgggtggattcaagaaagaataggatgagaagaaatggcaatggcaaatttagacaccactttttgagtgagttttgctataaaggaatctgatgaaacaggcccagctggaggcgaatatggggtcaggaaaaggccttaaggtgggaaaagtatatcttaattgtatatcaccagaacatctgggatgcattggctgaagcaacctgcgtaagcatacgatttctttgaagtcttaaagatgcacttgaatttttccttttattctgaacaataatctgttttaatttataagtactctattctctccaagtccttgagtacaatggatcccccagaagaaacatactgtatttgtcctatttccctgcagtactgcaaaggctatgcatacactagtctgagaagctgggttccagccaggccttccaggcctctgctcctgagcacagctccttcctgtcctccttcctctaccctggccaggctgggctctttgcagccttcctgtttttccaggaaaatgggcctattaagga

SEQ ID NO: 110976 - DNA, 1090 bp, Homo sapiens
ggactgggctgattttttttttttttttttttttgaggctgctagaaaaagtcagcagcagcattgcggtattgagtctacctctggtgctgcttttgcaaaggcagctggcagcgagtctcaccggttcaaagctccgcttgagcacagcgtcccaggggagcctgctaaaggggattctttgagagccataatacctagtgatattagtggttccgtgttagtatgcagaaatgcctaagtttacagtgcattttttgcggggtggaaggaggccgttttaagtggtgatggaaagtgtttggtggtgggagcatcactgggtgacaaagggtgtagaaacctcagcaggtaaccagaaattatacctaaaatttgcaaagtgcagcatactcggggcttgcagctggcagcacagttctgatagactgcactagcaccttttttttaatatatagaacgatctcataattgaaaacttggaaacgtgttttgtaaggttaagtgcagaattgtatcctttttaaagccttccggtgttatgtacaactgatcagttgtggtttaagtaaaagttattatataaggaccctgaaatgatttctttgggaaaagtaatggagctaaaataatggtttttttttttttttttagtatttcacttatttttaaagtagatctgtagatttcctacaataattgtaagactaaaaagtttaaagtggcagaagatgacccgtgattaatttaaccaaaatgatagtcctgcgggcgtctggaagttactaacagcttctctgacaagtgctcaggaactgtattctttaaagccaagcagtttctctgatttctatgataggatatttactattctagagagaagaaggatgttggtaaactttaaaagctttggaggatgtagagtatagaacataatggtcagcatgtttaactttaccctgaagcatatcaagccctattaaatggaacttgatacatcaaacctaccaattgggtaactgggataaagtgattatagaataatcagtattaggagcatagtacagtttgagtgagaagataggtcaga

SEQ ID NO: 110977 - DNA, 1048 bp, Homo sapiens
tgaagatttaatgcctcatgcaggaagggaaggagcaggaatatttaggcttctagaaggtataagtggttctaggtttctcgagcagaaaaatgtggttaatacataattggctaatgctctgtgaaaaagtaattggtaaaaaggcaagcaattcagaaaatttagtatttattgactgctaataagtatattttatactgtgtagatcacatcaagaaaattggtcagatggaattttaataagccatttacaatcccttttaagacttaaatttctctatacttatttaaggcatgggggaaaaaggtgattcttattggaaaaaaatccgatgtatcacacaaaatgagtttgtgccatagggctttaaaataagtttgctagaagaataccctggaattatttctaacgttcttttactttccttttgtcagaatattgatttttaacaagttaaacgtttccacttaaagtttaaatcataaaactacacaatatacaaattaaattgttattttaataagtttatgtaaatacagtcaatagcacccatatcttggtaaaggtaaactgaaaatctatgatgaagttagaaaatattgaaaatttctttgaactatatggcctctatagggctctttcccattcttaagagtgtatgaatagtgctttcttttatggttctatttgtaaatgttatgcaaagcctagaacctaatttattagcattagtgtacacttcaggaagtaaaaccgtagactgaatttacaaaatactgtggtgtggtatcatattgtaggcagcgttaatggatagagatggagtagagcatcagtaataagagaactaaacgtcacgtgaattttgaaaattgaaaatttttgaaagcattctgagagaagaattggtctctttgtctcctgattaaagttgtgatttagctgtgagtattctcaatagctctgcaaaatgacagccaaaatcacttttctgttttcttctcgagattggcatttttaatacttacctttagaagctcccta

SEQ ID NO: 110978 - DNA, 1082 bp, Homo sapiens
ccagtgcttttcttcaccagtctttggtcattgctgtagttgtattattgttgctaactacaggattaaagaatctcttcatatccatttgatctagtcgattctgaacatttaagaattgatagtaatctaattggtctggaaacattgcatcccttggtactcttaagaatacatggcagaactggcctctgttgggaatctcatagaacaggaagcattcagagggccagttagaaaagtggatccaagatttagcttccttttatgcaaaaggaggacacaggatgatttagcttgccaaagacttgctttgtggctggatacatgctagtattttcagattaatttaggctctttttgcgtaatgatatcaaggatttttgatagtggcctaatcattgatgataattgtggtgtgaacactttcacaatgattgttggacgtctgcatttatgtaatatgatagttaatgtatatattggctaagctaatactaaaactaactgctaataatatggataataagccattttttgacatttactggagtttggacttcaccttgttaagatctacctaggaatttacttctgaattgatcagattttattaactaaataattattaagtacaagcagcataacacaaaagagaagtgggaaagaattaaaaaaaagaataagatgtaggtgtgaccattttggactcagactaggtaataataggcacatttattaaactgttcctatgtgttagtattgtgctaagtgctttttatattatacatcactgtttttgattctgagactaatcctgttagatagctactgtttttttttttccttctaacttttattttagattcattttagattccaacttttattttagattcatatgcaggttcattgcctgggtttattgcatgatattgagattttagttaccaacgatcttgtcacccaggtactgagcatagtactcaatagttcaatagtttttcaacccttacccctcctcttacctcccccacaagtagtcctcagttttctattgttgctgtctttatcttcatata

SEQ ID NO: 110979 - DNA, 1688 bp, Homo sapiens
ccttagctatgaataacaatatttcagactactggcatattacttgtttcaatattaactcctaaatttcattgttgtgtgaatttcaagcttaatctatagatgatgatttctaatgccaaatctaaaaggtttgttctgttctttagctatctagatctttatattagtatacattggatattcagtctttcttgacactgtctaattctaccttctgtaactgttttccttgactggtttcattgttgctgattttaagggtggttccctcttaagtctctgttctcagcctcctcttcctctagtctagctgaacatttcctcctcagagaacttcattactaggaaagttctaaattgggggtagggaaccccaggccaatgattgatttgatttttggctttatttcctttggcccttggtgtgctatagcacaagcatcatggctgcagtcccgagagtaatttcctttctactaggctttgtcagccatatcctttaaagtgaaacaatttcaggattaaggctaggagcagttgcagaatgtttaataatgtctattcagtgttttcataagatagtggtaactcccctccagtacacacaggctgattggagccacagagcctggcaagcgcagtttacttggactaacattcatctcagagcccaagtacctgtatctgtccaagtgtttctttttgcgtatggatttgtttttttgtgtgcttatggatcttgacctctgtgtaacttttttctctagtcattttcattttctctacctctttttgatcttcctaaacttgacattatatggaactgaaacacctcaaaaactgttttgtttaattaagtgctgggattttaatttaaaaaatgcttgaaatgaatatctcatttatgtgattacagaatactaaacagccttatcataagcagcctcatcaaaaccccctagggtagtgaaagtgatttgtagtttcttacaatattctcaataagtaaaaaggctttttaaacccttgtttgaagtttttgtctcctactcagcacactgcaagttgcacaggcccatgttttctattactgtcttttttttcttttttaaaaaatctgatgttggataactagataatcttaatcccccttctttattcctattgtccagcaatacatctctaacgttttcattaatgacgtgtatgtaatttttgctctgtttccctgatgccttgaaccattgtcatgtttagctcttatttctgctttgccacacatattcagactgtattaatcctcgccgtttctttcttctgggtaccacattaagaaagaaaagctaaagtgcaattataggtacccctggctatttttgaatttgcatttgtaactataccctctgatgtttattccgtgtttgtttggggtcgtacgctgtagcttatgcctgtaatcccagcacttttcgaggccaagatgggcagatcacttgagcccaggacttcgagaccagtctgggcaacacggtgaaatcccatctcctcaaaaaatacaaaaaaattagctgggcgtgatgatgtgcgcctgtattcctggctactcaggaggctgaaatgggagaatcacctgagcctgggggaagttaagtctgcagcaagccctgatcaggccactgcactct

SEQ ID NO: 110980 - DNA, 1086 bp, Homo sapiens
tataaataactataatttaaaaaatttttaactgatatatgatagatgtacatgttttcaggtatcattcctttttcactcttttgtatactttattaaaaaacaagcaagcaaacaaaaaatttcagtgagtcccatgtgccagacaccagttgggtgtttggaatttcaagatcagtaagatattcaccctagcttgtagtctactagaaggcatacccacttaaagggtgatgatacattgtgataagggtaaaagggcctaaggctatgtgctgtattttactgaattgcaaagatggagttactaattttgatgtggagatgcaggttattagtaggttattagtgaatcctttttttttttttttaaatatccagagtaggaagtatgtgccgagaatgtatgagtttgtcagacagagaaaggcatggtggaaaaccataggtgtgaagtgaggaagctgggtggggagtgagattattataggcattgacatttgagaatgctaaatgtggttgtgaattaccaaatacccaggatgacagagtcaatgctgggcctgttcgcagtgcagcagcatccatatttgcatgtgggatttaaatttttgccaggcattttgtatgtttcatccaatttaatccttagagaatccctgtgaggttatctccatgagttagtacatataacagaaatttaggattgctctcaaatagttcgtactttaaaaaacccccctgtgccaaggatctttatgttaaagcataaggtatatatggagttgaatcaggaaatgaggctggagaagtagcagatacaaacattgtgattaatgttacattgtagatctttattgtccaatggccttatgagtttctccttcatttacttctggtaaataacaaaattttgctattaaatattctgaaatcttggaatatgactcctataaaatatatctgaggcccaataatttgtcctttttaaaattaaactttgactcgatttgttcagtttgactcggcttttcagtaagtgcgtaatttctgtttgtgctttgttttcataaatacaaggatgac

SEQ ID NO: 110981 - DNA, 1050 bp, Homo sapiens
gagaaaactaaactaatgaaggtgctgctgtcataattttacttttaatgctgtggttatttgttgggcaaatgtagttttgctacatgcagtatgtgatcttagaataaaattggcagcttcttcgtattatgattgctacgcgttccagtactcactagtttgcagattcctttaattgaagctgaatggcatattggttttattgattaatcttttaactcatagtatcagttatacaattcacaatgataaatctctttgagttttatacaaagcatatccatattcttaacttactatcaagtttaacttagtgtaatcgacctaaaattagaactcagatctattaactccttgttttgtgttatttttgccatatgctatatagtattttttatgagatctgttcaaaaatcttatagaaatatgcacatatgccggtcctctgaatgtaaccaaacttatatatgaataatctatgatgagttgtttaaacgtgtttataaaattatctggtaacttttatagtgtactaaaaatttagttttacgttttgaagtctttaagtttgttttcaagcaggtagctggtagtcatgatagattcatcataagccctaaatatgttaataattaggattattttttctttatattctagattagtaaaggagtaggaagcctgtatgtgtctcaggcctctaatttatcatataacaacgtgagaacactctgtaggaatgaaaagataataagtctttgtattttgtcagtcttcaagatttctagacaaatgggagctgtttttagttaaatacaaattcccaagcaagacatgacatatttatagacaattcctttctaattattatggggatgttcttgaaaaatcttatactagcagaatttcaaattgaaaaacagacctttgggaaaaataggctttagagatactgtagccccacaaaagcccttactaatatttatattcgctaaaagaaagtaccatagtaatcatttgcgtgttctgaattagtaattcagaaaa

SEQ ID NO: 110982 - DNA, 1021 bp, Homo sapiens
gtggactttacctaggtttcctttaactcagggttgcattttaaaagtcttaaaactcgccctgccttgctttactcttatcaatctctagatcccttctttttccagttactctaacataaaaagtctcacaatagtggaaatgagaaaccataaataaatttgtgggtattagaattttcacaaagtggaattatcatcttagaggatttattaaatttatatataatagtttttgtaactcataaccaaatgcctttatttaatgtacttgctgaaaattgacagttttttggccaaagcagtatagtcaatgtcttcattggtttagtggcttttggcagaaaactatagtatgtgtttaattattggattatactttacagttcaggttttttctgtctcttactgtctttttttctgttttagactatttgagtttattttcatgtggagatggtaaatagaatgtcatctttttataggtgatagaaaatatttttacattatctgttacatatatactttccaatagttatttcaagctgtatttttttgtattaaccttttgctttgacttgcctgatttaaggtaactataacttaaccaattttaagagggctttctgacctctttggatcttggttgtcttttgttaattttggaaaatcttggctattatcttttcagataattcttttttcctttgctttctctattctccctttgggacaccaattaagtatatgttagactgtttgataatggtgttcctttatggtttctttattttaaaaaacacaccttcccttttttttctgtttcagtttggatgacttctgttgacctaagttcatgaagaatcctgtcaaagggattctccatctttgataaattcttatttttaattttagcattgccatttgactctcttacagttttcgtatccctgctaaaatttcctgtctgttcttatgttgtccagatcctttaacatattaatcttttcctttacctttt

SEQ ID NO: 110983 - DNA, 1058 bp, Homo sapiens
tttttttttttgtatttttagtagagacggggtttcaccatattggccaggcttgtctcgaactcctgacctccggtgatccgcccaccttggcctcccaaagtgctgggattacaggcatgagccactgtacccggccttgtgtgtcttttctgccatggggactgatgatcagagaagcctgccctgaagcatgagaaagaggggagggttgggagggaaacagtgtgtgaaatagaggaataaactaggctttataaataaacttgcatgtaaatggtatattatttgctaactcagaatctctttgcctcaatttctccttgggttaaaaataaagagataatcactatctttcaaggtcatggtaaggattaaattggaaacatatgtatgcacatatatacctgtcttatattgtatataatttggtgttcagtgaattaggtatttttttcccttggaaaacagagggattggcacaatgtcttggaattactgtattatagaaacacaggaatgaggtatattagtatatgctgggacattgcctgaggtgccgaaagtgtataataagttacattatggtgggcaaagcagtttaacagatccattctttgtaacacagctgcagtaaaaatagaattgtataattaaaataagatatgaaaagactctttgaaggttaatttaaaaatgaaaatttactgctgtgtttattaatctctttgaaggagacttaatgctgtatcaaatgttccttttgtaattgacagaaacaaagcaccatgtacagtgttagagtgtgtagctgtgctgagtgagccatgtaaatctgcaaggttatgtattttggtatgatggtgatagcttattttcatattatatagccatgaaattgatcctcagcatttatcttagtctttgaaaagttactgtgaacagtagtattatcagattgttacctgattaatacgtcacaaatggatgagcctctcagcaaaccaaggaagttatctcaaatgggactgaaataatggtattagatacctgagttc

SEQ ID NO: 110984 - DNA, 1043 bp, Homo sapiens
ccccatctctactaaaaatacaaaaatgagccaggcgtggtggtgggcgcctgtagtcccagctactcaggaggctgaggcaggagaatcgcttgaacccaggaggtgtaggttgcaatgagctgggatcatgccactgcactctagcctgggcgacagtgtgtctcaaaaaataaataaataaataaataaataaaatgaaatgaaataaaataaaaaaaatgaaataaaacatttgaaaggtatagatgaagttagcaatcatttaggggaacttttagctaacaatcagggaaactactttgtttttgctagggtccaggtaaattagcaggtacttcttatgcaaagtgagtgattacagagattcagagttctaagaggcagtcatcagtcagaaggagttttcaccaaaggtcctgtattttctgtttagaatagtacttaagccataattagagaacatctgcagtggtttctcagccctctgttggtaaagtctgtctcctttaattgttgaacttttgaaaagtctgaatagataatcagagattatctagagtcttcttcctgcatttttatagcattcctggtatagcatttggtatatctagtccagttacaactttccctttcttatttgctgttctagcatgtaatatatgctctcaataaatattagtattttttgaatgcctatcatcatgtaacaggtaacatgtataaaaggctgaaactcatttttctctaaaaaatatgcagcagcttttattatttatgcattactctttttggagaaatagccattaatcctgttatgtgctaggtgtttgtagtatgctagatactggaaatataagggaatactaggaatatgaaaaagactttgccctagagagggtatcagaagagaaggaagacattattcactttccttttgagtttgaatcaggtctttgatatattgaaaaatgacacctgaaaattttctcgagaatttactctgaaaatactcacgttgaatatttgaagtattgaagtat

SEQ ID NO: 110985 - DNA, 1021 bp, Homo sapiens
ttgcattatggcgggagagttagtaagcaaacgaatcaactcatatactgccctgtgataaagtgctgtgaagaaaaattaaacaagtagaaagagtgaaggagaaggctatcttacatagggaaataagacagcctctgaggaggatcatttaagttggaatgaaaggagttaaccaaccatggatatatttggaagaaagagctttgccaatggaggaaactgcaagttagggctttcagtgaataatttattaatgtttttttctccttgattgtcactttaggataatctgtagatccctccatgatctggccttcgcttatactttttctgttaattatctaattaagtgggaataatgcctactttgtgggcaaagtgaaatgtgtaacacttaatttttatataagtatattttatgcaatataaatacaaggatgctccatattcatagttattatcacccttttgttatataataatcattagcttatgttcttgcctatccctgtcttcctagagagcacttgctcatctttcaagaatcagtgtaaatgtcactttctctttgaagcctttcttgctgtgcatgtagacatgactattcccttagttttgtcaccattgtttatttgtatatctgtcattgtatctgccatctttatttatttgtttttaccttttgtgtacccagcttctaacctagactctggcatttagatatttgctacataaatgaattgtatttagaagctaattcatttggcttctaatatttacatatacttaaaccattcaacaaatatgtcactgtggtagatactgagaataaaaaattaatacaatgcatgttcccaatcaagtttagggtaaagttacgatacaatataatatacttaatataatggtttgttcaaggggagtgtaaattaaagtggagatagattatctaaaggaaaagtaaggcaggaagtatagatatgtattctagattgtgaatatcattccacaggtgtct

SEQ ID NO: 110986 - DNA, 1067 bp, Homo sapiens
gtttaaattattcaaaatgagataggcactctatacatcttttagaagcaagatattaaatagaaaaaggttagggccaccctaatacttctcatttagcttacagagtgagaaaggagggaaagaagtagatgaaaatggagttggtgtagttccaagaaattgctctaaggagtaaataaattgatgctcccttgacaagcagtattaacttaacatgaaaacttgttagaaatgcaaattcttgagccccaccccaaccctactgaatcagcagcttggggatgggacctagcaatccgttttaacaaatcctctgggtgattctgatgaagtttgagaaccactagactttcaggactctgatagtagccagaagctctttatcttgaccttttatgagtagacagtatagttacaaatcttactttttttatgattaggtctttgaaaatatggttcatgacttactctttgtaccttgataaatcttaaagttttgcattatatttttacagttcttttaatctcaggcacaatatttataaatataaatactactgtgatgctcttgcaagataccttgttttctgctcctgtattttgtgactttacttttgccaagttcaaccttaaaaatttctttgtatgttttataggaagtcattgacattcagttactataaagcagggttgtatttgtcttttttatgtgggggaggatcttttggtttttaaagtaagatggttctgtaacctagatggttaagaatcattgtgcaagttattgagacagattttaagaaaacatctgatgattttatattagaatatttcttacttaaattgtgaaacttctacctggtcccagcatttatttagtttagtacttatgtccttatgtcctgacaattatagtaacctatttactggagtttcttctctgtctcttgcttttccagttcatttaccaactgctgttgagttatctttttgtttatgacatttgataagagctgatcctcccagagcatttgtggtcatgtatctgcttgtccctcaaagca

SEQ ID NO: 110987 - DNA, 1040 bp, Homo sapiens
ggtgactgtatacacctatttgttatataacttagaataatacccggtaaataataaacattgactaagtacttctactgctgttgctggtggtggtggcgttacgattagtagcagaagacatttcattaaatacattttacaaacatgtaagaataatgtgactacaataccaaaaatttgccagttactgtttgaaaatagtcacccactggatatcagatttcatctttttctctagttgtcaagactaaggtaatgaatttatatttaacttaatgttttctcttctatagttcatcagagaagatatgaaatataaagatgctactaataaacacagccatctgcacagagaagataaacatataacgattgaggatttatggaaacgatggaaaacatcagaaggtaagactgcctttgtgatctggccccctccccttctgcacatctagcctgcttagttgttctcaactcacttatagtatgcttttaccaaaaaaatcaaaataacatttctgtgaggatatttatattttagtaaataattttcccttcttgtttttgatagatgatttttatctttctgagagtcattaagcatcaggctgttctcatataattatagtagaataaataagataatgcatgtctgagagcctaaagttgtaaagcattatttcagctattacgtgacattattataaaaggtttagcaaataaacatatggaaacacaaagttttccttttagttgtggagaatagttcctaatgtttttaggaggctattactgttaagctttttcttaagtaaatcctttatgatgtctcgtaataggtgtatgataaaattggataattggtattttattccctttctactgttaagttctcaaggtgtattatggacagtaattgtttagtacaggaaaagtctgtgatctaaaaatctcaacttggttccatatactaggaagttactaaaattaaaaaaattttacaagtcccctaaacttacattttgttttcagtaact

SEQ ID NO: 110988 - DNA, 1044 bp, Homo sapiens
aagacaaagaaaacaaataattacactataaggtgatatgtacaataatagcagtaagtttagggtatggaggtagctcactggagggagtgattagctcactattatacacagaaggtggtgttcgggttgacccaggagttctagaaggagacaagaagtagaacataaatggtagctcccccatggcatcttttttttttcttgaaatagacaaggttttgctctgtgacccaggccggagtgcagtggtgtgatcatacctcactgcagcctcaaattcctgggctcaagtgagccactagagtagttgaggctacgggcgtataccaccacgactggcttattttttattttttgttgggacgggatcttactatgttgccaagtcttgtctccagctcctggcctcaagcagtcctcctgtcttggcttcctaaagtgctaggattacaggtgggagtcaccacacccagcctccttctttagttacctgaaaatttgctagaagtgaaagtggaggcggcatgctatagaaagtatgtaggctttcaaactatacagctttaaattctggctcttctatttatgaatagtgaggcattggacagattttgaaaattcacttataaaatgtaattcttgtgtgacataaatcagtaatgtagtgaaagtacttgacataatttatggcaacacctgttaggcgcttagtaaaggttgattctctcattcagtaataatgcgaaataaactaaaaagttcggccatattcaaagttttgtactgtttttgacttagtctcacaatatttattgataaaatgaacagactaagctatatatttaccagcattgtgtgcaaactctggacagtgaaatgtacccaagatctttctggaatgttgtcaactgtgggaaagtaaaattgttttatgcagaagttgatcctgacctcaaatagaatttcagcaatgactttaatgcagtgtgtgtgtgtgtgtgtgtgtgtgtgtgtgtgtgtgtgtgtatgtgtgtctgtgtc

SEQ ID NO: 110989 - DNA, 1785 bp, Homo sapiens
ctggcaggatttgctgtggaattgaattcaggttactagtgggggacagggacaggaataaaagttcattcttaggttttatgtggcattgaaatttcttgggaataggagtaattaggaaaaaacccagaaatctgaagtctcatgggggaggttgttaataatgggggaaaacattgaaaaatactggttgagatcatggcgcaaagagggaaggactgagtgctgtgaggtcaagaagtagaggaggaccctggagagaaggtggggaagaaatggccggtgagataggaggagagccaggagaatgtggggacctagacgcttagtgaagaaagcattttaagaaaaagcaatgtcacatgttccagaaatctgaataagatgacaacacagacttgacaattggattggcaaagtcgaagttaaggttattgatcttaacagagacagattcactgtaggagtagaagtaaaagtctttgattggaatggattaaacaggaagtaaggacaataaatattgttgactttaaaaaggaagagccaagaaatgggactctgatacatgaagggagataatgttgtgaataattttttttaaatgataggagattttaatcatatatacatatatacacatatatacatatatatttaaatcatatatatattttcatatatatgaaaatataaatctatatatatgaatatatattatatatatatggaatgacccagttaagaaataattgatacaggagaagatcaaactatcttaatttaaaaactatccctatttaataggagagtgctggtgtatagtcaggggcttaatccaccctggcccaggtcctgtctttctctgtttctttctggattttggtgttattttctcctcctgtgtttcctagaggctagttctgtggctggtggcagttgcaggcttatgttttcctaggatcatggccaaagagaactaggagtcttgcctgcctgttctagttagagaaatgccagaaagtaactggcttaggtcttgtggccaaatctagatctgctgctgtgacctccagaatggggtcctgtgattacttctttccccatctgcctactccgggtgatttggagtcttgtctccaaagaaggaagagagagaaggagtaacctagcagccagccagccattacagattaatgaccaagaatcactagactttgagaagagcaggtagaagaaaaccttgaaaggatgcagggttgggtgggtggtgtctggcagcatgggtcatgtgatataaaatatagctactctttcagaacatctctaagttcctgaaacttgcagttcaaaacttttggaccataaatggattttctgaaaggcctcttttggtcccactctgaattttacggtaattgagtgtatcacttcctaaatagagacattttattaaatcccattttggtattttaatgaaatgagctaatgtaactctcaccactgaaaacttccaaaatcttcctggctattacagatttttactattgcctggtactttttactttgaaaccctaggtgagtttacctagaatctccaaacatgtctgtattgttaaagatgaaacataggtatttttaaaagcatcaatggaggaggagaaaagtgaatttgaggcagcaaaaagtaggcgctgtctgtgctgagttagtttgaaaatcttgagaaagagatgctttctgaatactggtaaatttgagtagatggttcttcatgagctaacc

SEQ ID NO: 110990 - DNA, 1057 bp, Homo sapiens
agaacaacattctaaaaaaagattattccccttctttttattgaaattagaaaactgtccagagttcttgaaagcctttcatgacctagctcctctctgactttctgccagtctctcaaacactgctagttcattccatctgaaggcttttttttacagccttttcctctctttgggatatttttcacccatgtcttcacaatgggactccttgcaatttttaggtctcagatgtcagctccttagagaggcttaccctgacatctttcctgcttttcttaagttaatcactatctgaaatttcccttcctcttcttccttctttcataaagtgcccctccccaaacccaaaggaatttaagttccatacaaggactttatccgttttattcactgccatatgcccagtgcttagaatgaaatctggtattcagaatgttttcggtattacaatactatatgggtggatggctagatgaaagaatgaacaagtatgtatctggtaattttctacaaccagaaaaatgatagattatttcattcttacaaacttgtataggtgtttattttcgaattaatcatgctaatctttgtcctaattgcttttactatcacttctgtttttgattgtaaggctttcttcttctcatagagtgctagatacagttttggtacttaatgttgattaaattgaaaatgcaatctaatatctttatattctctgaaattatagaatatgtatttctgaaagcaggtgtgtttaaaatatgcattccccttttatctcctgcagttcataattggacccttgaagacactcttcagtggttgatagagtttgttgaactaccccaatatgagaagaattttagagacaacaatgtcaaaggaacgacacttcccaggtgagtctttgttatgcaaatgtattttccactcagggagaattatatgctagatgtcatttccccatactgaatctacaagttacttccgtggctgagggcacaaaggaaatataaatatatccattctttaatctttctaaattatgcat

SEQ ID NO: 110991 - DNA, 1029 bp, Homo sapiens
aggaagggagttgggatgatggtggtgatacttttgatgactcccttcaccccacagaggaccattctggcagcatatgattggaggtgctgttgctttttcaagggtccccatgactttgaccactccttctcccaccagcaggggcgtggtgtgtctatatgggtttacctctgcccttctataagtctagtatatcaaagagttacaagaagcacagtcattatttgaagaaagaattttaaaaggctagagcttgtgcatgggaaagagatctccaatttttggttttgttttagatactacttaaaaaatgtctttttgtattgaggtcctgtcatactcaaagattaatttaatcatctgtaattcttttaataggcccacctcataactggatgaaagattttatcctcacagtttctatagtaattggtgttggaggctgctggtttgcttatacgcagaataagacatcaaaagaacatgttgcaaaaatgatgaaagatttagagagcttacaaactgcagagcaaagtctaatggacttacaggagaggtaagttcagaaaaatcataactcatttatgtaggcaaatacaatttgtaaaaaaagtgatatgggcatgtgcttaaatacttacatttaggttattatacacatcaggaatagatgcatatttgatttcacatttttagaaaagtatacttttataattacagatttattataaatgtgtatacttgagaataaatgagtagaagaacagtggaggtaagtcaaatatagtggaattagatgtgtagttaaattttatttttaacttgatttaaataattaggaatttttgaaaagctttttgcggaagagtatttccctgctttccctgtcatttgaacccaggataaccaaaatagctgtatagtaagttgcctgatatttgtattaaccaaacttaaggctaatgaaaaatgctatgatttctgattgaaatatgtatttaatcgcttgacccagtattcattatt

SEQ ID NO: 110992 - DNA, 1087 bp, Homo sapiens
cccaccttttttttggtttaattttaggaatgtaactccattggggctttccaggccggatgccatagtggaacatccagaagggcaactgtctactgtctgcttatttaagtgactatatataatcaattcatcaagccagttattactgaaaaatcattgaaatgagacagtttacagtcatttctgcctatttatttctgctttgttctcagtgatgtatatgcaacattttgttgaaagccacgatggacttacaagctttaatggactcgtaagccagcatgggcttgcaaaaatttcttgtttaccagagcatcttcttatctttccacagagctatttacatcctggactatataacttaaaagaagtaaaacgtaattgcactactgttttccagactggaaaaaaaaaaaatctctgcaagtgaaactgtatagagtttataaaatgactatggataggggactgttttcacttttagatcaaaatgggtttttaagtagaacctagggtttctaattgacttgatttctggaaatgaaaacccgcgcttttattatgggaagcttcttgaactgcatttactattgtgaagtttcaagtcccgctgtaaagatcatgttgttttgttttccccagggctttcactgtgatttactgcattgcaggctgtatgataaaacacacataatttaaagagagaaggctcttgattccttatgcaagtggaagagttgaaacttgattgaaggacttaaaacattcacaaccttaagccgaggtggggggatatggggattcaggcaattgtttacacactttgaataactgcaaaggatttacggtttgtgaaaaatgtgtactgtggaaaagataataaattgaagacattattgtgtgggattgtgctgatttttgttgataacacaaaaaacactatgttttctggagagctgtgtaagctgtcttgttgcttagttgcaatataagaaatagtgatgttttggacgtaagttgtcaacaaatttctattttatattgttatatttttatgtagtttgaaatgtaaaaatgttctaat

SEQ ID NO: 110993 - DNA, 1086 bp, Homo sapiens
tgaaaatgctaattgataaaccagaagtttcttttgagatttgctttaaagaaatgctttagtaagaatatgaacaatttcctgatgtctcctataaattgtgattgtttattctattactattgttaaaaacttgaatggtatttatattggctgatatttatatacttaatagattgagttctgtaagggcaaaaacggattgaaatgaacatagcgttttgcactaatgataagataacctgagaggtagggttgaggaacacagggttgaaagctgttggagaggggaaaagttgtgcataaagaactgaaaagggttctggagtgttcattcagagtgaagggaaaactttatccttctatttcttataaccagacaggaggagttcttccctttgaaaattgcaaaaggaatgagaactttgcagttggatgaatagagaagggaaaagttgctggagcacggagtgaagatgggaggagctgttagcaaggcccactgctgctcctgggtgagaagggagctctggagcaggaccagctgggggccggcactgctgcttagagtggaggaggctggccaaagagactgtgggctgttttcagtcagggagcatgtgcattgtttgtgctcaatttcagacactcatttataaacaaattcaaccaagggatatttactgctttatgttgcttatgataattattttgcattaatacagtatacacatttgtaaattcaacaggaaattattgagttttggaaagctacagtaatttctgtattacatcatttatatgtgaaaagttggacatttctgtaagtttttaaaattatccatttgttactttaacattttaaaattatggtgttttcctgattttaaaagcaatattttccttactgtaaaaaaaaaaaaaaaaagatcgatgatagaaaagtataaagaagaaaatagcaagcaggtcaaatactactatccaaaatgatcacttttaatattttagtatgctttctgctagatctttttctacatattgaagtatattttacataattgaaatcatactatatattcaatt

SEQ ID NO: 110994 - DNA, 1423 bp, Homo sapiens
cggtgtccgtggaggacaagctcacctgtttgtgtggggacggctgcaatggtggtgatcccaatgaaggttggaacttttggacaagaaaaggcctggtttctggtggcctctatgactctcatgtaggttgaagactttttccatccctccttccctgtgagcaccacatccatggctccatacgtgcggaagggagaccccccaagtgcagcatgacctgcgagcctggccagacctacaaataggacaagcactatggatgcagttcttacagtgtctccgaagcacaaaggacatcatggccacgatctacaaaaatgacccagtggaggaagccttctctgtgtatttggacttcctgctgtacaagctcaaagaatagcaaggcgtcactggagagatgatggaggccatgccatctgcatcctgggctgcaaagtggagaacagcacgtcctactggctggttgcaaatcctggaataggtactggcgtgataatggcttccttagtttttattttaagttcaggggtacatgtgcaggtttgttacataggtacgcttgtgtcatgggggtttgtcgtgccgattatttcatcactcagatattaagcctagtacctgttagttatttttcctgatttcctccctcctcccactctcctccctgcaacaggccccagtgtgtgtttttcccttctatgtgtccatgtgttctcatcatttaacttccacttacatgtctatcaatgatagactggataaagaaaatgtggtacatatacacatatacacatgtatggaataccatacagccataaaagtgaacaagataatgttctttgcagggacatagatggagctgaaggccattatctgtgacaataacttctttaaaatcctcagaggacaagatcactatggaattgaatctgaagtggtggctgaaattccacacactgagcagtactgggaaaagatctaatctgctgtaggcctggctggacagtcctgggggagtttttccctgcatatagtcagggatggggatgagatggaggtagaagtgtgttttattttttgagttcacgtaagatacaagttgtagatgtggcctgaattggattgggtctaacctattcatgacccatcagagctatcttccaataacacacaccaaattctggatacctcccagcccattcagtggactgacagccgtagtgcagacagttagaccacataagccactgctgcaagcaccgtgtgtttttttccccaaagactagtgctgtatgtagtgcctgctgcctggctctggctgctttcccccactccccctccacctcccctacctatacatcttcagagagcaagacagagactcagtgatggaaagtggagtttgtaacgagatgaa

SEQ ID NO: 110995 - DNA, 1032 bp, Homo sapiens
ccacggtgctggcgacagacgcagacagcggtaagaacgccgagatcgcctactcgctggactcctctgtgatggggatctttgccatcgatcccgattctggggacatcctggtcaataccgtgctggaccgcgagcagactgacaggtatgagtttaaagttaacgccaaagacaaaggcatccccgtgctgcagggcagcactacggtgattgtgcaggtggctgataaaaatgacaatgaccctaagtttatgcaggacgtcttcaccttttatgtgaaagaaaacttgcagcccaacagccctgtggggatggtcaccgtgatggatgctgacaaggggcggaatgcagagatgagcctgtacatagaggagaacaataacattttttctattgaaaatgacacggggaccatttactccacaatgtcttttgaccgggaacatcagaccacatacactttcagagtcaaggctgtggatgggggagatcctcccagatctgccacagctacagtctcgctttttgtgatggatgaaaatgacaatgctcccacagttacccttcccaaaaacatttcctacactttactgccaccttcgagtaatgtcaggacagtagtagctacagtgttggcaacagacagtgatgatggcatcaatgcagacctgaactacagcattgtgggaggaaatcccttcaagctgtttgaaattgatcccactagtggtgtggtttccttagtgggaaaactcacccaaaagcattatggcttgcacaggttggtggtgcaagtgaatgacagtgggcagccttcccagtccaccacgactctggtgcacgtgtttgtcaatgaaagtgtttctaatgcaactgcgattgactcccagatagctagaagtttgcacatcccactcacccaggatatagctggtgacccaagctatgaaattagcaaacagagactcagtattgtcattggcgtggttgctggcattatgacggtgattctaatcatcttaattgtag

SEQ ID NO: 110996 - DNA, 1050 bp, Homo sapiens
tcattaggcactaagtaggaatagccaaatctctcaggacttttagctggaacatccagatgaggatgggttcttggcagtacctaatgtatgcagccttagggaaatagtttttaaattcttacctgcaaaagattcactaacagagcttttaggaagcgcagctctcctctgcttatctcagtcatgggccaggagctttcacttttacaaagtacactgggctcttcttatgaaaatactctagagtagcagtgtccagtgaaaatataatgcaagtcacatatgtaatttttaattttctagttgccttatttatgattatttttaaaagatgaaattaattttaattatacatatcatttaacctcatatatccagtatactatcattcaatatttaatcaatgtaaaattattaatgagatattttatatccttttaaaaatttaatcttcaaaatctgatatatattttataattacagcacctcatatcaattcttactagccttgttgtaagtactcaataatcatataaagctagggactgccatatgagacagcataacttgggataattacattcaaatccagtaaataaacctgcaaagtggaaaggtccaaattcaatcacttgactgtctaaataagaatatgctttattttgtgttgtcatgtgctaagttcttaaaatgaataatataaaatcttacaacagtaatatgaattagatatgctatttaatctatttggtagagaaaaaaattctcgctttagatgtcgatttgctcaaactcacagagaagtgagagacagaattagtttgatgtgacctcagagcatacctgccaaccacccttgagtaccctcttcaacactatgcttgtttcttgtataattgagtgaaattcaggcttttctccaatgttaaagtcttatacatgatcaaggccatgtttgatataaatatataataaaatagaattcagagataatgtgactgcatttatatattaatcctgtatgccacttgacttcctagaattgaa

SEQ ID NO: 110997 - DNA, 1053 bp, Homo sapiens
attaaaacatttgacacctataatttcctatttttttaaaaaaatgtttttcctatctattcatttattaaaaaccttgcagaaaattttacatagtatctttcgcttaagaaaagaagagaaatactattataggagaagaattaacaagagaagcttaatgaaattttaggttgttagactaaatttaagagagagatggggaaaaaaaggggcaaaatggggatgttagcaaaataaagagcatttactatagtttgaaagaggtgtattccacaatctaaaatatgataaacaatagaaagtcaaagataaccttgtgatttcaaaatattaaaattacatatgtgatactatgatataacaagtaatatgatttccctaattggttatttccaaatatgcatgtattcattaatccaattttcagggcaaccaaacatgtaccaaaaacactgaaaagaaacagaaagtacatgatatttgccttcatagaccacatggtagccttgtatagaatgtgataattaaatgaataacttcacaaaaatagttaaatagttgataactgctatggaatcataccatatataagaaaagtgcataataggaaaatctaatgtggtcctggtatacattactttaaggtagttttagttggttagtaaataacgcacgatatcagaaactttgaaatatttagctttcatctgtgtataaggaattttagaattaaatgtgcagtgatatggtttgtgtaaattaacatgaactttctgaaacttacaatttaaatcataaagattcacttatagatgccttggtaaatgtgttttgctttatgtaagtagcccaaatattcccatatatattaatttttaaagctattgctagagaaacaaaaagatattgtttttatttctagaagaagacaccatttacattttaaaattaagacatattttaatgctgcttaactttatacagctaatattgataatatactgtcagagcattttaatgcattttctgttctctaaacgattaatttta

SEQ ID NO: 110998 - DNA, 1086 bp, Homo sapiens
catggacacaggaaggggaacatcacactctggggactgttgtggagtggggggtggggggaggggggagggatagcattgggagatatacctaatgctagatgacgagttagtgggtgcagcgcaccagcatggcacatgtatacatatgtaactaacctgcacaatgtgcaggttatatactaaaacttaaagtataataataataaaaaaaagctatgtatagggacaatcttgttcttggcaaacatagcagtagtatgctaaggtagctatgactaaataataatcccctgttgatagtaaggatatttgatttttttgaaataaccattgtttctttcaacttgaattcttaaagctgggattgctataagcacacttatagcacattaagaccaaagcagaaatcatctgtgtgtatatgtatctcttctgtattatactgcttagttttcacttgaaacatctttatatcctaagagttcagactcaaacatagtaggcactcaataaatggttattgaactgtctataatacaatggaccacattatcaagccctccaaatggaatggagggctacagcaaaaggtagacacacattcagtacatagagaagataatacttgataaaatacataaaaaatacatttcttctaatttttagaactttttttctctgtgaaacagtaaacaagtgtgattacaattaggtctaaaataattttgttgatttattagtttaggtatgaagtaaactacaaaggcatgcaaattcagttttacgtgtgaaggttcatacatcaggacatgtagaacaattaacttagactcaatgaagtttatgagttttgcattcacacggcattgatcagattttcataagagaagaaacaatgagccaagtatggtcatagcccatttcttttttctttttggttttttttttttcttttttttggagatggtgtcttgctatgttgtccaggctggagtgcagtggtgctatctctgctcactgcaacctctgcctcccgggtgcaagcaattcttctgcctcagcctcccgagtagctgggactac

SEQ ID NO: 110999 - DNA, 1131 bp, Homo sapiens
ataaaattctgtgcatttatactttttgaaagtatacatagtccagattaaaccatgtccacaaaaatataattaaaacatgaacattttaaaaacttttattagtttgacctcctccagtatatagggattctgttaaattaattttttttattaagttaataagttgaagttgttttcatgtcaaaattacatgtccttaggaggacatgaaaaggaaggtgcattgtgagacagttatataacagctaggtagagacagaatgagatgataatcctactgtatgttagaaagaaaatacatatctatttggtattagagtcatcttatagtttttttctgttgtaaaaaaaagttatgcccatatgtgaaggtcctgcctagttaaaaaatgaggataaaatggtggctcattttgtagcagccaactgggtccctggatttggagaatcatagttgaaagactgttcaaattaacacatttcaaaatactaatttgtttagattgtctttgaaatttatatagattctttttttaaagaaagcaaacaaactcagggtttttggaaattgttttattggcgaggtctatggatggacaccattgtataggggctgctgattttccctttacatatttccccatctcccttccccaggtgttgctgccatcactacctttcccttcctcccctttcctcatggcaagacgcatggaagaagagtgctgttaaggcctctccattaatcaacaggtatggtggttctcatgaaacagtgtagctgcccctcttctgcattctccattaatagtctgtctcttacatttacaaggtgcattcattcactacacagagccttctatatggaagaattgttcaacttgagtttatatgtttcaccgtgttatgtattacctaaatccctatacagtggtagatttttctcaatgtatagagtttagaagaattaatgatattattctcagggaaagttgctatgcagtttcctcaacaaaatatgtataaaataaatggaacttgtatgtatgaatatgccactttcaacattctacaaacaatcgttatataacacatctttgaaagtataaaacaggaatatttctgtga

SEQ ID NO: 111000 - DNA, 1036 bp, Homo sapiens
agaatttaagaaatgaggtatccatagtctctgtgtctgaacatttagtacccaatctatagtacacccccaattaagacaaatcattgccaacttttgccctggaattgagtaatgggaactggctgaggtgtatttcatgcatacttctagcagagctgatatcataactcagacaaaaattgatttgtgtgcctcactcttccaagagactaagccttgtgagtagaggaaccagtattcccaactcagtgtcatctactgaaaagtgtctcaatatatttttaaagaatagatgtagttccttgatttcattaaaaatatatccctaaaaactaggtcataaacacaaggacactatgtcgtctccactgttactccttgactttattttgcaaatatttgttgagcagacactgttccaagtactgtttagcttccagtaataaaaacaaaattaaccatatggagtcctcaccctacacaaattcaagatgcagtgagaaggacataaaaattgatcaaagaaaaaaattactctctctctctctctatatatatatatacactatatatatatatacacacactatatatatatacacacactatatatatacacacactatatatatatatatatatatatatatatatatatatatgggatattatgtcagaattaaaaaacaaaagacaagacagctcagccttcaaaccaaggttggagacttcttgagcagagcacatgatcagaatcttctttttaatctaaaatcatccctgaactccatgcttctcatcccttaaccttctaaagacattattgtgcatacttttttgcacaaataactttctaatattttaatcattgaattttgaaagattaattcagttcacttgccagttattttgaatccagctttaataaagaactgcctaacaatttgtagttttcatgtctctgtgtgaacaagaatgtcacctaagttagcacaagtctcattaaatattgaaaaacagaaactggcatagg

SEQ ID NO: 111001 - DNA, 1037 bp, Homo sapiens
tttaaaagccttctatatacaacaggtatgagaaacaatacttagctgaattttcttatttgcaagaattagaactactatctctataggtagccctaggttctattctctgggccacttttacaatagagtggagtcttgccactccattacaattatcattttaataaaaattatacttagaagcccttatccctggtttcctctttttcctgacctattcccccagataatttggcccattgctatctgtggagtgctccagaaaacatcttctaaatgaattggtactaattagcaggatttttgatgtcagaacgagaccaacctcagtcatcaatggaagactttcttctggaggcaaaataagatttttcttcttccttcttccccttttctccttttgcttttcttccttgcctcccatctctaggaggaaatatgacttgtatttcagccaaatttggaatatggtggtacattaaaaattttcaccaagtgcacattttcatgcactagagtgttctcagaaattgtgtacttgaatttcactttggagctcctattattcattttgtcctttcctcttcatagtgtgagtcatggaggttttgtgtaggcctgtggctctttatcactcagcctaagtccccaacttttccccttccctagtcctctgaggatctctggagtgtcatctgatcaagttattttaatgttttaagaattctgaacaattgtattttcccatgttggccattttgaaatgaaaattatttggtattaaaataacgtggtggagagcgttgcgtatatagtgatgcagagatgcatgctccttagcttcgtataaatctaaaacttttcagctggtttttttcttccatactctgaattttctttgatgtttggccatatttcatgagtatcactcaaaagttcatttaaatgttgcagtgaactaaatattatatgtatgccccaattaatagaggaacattctgttaaaaatctgagttcacagaatcctgactccc

SEQ ID NO: 111002 - DNA, 1029 bp, Homo sapiens
tcacggattatcctaagggaaagtatttgggtgcagcactgtaacccaaagtccttcgtatacttctgtttaggaaacacgttgcttgtttattcactcagagaaaagacaaattgaatcagaacataagtttcagtagctactgcttcccccacgcagggatgtcactgcccacatgggcaggccagggtcactagttaaaatgttcccattgtgaaagcatattatcatcttcgggggtatttttgcttctggtctcgtgactgaccagtggaaaaagtcataagctatttttgtgaaatgtatttctagtacaatttgagtcagtgtttagaaaacatcacatattaataaaaaggattatatagtgagcacctattttatatcaattagtttatacacattatttctaatattcctagtcaccctgccatgtaatgttcttatgttctatttgcaaggatttcaagatgtggaccactttttgcaaagccaaaagttgatcgttgctacaaatggtggggagaacaatgttatgattatagcatggactctggtaccaaactacttgggctcacatccgtctggtcactacaactttatgattattgcaaagttttgtaactgtcagattgtattataaacacacaatataaatggtagttttcaagaaagtgagccttgtttccaacaatctcttctgcctctgacatggaatagattaactagatatgtacagtacatggccagcattttaatatggagtatatcaatttactagggctgccataacacaataccacagactgggagacttaaacagaaatctgttgtctggaagttctggaggctgaaagtcaaagactaaggttgagcaggtttggtttcgcccaaggcctctcttcttggctagcagatggtcacctttttgctgtttcctcacgtggtctttattctgtgcacactcctctctcataaaggcaccagtcttattggattagagccccacccttaagatctcattttacc

SEQ ID NO: 111003 - DNA, 1045 bp, Homo sapiens
aatagcacgttttaattgtttgaaaatgtgtgagcacaagaaattgtggcaagcaatgacaacgtgaaaaacatattgtcaactcacttatggttagagacatatatgatgttactatatgatcatttacggataaaatgatatcacgattaatagtataatctacaattttgcacatttaaattttagtgttatacacagttgcacatgttatttttccaattagaatatttaattacaagattacttacctagaattattttacatgtactatgctactttttatatatttgtgtgtataaggtaatggatcctgagattttaaaacagatagattacatttgaattctgacaataattttgaaacttgagattgtgcagacatcacacagtgagatgtaattgtgaacatgtgttcacaaacaggaatcaatgctttcagtgaatgcattctaagagaagattctttatctaagcacataaaaaatgttaatgtaatctggtttaacaagctaatcaaaatttagagatgatataattttatgtgtgtggggagagaggctagaagaaattaaggctttagcaaaaagttgcagagagtttgaaagatattccagtggagctgtctcttttgagctgaccagtgtgtttataattttagagcccatatgatgaggagaagctagtgttttacatgtacaaagagctcccaacctatattacagagcatatttacaaaagtatgcttaatcatattaagatatatgcattcaatttaaatatttttgaaatgtactgaaaatactacatattgttgtgaatatagatgtgtgtgtgtgtgtaaaatgtattcctaaaattcatgtatacggttattgtttataaaaatagtataagatttggcttatgaaaaaaagaaactaaaatttacttttattacatagaaaagtgaattattaataatgcatgggttgtatacaaagaagatgtgacagaatcaagggagacagcaacaggttcaacatttagaaggactcacacaca

SEQ ID NO: 111004 - DNA, 1031 bp, Homo sapiens
ttttattcataaggactgctaaatcgtatgattcatttgattagatagcattcacaacattagaaaattaaatataaccactaaaatattctacatttttgattacttggttttgattctttgtctcataggcaagagaaatagtataaacagaggaatggaattataactagaaatcctattttggtgaataagctgaggacttcctagagaagctgtatgatgtgaaatagttgcaaataatggcaaagtaactcgtagataaattattttaagcctttatttgttaggttgctgcatagagctgcaaagcatcaacaacatatttcctcaaaatgtagagtttacaagttttttgagctccctgatgtttgcaatctattccagtctcaatgtcctctaattgtacatcaatcatctaatgatctagattgcccattgcttgcagctatcttttcatgttttatttggttaaaggaaaatcagctttacattgtgaaaatgcatactgttagcgaattgtgaaattgtgaggaattgtgctgtaattactgaatattggctctccatgaacatgttgcttaaacgtgggaagatctgccagagaaattaagtttctctcctcagtagtccatcgttacagcaacaattgtggaaatcaagtgagatgtggaaccatttttgattgccttaaatggcacatttatatatgccagaaagaatatatgcttctatgtaaattgaaaaagggaaatgaaacagtctgtggatgtggactctctcgggttgaatgtaggtggatcagttcgtacttaacatctgttcaggctgcaaatgcagaggaagtttaatatgtttactcaatcatactggtttcctgggtgccaaggcagaaaatctaaaacatgtgacttctgttcacactatgtgggagctatttagaacaaaggtgatgatcgtggaagaaaatgtggagacgctatctccggtgccagcactgttggacttctttgttgccagcaatcaacagc

SEQ ID NO: 111005 - DNA, 1159 bp, Homo sapiens
aatttggccttggtcttttcatcctgtttgtttcaaacgaagggacaaactagtgaagaagtgaatgtaattgaggacctaattaataattatgtagaaatatttgaggtaattattttgtatcctgcccttgttaaaatggttataatgtcactgtttgccaacaaatatttatgttgtagggtgttattattcagatctttattcatatttagaaatacataaaataaggaatagtcatatttttttaaattatagatataagtagcttttaagctatagtcattatttaaatttggttgcatttaaaactttttaccatctgatatctgtttgacagaatatttctatttataggatttttgcatgtgttttctttttcttcatgtgtatgaattatatctacttagaagtgtgaagttataaaatgaacaattcattaataaataccagactcttaaattctgcagttgaaagccctttggttttttcttttagttgtgtccccagttggaaacaaataacattctaaaatattattattctatggtgttttactaagtcatctgttttaattgactttttaaatttccattttataaagttaatattttcatgtttcatcagaaaactgttggagtagggatgatttcttggttcaaagaagtaaaaataggggaaataagcccaggattcaaattggtggatttgggcaaaaggtccagttctattatataactagttctagcacctcaattttgtcatttaaccttttgaacattcccttaaatggtgtttatgagtccagttgttttccggaagtatggctgtaccacatgaagtcaagacagttagtgtaattggttaccattgtagagttcttacgttcttattataatcacttatcataagacaagaaaaagaagctattttaataaaacaaaatatcacagtctgtatcttaatttacataggaatagacaccagattgtgggattttctttgctctttgatctcctctttacttctttctatatgtgtccactgtttttgatcaatagcaacttctttgcaataatctgatgctgagaaaataaagatttagaaaaatatgatgtgtggcttacatgctgtctctattttctgtatttgtagtttt

SEQ ID NO: 111006 - DNA, 1046 bp, Homo sapiens
gtgcaccaatgctattaaatgtcaaaccatctattgcactacatatatattttaggattcgccctttgacaagttgagaaagttctactcttcactaattcatgaggagacagctcaactcatcatcagtggatttttttctgactagaaagaaaatttgaagttcaaaaatgtcacagtttatggcagaattatactcatattgtaggagggccactgcattttggatttctttcactgcttgctaaaacacccgttgtagttgtttataagcaaatagttacaaagattttatatcatatttaaaactgaattattagataaattatgtaaaagttttttctctttacctaaacttgtgaatatagcaagacataattttgattaagttcacataatcaagaggtttgatgtttctcaaaaaattatctgagttatatgatttcagttagacaaatacatccagcaatagaatacttttgagctaaagatgatataagatcaatgaaaaggctgtagcatgtcaggtgtattagtgcaaatttcagaattcttcaaaaagaaaattacaacacctggaggtcaggactgctgtagtgttgtggaaaatagaaacaatagataaagacgtcaaaaagcaagagatgaagattacaagcaccagtattagtaaaacagtagtagttatagcaagttcagatgttaaaaatgagtgtggtaaggtgcaggtatctttgtcttcttacaggagcatttcaagaaagaaaacaaaggaaagaaaggaagttttttgtttctctttttatattaggtacagtgattatcagaaatgtaaaagattacattccttattacccacacctggcccccaaagccccagaattcatgcggtttattcatgcctctttgggttgaatataaactagccctgtcaagtctgaaatcaagattatatcgttttactttggtgtaaatagacttaaaatacatcaacaattagtttatgttttaaagcaaactttgtatctagtgataggtctttaaaa

SEQ ID NO: 111007 - DNA, 1137 bp, Homo sapiens
aatttaacattttaggaaatgcaattggatttatacatatgtgcgattatgcattctctgctcattgtactaagtttataatatatatctctggatgtagctaaatcacttaacctttccctagtttttgggatttcaacttatttccatttttgcaatgcttggctaaatgcatgtgtttgtgtgcatgtgcacatgtgcatgagagaggaacagaaatatattgaaagaaacagatattgtgccttcatttcaaatcatgtacttatgaaagagtcctgtggttggaactaattgtcaaaactaatgcatacgtattttaagattcttagaacatattttcaaatttatttttagagtatctcatcagcctttaaaatgctatgctcatcttgttatactccagtgatgaacattaaacattttagatctttgataaattgcctttgacacatcattgattttacatatatacgtgtatatgtgtgtgtgtgtgtgtgtgtgtgtgcgcgcgcgcgtgtatgtgtgtgtccattctaatagtgtgactttgtaataagttgctcaggaaattctgttttgtgaatcttaggtgtgataggactgagatacacagacacgcacacacacacacacacacacacacacacacacacatatatttgattcttagactggtttgtggttacatcggctaattctttctgtgacttacctttccatggctgataaccgtatttctgtggaagacttactattttatttttgtataaatccttaggatattatcttttccagccatatttgtagagtatttcatttgcttttcagttttgtttaaaatcttttttatatgagcatatttattttttatgtggtcaagtttattgatctattatttgtgaaggcacttctggttcttgtcatagactaggctcaaatatgattgtttatgcttcatggttattatattgcagttttaatataattgtttttgttagtcctaggacttggtttctaaggtcttattgaactgtcttgattcattatagcaaataagaatttttctttatatggctttgaagtgccctttggaatttatgcttagaaaatagacaattagcataactaatttct

SEQ ID NO: 111008 - DNA, 1052 bp, Homo sapiens
atgttgagagagataccagtcaattttcaattgctttgtgaactaggagataagagtgatgatccctgagcttctggcatgggtgatgctatgaatgatagtatcatttgccaagatagagaatatgcacttctctcccagtactcaaacatagctagttaattatagctgtgattgttgaaaagctgtttcagtaccatgccaaaatgagaaaatttcattgtaccacccttgttttcatctcccttttgatctattagccctttgggaaatgatgactgtcagcaatggtagattctgttggacttgtcagtgacagataaaattgtggcttttggaagtaacacaacttccaattatttatactgttggcctatagagatagtgtgaatgattgaaagaaagagaaaccaaccagctataagcttgaaccttatatttttgctagtaacagcttgagccagaaatgtaaatcatacataaatttaatgaattaatttcacatatttttcctgttcttatctacctttgattaaaatgctaaactacattaatgtttcttaaaggcaaagaggagaaagaaccccctaaactggaaatgttcataaattgataattatcccctgtatatagtcactatttagatagatattttaatcttcatggtcattttctctatatgcatagcatgagtgtctttagacagaaaaatattgcaataatattttccacacacacagcatttttgctctaaaaagctctaaacagaaggtgttccagatggtgtcgttttaatgtgtattccttgtatactttaaaaattattttggaaaataaagctttcttgatcacacttaggggtttctggcatgctatttgatgttgttattgggacttagatcctgtgcttttcttttagaccttagtactgtttgtgcaaataaaaaaataatattgtcaaatatcacttgttagtgaatattctagaccaggaaggcagaaggcattttcctggacggtaggaaattgtatcatcactttgactgaaatgt

SEQ ID NO: 111009 - DNA, 1109 bp, Homo sapiens
tattggccaggctggtctcaaactcctgacctcaagtgatccgcccaccccgacctcccaaagtgctgggattacaggcgtgagccaccgtgcctggccaaatcttatgtaaatgtatagcatatcacttatgaccattatagtcatttaattttgttacttattatttaaaatagtggactagtggtaaaattcatttattcatttaatgagtatcataattaaaacaggtaagaaaggagaatattctatgacgatctgttcacattaaaataaacaatatttagtagcatattgaaatgctaaatttcttaaagagctgtttgttaatttaatggtcagaaaaaagtaacaatgaatagattaagcattatttatgtaatatatttgactcacatctactatggtttaaataaatctttgtcaggactttaaaagcaggccatctaagatctttggtgtgaaagtgtcttatcatgttttttgatgtaattaatgaaaaacattgatattaaaatctgaaaaaagttttataggagcatagattttaaataagatttttatatgagaaaggaaagagatttgcaaagctgttatttacataaaactacattgaacatattacctttattatatgatgactagttgagatgacttgttttatagtaaatctgatttgatttttgatgtgaacaaaactgattattaattgacttgtttttgttttaatagtgcttttactctaaatgattattcaatgtaatatgacttatggaatgttaaaataagtagattctatatattaagttactaagtagtaaatgaaatataaaaaagaatagtttatatcagcatattaatatgtttaaaatattcttgataacattactgatacaagtagctatgcagagagaaagtatctacaatgagatgtggttaaaaaataattgttgccataaaattcttgctgaattgcctcaaataacacattggagagtatgacctcaataatgtaggcactgaagatttatatagacatattttaggaagagagctggaagaagtggtaaggagattggaggaagagagactaattgttgagaatttaa

SEQ ID NO: 111010 - DNA, 1053 bp, Homo sapiens
gcagaacatatttgctaacaattaatttgggaggcttgctgtgtttcacttgcataatagatgtgtggctggggaaccagcccagagacaagctctctacacttcctgaagttctttttctattgtcttctgagagccaagaaaagttatgccaactccttgttttaaacatttcagaaaattgcaaaagcacaaggtagacagagttgatatttgtttagaaataatattttttaaattttttaaaaaataagaagttcgttttcgtatattttctgtgttaaagaccaaaagtacctatggttgtctgccttcagggaaggagaatataaaataaaaataaaaagcaagcctaagtaaaaacagttcttcacttcttccttatatagtcagaaaaatagtttattttttcttttaagcctgcaacatgtgatatctttttttgcttttgtttttcatgtcagtagccattttaaactacctttgcctttcatatgatcatttaaaaaatatactaatctttcactgaattttgaatgcttataaatgattctgtatatttgttcaggtctttttcagcttaatcaaaattcaatatgttttccatgtaaatccaattgacaaagccttgttattttagtaagatatttatgccctaaaacaaaaatcaagggaaaataaaatagatatataagcttaatgagggatgaaagcttatattatcttcgtggaaggattatctttattattagaaatgggttcagtgacagtgtttctgaccacattttgttgtgcaccgaaccttacaaatgtgtgcaacaacgctgttaattttgtcattaacaaaaaattcctaggtcaactgattagaaagtactattatgctattttttcctatgtgccatggccaaaactgtgtattatcatagcctattgttgtctatggtgtttaacattaaataataatatatttacacggttacattacaaatgaatttaacaatctaagttcatgttacttgaatgtaaaataacaatttcatatgttttgca

SEQ ID NO: 111011 - DNA, 1650 bp, Homo sapiens
atttatttcttaaccctttgatgtcttttagtgaggtttggggaggagtagaagtaaatgcaagcttttaactgagatttttaactggaagctggttcacgttgtattttatataatatgactccataaaataaagaagtgtgaatcttttaacatagctttttatacaccactttatgaaagcactaagctctttgtagatatttttaaaattggtagttgcacactaaaattcaggctttatcattgacttccaagaatctttttagcccctagaattttatgttgagtacctttttttttttcttctcattttaggatgtagatatagcagagatggaagctgagattgaagatactttttttgttttattttcgttttttggccccagctcatttggttcatataatcttggaaattgctattttggtttgctcaaaagtgagaaagtgctctttagaatagagaagtgctggcattttatagaaatattttagtaattccttgcatctttctctctctaaaatattttgttactgtatcgtttaaaagtcttctgcttcttaaaagaataattggataaataaatagctgaataaaaatgagtaattagataaataaaaataaatacgtatggagattgtagtcctagaaaatattgggtctcgttagggttagaggagggaataacataaaatatgctgtgattctttagggctatgtaaacaaggcagatgaatctggaacagcatggtgattatactttttcctttgagattgtttagaatatttgagaagtatgtttttcattgccttaaatggcaggattaataaaagccataaatttgacttaatgtctttgatgttctttccaattgtgtgatttttaaaggtgacaatttggtagcttctcacaccttagattggtatcattggttagttagcatgcttgttagatattaggatttgttttttaagcttaaagatgtaatcttgaaaaaaaaaactctgctggcacttaggaattaaattaaacaagagtgcctctgtgtgagtacttcataaatagagatttaattgtgtgtgtatacagtgttgttaaaaaataatttttaagaaacacattttgagacaacaaaaactgataccagatggtgaagctgtttttatgaaagcagttgaaactttacaccacctgccctaccagagctcaagggaagagtttatagaaatatgttcaataatactgcacaagtctaataaattattcgaaaaaagcttcttaaataaatgtttcccttcagaaccctaaaaacaaaatgagataaaactcaggctaatgtgtttcatgtctgctttaccttttttcctgaaggaattctgaagtactttgcaagactgaactcacatataaaatgtagaggtcaaatgttattactacctacagggatgtcctgggtacttagctataaaatgtactaatgtctgctttgtatagcagttaagagcagtctttgggaagacactcccagatatgttctttattacctgtatgacttggacatattatttaagcaaccactgcctctgtgccttcaactctaaaatggatataataatgttacctgtctcacatgtttgtctggagg

SEQ ID NO: 111012 - DNA, 1073 bp, Homo sapiens
tttggggggctgtatttcaaacaggtcaaagcagatgaaaagcttaataagtgatacttgcttttaaaaacctctcactgggttttgaggattaaaataaatcatcttcttcactttttcgcagctgtaaataataaacttaagcttttcagcagatttgcatagatgcaaatatgaaagactggatataatttattccagcatttcccaaatatgcatctcagaagagaaatgtttgaagctgttgtaaagaaaagagaacatggttggatggctgtgcctcttcgaggagatgcataaattaacatctccaagaatatctgcaataaggaaacctttttgaatttttacattactattttctaaggatgtttgtgcgttcagcataacacacagagcatctttataaaaactgcactgtatattaaagaatttctattttacttgaaatgttttaggactttcttacttggggaaattcctctttttttaaatttaactttttttttggccatgagaaggactgatgtggcagtgtgagcctgagacagctaaaagttgatcatgtgaggttaagtcagcacttggaggtggaggaggacacagatgagcaagatgtgttacttgtctttttgtagcttccatttagtgcagaaaagaaatatatatgtgaatagtgataaaacccaaagacaaaagtataataattggagcaaaaaggtctgcagaatacagagtcctgaggttaccaagggttgagaaagcatttcttcaaagaccttcctggaaggagagggtagcagttgaattgccctttgcaaaacggataagattttaactggcatttttaggtaaaatgctcttctgtctacagggaaaggtactcatagaggtgatatctagatgtacttgagggttgagatagtgagcaggtggaggttggagttattttattgaagatggacagttgggttctaggaccaggagagagaaactgccagtgaaaagcatgttcagagaacaggtaactagggaaagtgaaaaagccaataatcaaatacaaaggaaaggtc

SEQ ID NO: 111013 - DNA, 1030 bp, Homo sapiens
gccgcccgcgcggccgccgccaggcagcagaggcgactgcggacagccggcggggaccgggaaagaggaggcctggcgcctccggcagaggggcgaggaccgagcgcccaaggctgggagagacgccggcgctgagcttcccagcgccgcctcacctcgcttttcgaactccgcgacccgagcgcaaggcgagtacccggggcctcgggaaggctgggccgggatggcccacgcgggggtgggaggaccctgtctggaggggctggggcttttcgacacttcaccgggtaaatttcctcagcgcaaagtgctcggctctggtgtccgccccttggatttcgctcccgcgtgtgggcgtctgaaaggaaaccagaagccggtaagtgatccaagaactccacttctgggatttgacccgggagggtgaggatccggatagacagctggacactccctccattcctctcccctacctttaaataagaagaagctgtagtgagtttcaggcaccaagttatttactcggtagagatcatgaatttgcccgggtgtctgtgctgccccgcaccctgcttgttaaccacgttaagacgactggcctgttaattaactttaattacgatcatttggcttccacctgcctgaacccgataccttacacgggaacctgtatgatgtgagtttaccagattgatctttcttgtttacttttggagacagttctcttgggagaagtggtgtccatcctatttaataaagtaagttttactttatctaattctggcttgttttcttaaacacctcctaccttgaggtgatctggagttattttgatttggggaaagggttcgtggattatatagcctttgataattagaggaaaacacaagaaaataagctaatttgtgtggaataatgacatcttagggtgttgtaagtaggtatcctgatagcaaattctttttttttttttttttttttttgcaagcttgtccttgaagtaggctgttcagtagaatacagccttcgg

SEQ ID NO: 111014 - DNA, 1049 bp, Homo sapiens
atggcaggtatgactaggcgaggcacaagtacacccgcgcccataagtcagaaattatgagattcatcctcccaaacacagatgacagcatcatatgcacatttgtttgcattaaatcagtactcacctctgcaggtgcttaccctctattcagtttaagtgagccctttggaaagaaactgggtgtgggggttgtattttcttccatcactaagccatttgttccactgtacttcttgtgtaagtctcaaaagaggagaagctatggcccacttggagtcaggcctggctgccccagaagagacggtaatgagggctggactctcatcgggtttgaattttggctctgccatttgttgtgggacctcagaaatacttaaaattcctggatttcagtttcctcatctgtaaaactgggacgctaactactcctggatttcagttttctcatctgtaaaactgggacgctaactacttcctctaatgtgtgtctacctagcacagcccgcccttagtaaatgtttaaataatctgagtctcagcctctatggcctcccattttctcaaatgtaaaatacatctggactagagcagaatgggaggtacaggatggaaagaaagaatgagggaggggctcaaactacacacaccttctcctggctcccctcgtcttgaccttatataaaagccacacgaaatagcaggaagctttcaagcttaaactcttgggatttcccctgaatttctaactagagatgtaaatttcctcattatgaaattgtctacttaaatatctgtccagggatagtttcaaatgtttctaaatataccccaagcatgtaaagaacttgttagggtaaaacctataatcaattccatgtttgtattagtgtgaggcagagaggatgccaaggactgaatttgaggaaaggaagcaacagtggagttcacagagaaagcagaacttatttacatgctgaaatgatcacagtataagtagggagactaaagaaaactgtaaaatatggagaaattaaagctcaagaacg

SEQ ID NO: 111015 - DNA, 1039 bp, Homo sapiens
tttaaccaagttaaaagatcactcttcagaagattgacagagtttagagaatgttaaatagaatataagatttatagttgatctcaattcaaggaaaatacatttttggatttgttattttaatattaattttaaaaaccgaagtacctgcagataatgcttttgagggttgtaggggacacccagaaaatctccttgctatctcccattcccaagcagtagtgtgtccctggtctttcttctcaccccacagttcttcccagtcttctaggctccctgaccaacctctggcagtgtcagaatatatgcaccactcatagctcaaacatacatgatacccaaatgcctttctccagccctgcccccctacacagctacagatccattaaaaactacttccggtagggcatatctgcttgcatatccccagaccccatccaactcaactcacctgaaatgcagtctatcggtgctccaccttcaagcccactgatgtgctctcctttctgctattgtctcagctgatgacatcatcaagtgctctttcctctctagggcaaagactggcttggacattgctatggtttgaatgtgtcccccaaatttcatgtgtttgaaatttaatcctcaatgcaacagttttgagaggtgggatcctaaagaggtgattaggtcacaagtgccctgccatcatgaatggattaatgccattaccttgggagtgggttcctgataaaaggaagagttctggccctcttcccttctttctttctcacgggtttctctcttgcctttctaccttctgccatgggatgttgcagcaggaaggacctcatataaaataaaagtccccctgacctcgaacttcccaaccctcaggactgtaataaatctctgttatttataaattactcagtctcaggttgctatagcagcacaaagcaggctaagacacttgtcaacgttgcctctctttgaccccctcagtgcctactacctggcaactgtaggtacgcaaaaactcagttgataaatatga

SEQ ID NO: 111016 - DNA, 1036 bp, Homo sapiens
aggagagagagcactccctcctgagcaacctcgggaagattagaaaaggcttgtgagcgaaagcgaatggtgctggtgggtccagagcacactgaggagagggcacgtgaggacacagtgagaaggcggcatctgcaagctggaaagagctctcccgggaatcgaatttgccgacttcttgatcttggacctcccggcctccaggactctgagaaaataaatttcttttgtttaagccacccagtctagagtattttgttatggtagccttagcagagtgatatagggctctgatttgaaagaatcttagaagttatcccacccaactattttattttataaatgtttttccggactcaagactggaagcaagaactggtcggaagacaagaaaaaacctacaatttgtcccctaattgtagatgaacctacgtgtgcagagttggaacccaatattcctttaaagtacagtaaaaataggttttgcacttggaaagactgagcacggtttagaggccttaaacacccccctactaggggtaagacactctgctaattgctaagacactaagaggtagaagatctctgctgtttgttaaatgactcaccaaccattcaggcaacagatatttcctgagcacctattatgtgccaagtaccgaacttgattccagggatgtagaaagagtttactgtccaggaaaggagacaagtatatagatacatgactaatatagtgtcataagtactagattcaaatatgtcatataatatgctatataggacaaggagctccggagtaaccgtaggaagattagaaaaggcttgtgggcaaaggtgggcagacagtggttctggtagatttccagagcacattccaggagaactatgtgcactcccactgccctgtcctcaaacagcatcatctcttttgtacctggattactgactgcaacatcgccttactatcacctatacctgctagtgtctctggctaacatatttgccacaaaggagtcacgatctttttaggcca

SEQ ID NO: 111017 - DNA, 1103 bp, Homo sapiens
gaagatggtctcgatctcctgacctcgtgatccacccgcctcggcctcccaaagttctgggattacaggcttgagccactgcgcccggcctagaaccctgcttctcatataagatgggcctgcacctacctctggcatgtttttctttgtgtatttcctgtttttcatcctgtaactaatgctcattatttaaaacactccagttacttttccctttaggcctggcaaacttttctttttcttttttttttttataactgtacattttacaaaacacctgaaaggacccagaggcataaatagtattacatgatttatggtagctctggggtgagctgtgggggaggccagttacaaggtctccaagacccgcctccatgtcagtgttggggggtgccttgagcacttcttttatttcatataggaaaatgcacatctttcatttgtctcccaaaagatgatttccataaaaatatacttcaaagtatttactgtacatagacttcaatgattttatttccagcatcaaactaaacatttctaaccttttaaataaatggggaatttagtttcatgagaatttttactgacaactaataaacactgtatgtgtacatattcatatacactgtggactggagaaagtcagtatggaaataaatttcactgagatccagaaagtagcaatataggacttttaggggtatgtattagtgtaaataatatatgtgcagtctaggctaatcattttaattaaaaacaaataagcatacttttttgctttaaaaatatgccctcaaaatggtgggggataaaatgtaagatattctttagctttaattatttttccatcttattcaagtcagagcacttttttttaaatagcaatacaacaggcaagagaatactcaaaaatatttaaaactgtattgataccaagagtatgttttaaatattttctaataaatacttgagcggtttttgtctggcaggcttccaaatttgccaaaattaagcgttcagtattttcaacacatacgctttttactggtttatactgaactatctgatgagaattcctgtgttcccaaagcaactgatgt

SEQ ID NO: 111018 - DNA, 1013 bp, Homo sapiens
acctgaaagtagttccagacttgactttgttcagttttacagtaaaaatctgcagttcttgtacagttttggcaattcagtgcagggtattacgtatttcattagaattaaaaacttgatccatgctgttttattggacagtgtttcctttttagctaaggggataaaggtcctttactcatcatctcatttgggaaataaatctctttctttctgtctgtctccctcattcttcctcttgtgctctgtctctattctctttgaatattatattgaatataatattgaatattatggttgaccaaatgaatattatattgaatataccattgaatattatggatgaccaaatgacagaagaggataacatagataataataaggtacatatcttgaaggacaagctgtaaaataagtaaaaagtatgttcttcaaaacacttctagcaacttcatgctatttcttcatatttctgcaagctgggtctatctctggttttgtttagtgtttatagggtacacatgattttggcaggtgggagaacgtttcgttccttaaccttgtgtgggttcacctgcatggtatgtgtatttcagcatacacggggagctctataattttagtcctgtcctgggttatgccagtctgtaaaacaggaaagtaaaaagtcacagagctgttcattaaatgagatagttatagaaagtcatttgaaaagcagggagctattttacaagtatgggcctttgtttgtgatgtaaacgtagacattgacaagggccagttgttagaatgacttaaaaatacaatccagaaccctgaaggtacaataaagacctaagatggaatatttaatcattgtgttcttacttgaaatcccaaccgtgctgtcttggatggtcagtagagacttccagtgaactggctttggtggggctttagaaagacacctattgaaggcacatcacatgggaaaagcaggagcaagagagagaaagggggaggggcacata

SEQ ID NO: 111019 - DNA, 1062 bp, Homo sapiens
attgacaaaaattatctatatttattatgtacgacatgttgttttgaaacatgcatacattatggaatggctaaattgagctgattgacatatgtattacatcatatatttatcatttttttgtggtgaggatatttaaaatctctcttagcatttttcaagaatacaatacattgttattaactgtagccaccatattgtgcaatagatttctgatacagtctttagagttgtaatttttcctgaaagaggtttttgctcaaatttggatttgatggcctattcctcctaattgaaattttatgtcctttgaccatcatctccccaaccctcccttcccattttgccccatttttaaattgggttatttgttttcttgcttttgagttgtttgtgtttcttatatattttggatagtaaccatttataagatgtatggtttgcaaatattttctcccattttataagttatctcttcactctgttgattgctttgctctgcagaagctttttagtttgatgaaatcccatttgtccatttttgttgcctgcgcttttgggatcttatcaaaaaatcattgtccagatcagtgtcatggaactttcctcctatgtgtttttctagtagtattgcagtattacagtagcatttcttttatcaaaacaaaaattcataatattagacatctgtttttatttttgttttattcagactattgtattgatttttattttagtaatttatttcagtgattaaaagctgggttttaaactccttacttttaattgtgccacttaactaccaatggttttgggcaagttacttaatgttttcaagccccggttatttcatctttaaaatgagatcgttgctggacatacatgatacgatatatgtgtagttcataagtcaatccttggcacagagtatctgctaaacattcactgctgttaacaattgtcatggctggtggtcttaattatttattaggtcatttctgaagcatcagcttttggtactgtgaattcctttttacatcttaagaacattacagctttgga

SEQ ID NO: 111020 - DNA, 2081 bp, Homo sapiens
ggctgattttggccaccactgcccagagagcggtactctagatctgggaaggttagaaggaattaggattgctcagctggtttttttggcccgaatctgtctgattctgattatagaaatttggtccaagcatctgaagtcctgaccacatttaactgatttacaatgagatattctctgcacagcacactgttattcaacaggattatataaacgaggattggatttgatcagaagacatgggtgcaaatctgagcttcacaatttggacattgtacttaactgccctacccctggtttccttgaacgtgaaataaggtattaaattcattgttttaatccaagagccaagagaaagtctggaatgtagttggttctcagtagaaggtagtcatattgtgttgtgctgctcaaatcacaatgagcacgagtggccttcaaagggtgacgtgttttccgagcctccaacttgttgtaattgattttcaaattaaaaattaattcttcgttatgaaaaattttaaactcaaaagtagaatagtatcatggatgtccatgatccatggagtaaattaattataatacctacagttttttgggtattctgtacttgggcatgctttgaaaggcacattccgtgtattagctaatttctgtaatcctcgccacggcagtctataggtgctagtaccccattttgcagatgaaggtcttaagcacagagagtttaaacaacttgtttagagataccagcaagaatgtgatagagttagacttgaacctgggcagccttgcttcaggtgtcacagacttcattcaactgggtccaagacgagcaggtcccatgagtagagcctgctcagattgagacctgctgggtggccctatctgattaccccaatgaagtataggccctgaaaaaggaaggaagggaatattcattggtgttttaaaaattatgtattcattaaaatttttcttgcagttttttttcttttcaaatctcatccccccaaaaaaagtatgtttgggacatttaacatgacttgattttccaactagaaaaattctgaaaattttacttctgggccagactctctggttctagacgaagccagaagatctgcactggaatgcagctagtgaagcaggagaggagtgctatgtgtctcttctacaatctgatacagtctttagagttgtattttttcctgaaagaggtttttgctcaaatttggatttttagccaaacaattttactgcaatgttttgttttattgtagaacagactcaaatattcaaatacaaatgcatatccacttattggttaggtttctttttttatttcttttgtttaaggtgtttgttaccagaaactaaacttatattctaaatagaatgttatcaagactgtggcaggatttctctctctcccttctggttccttctccctttaaaaccccaaatctgatgttgggcatggcctccccattcgtctaaccctgctttgttggtctgagttcttgtttgtggctacatctaacttgccctcttgccctctgcctgatttattttggcaatgcggttaaaatggtcttttttctgcagaaaatgtgttttggtttctcctgagaagaataagcttttgttcttcaaagttaaataaattgaattgctttcagcctccaaatgccactgccttgtcttcattgtcactggtctttggctttttaaaaatgatcctgtcctaagcattctgtgtcgcatgtttctgaagtctgccctcttttgttccattcgctgatagtgtcctgttggaaacattgatttagtaagtttacataaccatactttaaaattttttattgaaaattaatcagattttaatggacacatgaaagttgcatatatttatcatgtgcaatgtaatgttttcaaatgtgtgtacactgcgatggctaaattgagctaatgaacgtatgcattgccacacatacttataatttttttgcgtggtgagaacactccaaatctactctcttagcaatttttaagaatatgatacattgttattaactgca

SEQ ID NO: 111021 - DNA, 1036 bp, Homo sapiens
atcgagacaatcctggctaacatggtgaaaccctgtctctactaaaaaatacaaaaaagtagccgggcgtagtggtgggcacctgtagtcccagctactcaggaggctgaggcaggagaatggcgtgaacccgggaggcggagcttgcagtgagccgagatcacgccactgcactccagcctgggcgacagagcgagactcggtctcaaaaaaaaaaaaaaaaaaaaaaaaaaccacacacacacgcaccagaaccctgtgataaattgatagtggcttaactttcatcttaactcctttatttctgttccggcttgagtggtatttatcctttccatgtttcttatcccttgtaaaagagcaacggtgacgatttgggagggatcatgccctaagtgctccatggaaccatcagagcctgaacatgaaggcagaagagtttacacttacatagggaagggagggcgggcaatgggggagaggtcaggcagggacacagcaaaactgacatgaaccctggagtcagactgccaggttcaagctccagtgtgccactcactaaccctgggacctgggcaagatacttgagctttctatgcctcactggaaattggaagtggtgctctttgcctcaggggcgggagtgagatttccatgaagttgcacgtgtgaaggcagggcctggcacgtgggaaatgctccgtccatgctactgattattaccatgtgattcattcatttttggtcggtgtggctgagtggaggagagatgtggcttttgggtgaagcttctctgataatctgccgggctcagagggttgaaggtgctctggaagcaatctggaacaactctgtgcacctaaattttctgagacatagggactctgatcattttctagtgttagttagccctcgcggttttgcctgtggggagatctggcgtctcttcctgagtttaggagcagaataggagccttcttaaagagagaaacagtacagaaaagtctaccattggcttctcagccagttactggtg

SEQ ID NO: 111022 - DNA, 1047 bp, Homo sapiens
catacacccagtctggtctcaaattcctaggctcaagcaatccacccacctcagccttccaaagtgctgctgggattgcaggtataagccaccatgcctggccaatacctgagtttttaaatgccttttgcatgctctgtaaaatatccggcttagtctgtgatgtggctgagtagaaatcagctggaaggttgggcaggggccaggggaatgtactggataggaatgcatgttcgaatatgttgtttttcatttgtgtcctaacttttggctgagttcatttgagatcctctgggtggatgatttttgctttattcataattcttgtttattagaaaagcaaaccccatcacctctccccattcccccctcagatttagagttacaaaagtggagcacaagtcaaaccagaaggaacggagaagcctgatgtctgttagtggggctgaaaccgtcaatggggaggtgccggcaacacctgtgaagagagaacgcagtggcacagagtagcaggtgagccgtggttttggtgacattgggggcagagtggtgcagggtgaggagaaggtacttggagcctcccaggtgctgtggcagcataggaatggtatttgacagggaagtgggagagctttccttgacccaggaagactgagggggactgaacatgattacttgtctgcctagagcttcttgtaaagaagtcacaaacttagtgcctccaggggcttggcctgtgtgataatgaggatagaggattacttgtgaggcaatgtggcatggtggggattgtggcaaactagaattcacatcacccaccatatagggcttgcattaccacgaggcagaaagcacctagtgttgctgcatcttcttacgcaaaaaaagacaaaatccagacttctaaaatgtaaaatcactgattttcgatattggcagcttacttttttttttttaaacaaccatgcaggccaaatgacttgtaatcttgtcaccatttttaggtaaactgtgacttgaaaaagtctggagcaaacaaaccaatgc

SEQ ID NO: 111023 - DNA, 1031 bp, Homo sapiens
tgtgacccatatgtgaggtggagatcttgcagttcaagtgatgaatccattggcccttacctgaagcatctttgcagtgggatgcttttgcagttctgctgttagatgctgagtcccatgcaggaactgcattgccgatgttgcatttggaaagacagtggggagtactggtaaggaacacacatgctggagtgagaccgggtgagcactgagcgaaagtcaacagtgctgcttacatgatccttctctctcagtatactgacaacccccctgggaagagtaacctgaactcgtcacttctacctccttcaagtcctggcaccactacttacaaactgttacgttgctccatgcctcagtttccccctctgtaaagtgagaaggacagtcacactcacctcatagagttgctgtgtgtagactaggtgaggtgactcacataaaggtcttaaaccagctttgggtacttacgcactcaagaaatgttggctggtattatttttattttaattcagttgagtttcatcatgtgttgcacaagcatcatggagaagacttgcagggctgtttgccacttacagcaaaacagcacaattcatgaccacactgttttattaagaagcagagtcatgggaatttatgaatgcaaagcagtgagaacctgtagcttgtttggacaaagcatgttttgttggccttaaaaaaaaatctgctgaaattttcaactcagattcaacatgccttttttttttttttttttttttttttttttttttttttgaggtggagtctcactctgtcacccaagctggagtgcagtggtgtgaactcggctcactgcagcctctgcctcctgggctcaaacgattgtcgtgcctcagcctcccgagtagctgggactgcaggtgcccgccaccatgcctggctaatttttgtatttttaggagagacggggtttcaccaagttggccaggctggtctcgaactcctgacctcaagtgatccacctgtcttggcctcccaaagtgttg

SEQ ID NO: 111024 - DNA, 2734 bp, Homo sapiens
gctgggattacaggcgtgagccacagcgcctggccaatacttgaaattttaagatatctggccagtcaagggcttatatgatcctgaagctcatctggaaaattaaccttctctcatccctgaatcgatatgggatagaattgatgctacaggaggattcagagtttagggctaattattttggcacatacaagttattagactataggtcacttatgaaatacatttcactatcatatttttcaaagtatatttatcaaaattagttaactgcaagggagcagcggcatataaatggtcctttagtttggtggagttggtgtggggtgagggggtggtttcttctactttatattgctattgatgtgtaagaagcaatgccttatagtagatctgctctccttgccatagattctttgtcattcttactaagttcctgtggggtggaagttactgacagatggtgccatgttatgcagttatgttgggggagaccctcctttctctaggcccccaggacttcatctatgaactgaaagaatggaattagatgtgttttcaacagcttttctgatgtgattactcatcttattcattctattttaattctttaattttatttttattccttagcgaatgctgatgtcttaaaggcgatggtagcagataacagcctgtatgatcctgaaaggtgagtgctcctcccctctttcttagtgcgacatcttttcagttacttgctcagatatggcgccatctgaaatgctcttctgctagagcaggtttcccagctttaacactatagttattttgggaccaggtagttctttgctgtgcggaactgtcctgtgtattgaggatgtttgatagcatccctggccttcactcacaaggtgtcagagcatcccctgcccccaccctcccaaggtgtgacaacccataatgtctccacacattgtcaatgtcccgtagtggggacagtcactcctggttgagaactgctgtgttagagaatagtgatgggaagaaggaaggcatagaggttaagggcaagaacatagccttggaattgggagatgtggttgagtcctgcctgtaccacaatattaactgtctgttcttgaggaagttaactgaccaccctgagttccatcatctataaaatggagatcaccacagtaccagctttatagggttgttataaggaatacagagtaccttaagcattgaaagacctccatgaacaatgatgattaaatgaacaagctggtttggagctacctgctatgttctgtttttgtattactattttaggttatggttgttgagcagcatattccttcataattaattacagagaactgtatttccataaaagtattatttcttcaacaaggagcatttattggatgcctactgtgtgctgggtgctgctctggagctggacatccacagacccttgccatggaggaacacaggattggagatgtgtgtgtgaggcctcatggtggagagcctgtgaatgctgtaggatgggtggagactgaaggctctgggggaccccggggggccaatgggcattcaggaaggttcatggaagaggtgccatctgaaccaggcgtgcaggaggtggagacaagagtcagggctggctgtaggaagaagggccagaagaaaagtcaccacatcatgatagcctgggactcacctgtgaagggttcagtccagggtggccaggccaactgacatggcaaaggggctggatctttcttcacttgctatgtgggttgtgcactcagcacaccttagatgtttaacaggtgtttgtcaaactggctacgttagatgtgtgttttagaaaggtaactcagaatgcaaggagttgagtttaggagagacgtagagtcatagagacagaagagctctgatttctcccacattccagtcctggccacagacggctggtgttctgaccatcttagctcaaggtgtctttgtctcagtcatctttgggcatcctgtagtgcccgtcagtgggttttgtacatagctggtacttgagaaatgcttgttgaatgaatgttgttaaactcttgcattcagctttctaatatgtggtgctaatttaacattattttactccaggaaggtactgctttgtgtttttattttaacaggtaggaaggcatccctaaagagcaccagaagacttttggctcagtcatgtttgaggcggtctcctcaaccgtaggctctacttcttttttaagtgtgtaggtggccagtttgcatcaccgaaaaggctggtttctgccatcacagcctcctgtgtgtctctggggctcttgccacagtccaggtgtcaggctgtgggtgccacgccaccctcagtactcccacctgcaccagagggctgattcctgctcagtttggctctgttaggttagaattcctccttttctgctgggccagagccttcacacatgctttttgaaaatagctcttatctcgactatgtatttctgctttttttttttttttttgagacagagtcttgctttgtcacccaggctggagtgcagtggcgcgatctaggctcactgcaagctccgccttccgggttcacaccattctcctgcctcagcctcccgattagctgggactacaggcgcccgccaccacccccggctaattttttgtatttttagtagagatggggtttcattgtgttagc

SEQ ID NO: 111025 - DNA, 1057 bp, Homo sapiens
tttttcttttttaatgagctttcttcccatttctcataaggctttaagaaaatgatgagagagaaataataatgaagactggtacaaatgcattttcaaattattgtcttggaaagtgagtatttgaacttcagaagagatagatggacagctttgatactttctctttatgcttgttatgcattaggaagtttggggctggagggagaaagcctagaattgtagcaccatgggtgatctcctgaggcttctggaaactgttcagtgaggtcttgggttctaagattgattgacttgatgctggtgaccaattgtaacctgttctcccctcctcttttctctttcagaattgaatgacagtgtgaatgaaaacagtgacactgttgggcaaatcgtccactacatcatgaaaaatgaaggtgtgaacattttagtgttccaaaacaattcagtattcctatcctttattaaaaacctgcttcgaagagtcaagatttatatagactctcttactgacttcacctaagctttctaacacctcagcttccagcattattcagctacgcaagtttcacatgagtgagttttctaagcgtgagtcggtctaagcgttgcagagacccagccctggaggcgctgtcagctggtgttcaaatcctggcctcactgcttactggttgtgtgcaatttggggaaactatattgccttgtttcatgaggtagagtttcttcctgtaaaatgaggataataatatttacctcagcctggcacggtggctcacatctgtaatcccagcactttggaaggctgaggtgggaggattacttgaggccaggagttcaagaccagcctgggcaaaatagtgagaccccatctcttcaaaaaaagtaaatagccaggcatggtggcacattcctatgttcccagctacttgggaggctgacgtgggaggatcacttgagctcaggatttcaaagctgcagtgagctgtgatcacaccactgcactccagcatgggtaacagagcgagactctgtcaaaaaaagaaataataag

SEQ ID NO: 111026 - DNA, 1029 bp, Homo sapiens
tctccctgtaatttatatgcttcactaatgtagattaatatcttcagttttttcatggcacgataattatgaaattaagtgaatgacacatgtttgtaagtcacagagctctgtagatatttagtgtttgttaggggttgccacatgtcaaattcacgatgaagacaccttctcaatcacctgattcagagggaggtgtttgactccaattctgagcccctctttcatccctctttcccattgtccccctaaaaaagaatttattttcacccccagattgaaacagacagtgattctgagtaaagctccttgatctcagcatgctgcctacttcacctattcttgttgcgtggaatatgtgttatataaaggaattaataaagaaaacattgttttaggaccataaaagggattaaataaatgtttctggtttttcctgaaaataaggcatgaggttaaaccctaacttagacggtatattgcatatatttagggatgtatttattatattgattcttcagggagaaatcagaaaacactggctatttcaaattctggaggttgtctgataaagtaatgaatgcaacctcttacaaacctaagaaaccaattatttcctttcatgttcaaagacaatggatatttccatgcgaaagagaggtagtctttgttctatggcctctggtttgcaaataaagcttctgtttgatattgtttgtttgctgctgtgatgaaccgtgctcatttcataccaggcatattgtccccattataatcattatgatgcaggagttttcttctcggtcactttgtaaactggggacctcctggctggcgacgctctgccccagcctcgacgccctgcttggccacgctggcgtgcttcagctcccctgtggtatagcttgtacccactttcagcagttcccaagctcttgtagcgcacccaagaagaatgaggatacacgacacactgaagggtgaggagggcggagaagaattttattgagctatgaaaatggctttcag

SEQ ID NO: 111027 - DNA, 1043 bp, Homo sapiens
gtagcagttagccacacatggccactgggcacttgagatgtggctaatgcaactgaggaactgaatttttaattttatttaaattcatttggcttaaatttgaatttaaatagctacatgtggctagtggctatcttactgaataatgcaggtcttttatgattatgactaaaatacagtgcccacctttttgtagacactcttctgaatgctttacatattaatattgtttaatcttcacagtgacaccatgcagcaggcttccagttactattgctgtatgacaaataaccccaaagcttagtgggtgaaaacaacaatcatttcttttgtttaaggatttgttatacaatttgggcagggttcatcagagacagctctgatgccccatggagcatcagttgggactataggatctacttttattatggctattactggctgataagttgatgcctgctattttctctccacagggaagcttaggcttcctcacagcatggtggctgggttccaagagcaagtgccccaagaaacaggaagtggaagttgtcagtttcttattgcctgaggctggaaagtgataatgcatcattcccaacacattctgtgggtcagggagagtagagtgtaaatgtaaggggacgagatacagacctcacctctcagtagaagcagtatcaaataattttgaagctggaaaccaaaaagtatctgagacgggtctcagtcaatttagaagtttattttgcaaaggttaaggacatgtccagagaaaaggatctcaaatccacaggaacaatctgtggttcatgccattttcctaagaagattttgagggtttcaatactcaatacttgtattgagtattcaatacttgtattgaatattgaggtttcaatacttgtattgaatattgaggtttcaatacttgtattgaatattgaggtttcaatacttgtattgaggtttcaatacttgtattgaggtttcaatacaaggggaaagagggagcagatgttcacattactgaatctacctgt

SEQ ID NO: 111028 - DNA, 1048 bp, Homo sapiens
gaaaagacttcattcatagcctgaaacttggcattttcagtggaccttaaaagggagtgtatggaatggtgtgctgagcaaaggaaacagcctgtgtgcaaaggcatggaggtgggaatagagaagttaatgcagactgggtgtggcagagactcctcagtggaagtcatgtgagatgaggctgcagaggggagactgaggttaggcgacagagcccctgaaactgcactttactgtgtagttgcggaggataggggacaacaagaggcccccatgcatttccatgtgatagaagagccccagaggctgagccgaaaggagacagggccctgtgctgtcagcagggcagttcagattgccattcccatttccttatctgcagaagtgtaggtggtagggaggcagagggtgagccatcaaacataatacagtcctttgtaagtaacacaaataggatctatgcagcagaatagatttaatgcaatccatatgatatgcagatagaaacaatttttcaaagtttaaggagtgctgagaaatgagaatcatgaagtaagtgctaagtatatagttttggcctagtgtggtggctcacgcctgtaatctcagcactttgggatgctgaggcaggaggatcgcttgaggccaggagttcaggaccagcccgaaaaccatagcaagaccccgtctctacaaaaataggacaaaaattagctgggcatggtggcatgtgcctttcatcccagctactcaggaggttgaggcaggaggatcacttaagcccagaggtgcaaggctgcagtgagctgtgatagtgccactgcactccagcctgggctacagagtgaaaccctgtctcaaaaaaaaaaaaaaaaaaaaagaaaaaaaaagtatatagtcttgatggcttggtggtgtgaaagccaaggagtgttcattaatggttaaagctcgctaattatgtatttttcttaagttagagtaaataccttcaaattatacaaatcagcttgtctattgaattcttgattacaggcatgagccacca

SEQ ID NO: 111029 - DNA, 1038 bp, Homo sapiens
tcaaaaccaattgtttcgtggcttctttgatttacttatttatccaacaggtattaacaaagtaccttacagtgtgcaaggctctgagaatgaagtgatgtgaacaaaatagactcagtacctgcctttatggagctagtaggttatcaggaaggcaattaaacaagcaaaatgacatgccctgagtaccttgtcaaggaaagtatgacacagggccaaaatacctaacctagggctggggttgggacatgcatggacaaactagactccagtgcaggttgggcatgctctctggaggaaatgaaagtgaaatttacagctgcaaaaactgcaggagttggtcaggtggaaagaacttgtggtcaccgaagagaggaggtaagatcaagcaaagcaacagcagtggttcccaaacttgagtgttcagaagtccagctggaaggctggttaaaacagatctctgagccccacctgagagtgctgagtccataggactgggatgggtctggagatttgcttttcaactctcatgtttccaggtgatgctggctaagtatcaactgtgagcaggggagtgaaagagataagagtagatggaatcccctctcctcttcttggggctgtatgtatcctgtcctctgaccatccttcaagctgagatcaaggatagcatttccaggaaacatttcctaggtattctcactgcctttattgcctcctgtgaatacactgtccacaagtctatggatacatgttgcatcttttccatgttatttagccctcagttacatgcaattgtttccaccatgtttgttttgtctaactagagcttcttgaggcagctgagcatatgaaatgtgtacaaaatatttgattgcctgatcaaatttaattcttgcaaccactgtgtggagcaggttgcatgttattctctgttctgtggagatgtggaaactgagacttacagggaataaccaagatgaagagaaggggaatttcttgctcaagtcagaggaggggaagtcaacgtgaggtgtg

SEQ ID NO: 111030 - DNA, 2133 bp, Homo sapiens
tgacatgttttactggatgggacaattttttttttcttttccttattttgatacaggggctcattttgtcacccagactggagtgcagtggcacaacctcggctcactgcaacctccagctctctggttcaagtgattctcctgcctcagccttctgagcagctgggattacaggcatgtgccaccatgcccggctaatttttgtatttttagtagagatggggttttgccatattggccaggctggtctcgaactcccgacctcaagtgatcctcctgcctcggcctcccaaagtgctggtattacaggcatgagccaccatgccctgctggttcattttgattttcatcctgcgtttgattgctgggacacataggtgcataatcaggttccacttggatgtgaggttggagacattcattagagggttagagtcagttgcaacagaatctggggaagagtttaatctgggagtaaaattattaaaaattcagcacatgatgcatgtaattagccatcatcagcaggagaaatccatccctagagtgggtgtgtgtttggtttgacctctgagcaacacccaggtctcaggactagaatgtgactgatgaaagctctcatctaattgcatgacagcctttttttttttttgatgaaaattaatgcggaagaagaaacaggtgtctaaaaaggaaaggatacagagcacaaatttgccagtatcttgaggcgtgtgtaaagagaagatgctctgaccagccaacatctgatccccttgcaaccaaagatggtgttaatgtttgtaccttgagcatagggaagtagagggaaaggaatgggaaatactgttgagtgcctgctgtgtgccaggctttgggttgagtactttgtatgcatttttatttttatttatttttttctttttgagacggagtcttgctctgtcgcccaggctggagtgcagtggcgcgatctcactgcaagctccgcctcccgggttcacgccattctcctgcctcagcctccagagtagctgggactacaggcgcccgccaccatgcctggctaattttttatatttttagtagagacggggtttcaccgtgttagccaggatggtctccatctcctgacctcgtgatccgcccaccttggcctcccaaagtgctgggattacaggcgtgagccaccgcgcccggccgcatttttatttgtttatttatttttatttttattgttttttgagacagagtcttgctctgactcccaggctgaggtgcagtggtgcgatctcagctcactacaacctccacctcccaggctcaagcaattctcctgcctcagcctccctagtagctgggattataggcgcccgccaccatgcctggcaaatttttgtattttttagtagaatcggggcttccccatgttggctatgctggtttgtaactcctgacctcaagtgatccgcccttctcgacctcccaaagtgcagggattacaggtgtgagccaccgcgcccagccttcataggcatttttaaactcattgctcataaccctgtgaaatacttacttccagtaaggcaactgaggcaagagaggttaaacaactggctgaacatcacataggtactgtgccagtcagcattcagagaagcagaaccactaggaggtgtctgtgtatgtgtgtacctttatatgtatctttatctgggataacccagcctgcttgattccaaagttcattccctttccactgtaccccactgctctgcagaggaaaaatagaatatgagtcaacctctgcaatctcgctgagattctaagatagtttagaacgtcataaaattgtaagcatgtggttatcagaagttgtcaagtagagaaaagaagggcagatagcttcacggtgggtagtggcaatgcctttttcacttccttcctagtagaagaatctcattaaacttgtctcttagcagcagcattcgaaactatataccacaagcacccaaagggatgattttccacgtcttggcttattaatgtccttaagttctctggttactcaaccttcaggtttattagtttctctctcagacagtgggcatagccctcgagtaaggagtgggt

SEQ ID NO: 111031 - DNA, 1044 bp, Homo sapiens
atagcctaactgcgccgccaaggctgctgctgggtttggaaaggaagcgggagaggaggggtcgggctgagctgtgggtggggaaaagggcggggccatggatgggccacgtgccttcttaggtggagtccggggctcggtagggagaggcggggccaagctgaggtgggtggagaaagagggcgtgtccatggcctagctacgccgctgaggctgctgcggggtttggaaaggaagcgggaatggcagggagaggcgggatcaggctgaggtgggcggggagtcgggggcggagccatgagtggacctcgtgccggcttaggtggagcccggggcgcgcggggagaggcgggaccgagccgaggtgggtgtggcgtggggcggggcaatggcggggcggggttcgccgctccctggggcccagcccagccactcgatcagcccgccggctccggagcggctctgccttcccgagcgcgggacgcggcgccctgggggaggagggcgaagcgacgcggcgatggctccgcgggcactcccggggtccgccgtcctagccgctgctgtcttcgtgggaggcgccgtgagttcgccgctggtggctccgggtgagtgtccggtcgtagccggggcgccgggtgctgagcccggtcccgggagcgcggaaggaagcgaggggtcgggacggcagccccgcggcgtcctgctttctggcacagccgcgggatcccggcactgaacaactggctgtcccgcggcggtccgggcagggcgcggtgcgtggcaacggctcccgtccctcccctcccgcgggccccgctcccgccttccctccctggggcctcctccgaggatctgtgttccccagcgctgggcagtgcggggcgtagggaccaggccttcttcgggggcgcttcctccacggccgctcgcctcggaaccccgcggacccgtttcccgccgcccttgtcctcaaaggcgccgcgagcggaagatcgtgacacagagcaccgggtgcgctgtcggcgcctccttctccctttt

SEQ ID NO: 111032 - DNA, 1072 bp, Homo sapiens
taggccgggaaggcttgtccccggacgaaaccagccatccggccggccggactgcaagttcggagtagaggagcgagccagggtggtgtaagcgcggccagaccctggacgctgtctagttgaggggcgcacgccttactgtcactcagaccgctggctcgtcgtcggtagtcggctgtgcatccccatggacccagaatcgctccgtcccgcgtattcctttggccgctgagacctttgcagagcagcgttctggtccggtcctcccatcccgagggcttggttacaaacgtgggttgtcctcccgggtgggcccgcctggcttcaggagtcccccttagaactttgactgccagggaggcacacctgggacacagcacggttttctctctcttcattccgtttcttagaatcaggaacccagctctggacatcactccctctcctctctataaacttgcgtctcgccctttcgacctgttctgcttgctgttaggttttctcggaatgtccctcgctgctctcctgctgaacttgtttctcccgttgtgactcatattttgtgcctgaacttaaatgtggcttacgtagagagtcagtccttccttggctccgaagcgttaaattatttatccctaatattcactctaaacagtctgttattttcctttatagctcttactacaaatggtaaaaacaaaaaactccaaaaacacttgtttgtaggtttgtttaatgtctgtctccagggccgacttcaggggcgagagacccctgcagtctcacaggactcgcgctccttgaagggcccactgttgttttaatgtcctgctgtcctgtcttgaaagtcttactggtaaaacaagaggtcacccactttcattgtgcactggacctccataaattatgtggccaggcctctctattctcactaccttggtttgtagtgcctggcataggcatagtgcatgacacatagtaggtcactgaaatacttgaatgaacaaagaagattacaaggtcagtaggggtcaggtctttgtctttatttaccattctctggcccctacaa

SEQ ID NO: 111033 - DNA, 1039 bp, Homo sapiens
tccgtaaggtaactttctggcatcaaaattgtatgtgcattcacaaagttgatagtgcttagcaaattgacctccaaaaatataccagttggtgctcccaccaacagtagatgttgacagcatatgatacctacatttcctcctgctctgtgatccaatttctcatttttcctgatttgctagttgaaagtaatagctcacttttatttgtattctttaattaacctatattttctatgtgtttgttcaccttttatatttataaacatctttgtttataatatatatacatatatacatattatatatacatatatgcatatactatatatataaaatatattttttagatgttttctgttgtctttggaattttctattgaaactgtttgctgaactgtttaaaaatctgtataatatttattagtcttattttatagcttctgggttttatgtcatgcttaggaagacatgctctatagcaaaattattaaagtaatagcaaaatatttcccttgttctttctctagaactatcatgtttgtgttttataatatttaaatcttttgtttcattagtgatttttaattttatatggggcatgaagtaggaaagcagattagatttttttctaaaaggtttgcagttgtaccaacatcaatggaagaatctttcttttttttcttttttgactaattggaaaggtcacctttatgcaacaatttctaacattaatcaagtgcttattatatatcagataactgctggaggcccttcacatgtcattttttttcttttttttttgagacaggttctcacattgtcacccaggctgcagtgcagtggcatgatcttggctcactgcggccttgacctcccagattcagggaatgctcctgcctcagccctctgagtagctggtactgcaggtgtgcaccaccatgctctgctaattttttgtatttttttgtagagatagggtttcaccatgttgcccaggctggtctcgtattcctgagctcaagcaatccacccgcct

SEQ ID NO: 111034 - DNA, 1036 bp, Homo sapiens
ttgctaaatttcacttctggagctgtcttggttggtcctatattatctttctaagaggggaaagacctcttgagttcttaaggaactgaatgtttttaaagactatcatatgctcgattcttgattaaataatcttttattttcatattcttcttcagactttgtcttttgctttggctgacaaaaccaaggccagaattgttttagctaacgacccggatgctgatagacttgctgtggcagaaaagcaagacaggtaaaattaattgtgattacctatattatagaacatataaaggatgatctcttcattggtaaaatgtttctggggagacgggacctatttggaaacatttcccatttattttgcaaatgatcatttcactgaacctcctgtagagtcttctaatggagagcaagatagagatctagtgtggggggaggttacgtgattggcaagcataatgcagagtaaatcaacccagtatatatttcaaattgaaactcctatttgggaacttctcattttgtaattgatctttttataagtaatgtctcagtgtctaatgagggtaaagcactttggtgctagctgtatgcttcagtatttgctgaggggtttaggagggagcagtaccttcaaggagatgctgaatttagtttggacagaccagggaggaattcctgtggggtatcggcacagtgtttaagacaagtctgaccagagagtttgtacaaaggagaagtaagtacgtggggctaaagttgaaaggtaggcagggcccaagcaattttgggcgtcaggtagcctatgtgatgttttgggggcaggagggtgctgctgctgaaatggtagggttttcagattgtgataaaacaggttccattctatatcagtgttgagaaagttaagctaagatgatacgtcctgataggtgagatttacttctagccatctggactgccaagagaagcagaaattacacatcttttctctgatgttctgaccatttaggactgagcttgatcttaaggg

SEQ ID NO: 111035 - DNA, 1051 bp, Homo sapiens
gtcaggagttcaagaccagcctggccaacatggtgaaaccccatctctactaaaaatacaaaaattagccaggtgtggtggctcatacctataatcccagctactcaggagcgtgaagcaggagaactgcttgaacccaggaggcagaagttgcagtgagctgagattgcaccactacactctagcctgggtgacagagcaagacttcatctcaaaaaaaaaaaaaaaaaaagaggaactagtcatcaaagcctgtgtggtcatttcgcaccttaggcaataagtgatcagaagtgtggaacctgtctgtggacacagagcttagttggtggtggtccagggagaatctgggttttctatctcaggatccagcattctctccctgtcaggagttctcacacttgcaggagcatcagtaaccaagaaggctggggaaacagagtgctggagcccacacctggactttccgattcagtaggtctggggtaggagccaaaaatgttcatttctaacaaggtcccaggtggtactgatgcaactggtcctcactttgagaaccactgtttgttttctagttagtgtactctgttctctgagtgtattggagctgttggctgtaaagcctgagtttgcattctttacaccaagcagatctttcactggagacaaaagaagacacaaaggtagcagaagagtgttgctttctatgttggggttgggggaggaaagttaagaatatccttatgagatgttaggcacgttctttgatattttctttgttctatttttcattttcatctgcacacagcatatttttaaaatagaaatagtatgaaaacgcttacgatgaaacgtggcagtcccacccctgccacctcattgccatgtcaccaagactagatttgtaaatcatgtgctcatatagtgatgttttgatataccagttttacaatttgttgactttctatttttgagataaagatttagttcttacgctttctacattcaataattctcttctccccatcctcacagtacgtttatgccacag

SEQ ID NO: 111036 - DNA, 1118 bp, Homo sapiens
tgtttgtttgttttctttttttttggagacagggtcttgctgtgtgacttagtcacttaggctggagtgaatggcatgatcacagctccctgtagctttgacctcccaggttcaagtgatcctcccacctcaccctcctgagtagctaggaccaagggtatgccatcatgcccagctcttttttttttttttttttttttttttggagggacgagtctctccctaggtttcccaggcaggtctcaagtgatcctcctgccttagcctcccaaagtactgggattacaggcgtaagctactgcgcctgccttaattcatgtagtaatagttgctttgttcttccatttgcctggatttctatgtcctgtcagcagtttttcccaaatccttcaaatgcctctcagtagggttttcctggtccatgtccaatggccgccctcctggttgggtgcacagctgtcatcctgggaatgcccttctccaggattgagtcccttgctcctagacctcatggcttcctctttctatatttattttcctagatcacatcctctaatagctttctgagaacaagtaattgggtggtaagtttttggtggcatttaagtccgaaaatgtcttattctgtcctcacacttcactgactcacagttttgaaagcattgctccattattgttgggcttccagcattgctattgagcctccaatccttcctttttcagcagatagttaaggcctactgtatgctgtatgtaaggttattgatgccatacttattcagtcctttccatgcaacttgttttgtttgtttttttcctctgggaagattttaggaacttttctctaaacttcaggttctaaaatttcacagtgatatgctatagtatgggtccctttttattcatgtttctggatacttggtctgtagaatcatttattttagttctgagaagttttcttgattatgtatcaggaaagggagctaattggttattttttaaaataatcacctcccctgcattttcagttctttgtttcttgaagagctcttagatgctggctttccaagactgatgttctacttttcttgtttctttctttcttcttctgtttttct

SEQ ID NO: 111037 - DNA, 1018 bp, Homo sapiens
atgcctgacaagagaaagagatttataaccaaattctgtaattgggacttccagtctttccccaagtagagaattggacttactctatatgctaaaaacccatggttgaaatatgaattagttcttaagtgatttttggcttgcataccatttttgcaaacacaaattgtcattactctgctcatttaataaaagaataatttgtagtataggtatatacctcaatcagtgattttgttgttggaaacagaacagtaaatcacactggccatgatgctaacagcgtgatagattttctgttcttgggacaccaatgtcactgtatctcatagcgaaggattatctgctgtaggagcattctcttgactacttataacatttgctgggtgaaataattctccaggttaaggcctcttctaaacagatgaggtcagcactaactgcatttgccagagaagacatatgcatttactgccagcatcataaacacaaaactacagtttgcgaggaaaccctttgaccagcatctaattaattcactgagtaatgtcttgggagaagaggcatgtaaaggaacaattttataagcatgccatgagattgttttctattgtatgttccatagaatatgaggaaacttcaaaacattttgtggaaaaattgaattaaaaagtaaaaaacacatatatacataagctttatttctcaagataaactttatcaagttcaagacacttttgtaagcaatgttaacagccattgagtcggtctctaaagaactgagggtcctgggaatttaaccatgtttatacagtcttttatacattattaactggagaaaaattggcgctctttaaagattttttaaaattgagaagcaaaaggacgtcagaaggagccaaattaggcctgtaaggtggatgcctaatgatttcccatggaaactcttgcaaaattgctcctgtttgatgagaggaatgagcaggaacattgtcatggtggacaaggactctggtga

SEQ ID NO: 111038 - DNA, 1086 bp, Homo sapiens
gagcattaggaaaaacagctaatacatgctaggcttgatatctaggcgatgggttggtaggtgcagcaaaccaccatggcacacatttacctatgtaacaaacctgcacatcctgcacatgtaccctgaaacttagaaataaaaatttttcaaaagggaaaaataaaatgtccatctcttgaatcctggttttttacttatcccacatggccctgtcgtttgcacagattatgtgatggttttgagttgatgggggctgcagaaaaattgtgctaatttacagtgaaaatcaaatcaagacatttgattgatgatgtgtgatcaaaattgtgcacggctagatgtgctgattgatgacgtggttttggatatgccgtgtattgtctcagctgcaggtaattggaatccatatgcattagctccattcctctcccactgtggcatgcagacattttgcattcggagccagtaatttggtgccttttccgacaagtttggaatgaaagcatgaatgctaaattttggaataccacagtgtgatatgaaaagcatattactaattaatggaatagaaccaggtaggaatttcttggacagataagagagaaatggtgtttttaatctggaggtgatcctgagtaattcttctgagctcagtttttaactgacaaatcttaatatcagactttattaaaaacgttttcaaagtggcatgtgcaattaaagcttcatcaaggagaggcactgcatgtcattactggtaatagaatcctgctcctgtagtttttaattcccacttttctgaaatgaaacacaaccagttatgtagtataatatgtaaaatctactagggaattcaataattttgcaattaagcttgaggtattttaaaatcattttgtctattaaatatgtcactataactgtttaatcatgacttgaataagagacaggagaaagcatatctgggaaaatgcaaatggttgatgagtagaagaattgactaaggttgatgtgtagaatagtggtaaattctacagaaccttagagctccttcaagggagggataaacatgagccacgcctg

SEQ ID NO: 111039 - DNA, 1043 bp, Homo sapiens
cctgaaatcttagagcatgaagccctgtgtttgtagcagttaggacctgcttggagggatgctgacaggtggtctacgcagacactgctccactgtgcctaggtgaggcctttggtgaattattttactttcctgaacctcagtttcctcatctgcaaaacagaataagtaataccttgcagcagggttttaacataattaggggctgtgaagtaaagtggttaagttggcagagtgcctgggcctgattctggttttctcctttcccacctgagtgcttcagtttccccatccaaaaataggtactcatactctcgacctcatgcgctgtaaatgctttgaaccatgcctggtgcatggtggatgctgcctgaaggtttgctggttttagcagtgtctggcagataggaagcactcaatacacattatgttttattactattacaattattcttaccatctagggttgggagatagataatatatgaaaacatctggcatgcagtaagtactcagcggatattgttttcatccttcctgacccttgatcttggagcaggggtaccttgaagtggagggaggtgatccctgcactgagttggcattcttttttatacttgtgttgtccctgagaacaagaactctagatatttggaaaagttccaggagcatcggggctcttgtgatattatgacctagagatcggtgagcagatatgtttagttctaccttgaccctgagcgaaggctgccaggtgcaaacctgtcatggacatttatttatttatttatttattttatttatttatctgagatggagtctcactctgtcaccaaggctggagtacagtggcacaatttcggctcactacaacctccacctcccagattcaagcgattctcctgcctcagcctcccgagtagctggtattacaggtgccaccatgcccagctaatttttgtatttttagtagagatgggcttttaccatgttggccaggctggtcttgaactcctgacctcgagtgattcacctacttcacc

SEQ ID NO: 111040 - DNA, 1042 bp, Homo sapiens
gccaggtgtctgaatgtgttttaaaggatgcgaccctcgccaccttgaaaggctcgctggtcgttagggcatcttgctgtcaccccatgcactcagtcccttggccggcgccttcccagggcttgtttcctgtgtatggctggttgagtaataagctcacaactcgttagccatactgtgaggctttaccaattaataatttaattaggtggtggttatgtcttgagttatcatgcaatgcttttatagtcttatttaattacatttttatgaatacctgtttgtgagcaggtatggctttgcctgtgatttaagtgatacaaaattggagacacagaaactagataacactagtttttagatgggcaaaagtttttaggtagattttcttactaggtaaataacattccattagaatcacttcctgaaacatagctggtggtaaaatgagatgactttcaaaaacgttttgagtcattaaaaagtcatttcaaaaaccatcacagacttttaggacgattgttagccttctccgagtgtcagtacgttggaaaagtttatatagaggaaatgtaggctggtagcttaatttggattctgaatcttgttatttcaaaattattatttttgagacagagtcttactcttgtcacctaggctggagtgcagtggtgcgatctcagttcactgcaacccccacctaccaggttcaagcgattcttgtgtctcagcctccccagtagctgggattacagctgtgcgccaccactcccagctaatttttgtattttcagtagagatggggttttgtcatattggcccggcaggtctcgaactcctgggctgaagtaatgcccccaccttggcctcccaaagtgctggggttacagatgtgagccaccacacccgccctcaaaattattatttcgattacaggacaacagcggaaaaactattaaatgtttttggagcaaattcatgtatacctcttagcatacatttttaaaatgtggttattttatatttcatttcctgtaggtgg

SEQ ID NO: 111041 - DNA, 1044 bp, Homo sapiens
ttgtctgtgtttggtgcaaataaccgagtaactaattgctatttatatgttgagtacgagtacaacttgcccttccatcatctctttcttctaagcacagcttccatgcaaagttctgtcctgactctgggcttatttatttacctttgaggtttcctgcagactagaccagcccaccttgggtgccggtaggcggtaggagttgcccttctgtttaccagcacacagcacagcagccttcctatgtaaggtgtgaatctgactatagcaaatatttaggcaacaattttcttgtgttgcttgaagtcagtccagtgttggtttgtccttgatgtgtgtcctaggttaatgtgatgtattgttttaaaatttttttttcttctgtagactcatactacattttattagtggatgcttgagtttaataaggaggggagaactccttgtcatagtcaaaccattccttgaatttgaaaaatgtgctgcctcggctaagcaaagctggtataaccctgaccaggatttcagcagagttcctgtggagcactttttatctggtagtggtggcagctgtgttttgggctttgggaactctagttgcttagagtgtgccaggaacttgggcgtaggttggttttactgaaagagaatggaggagagcagagatagaaatcccacctaatccacaaatagaacacagcccagagcaatgcctgatgagaaaaaaagataaagtataatttgtttccttagacaaattctttaatctgattttaacctgtatgtgtgtcccctgttcttctgtttctatcaaaactctcctcatccttcattcctttcctgaagcacctctgattaatcattcattcattgacgaatgtactaagcagggcagagaataacgggaagggcaggttgtgccaggcagttagagtagcgtatgctaaggcctggaggccccttggtggagctgcactcacaggaggttggtgggcctggagcgagactgctggggggagtagcagaggcgaatgaggaccagga

SEQ ID NO: 111042 - DNA, 1022 bp, Homo sapiens
gaggtaataatttcccaaatgtagtaaatcccactttacaacctcacggttaattttgatcagggataagtagaactgactatacactgttaacttagatattgtccttctcaaaaacatcatttttattctgggtgccagagatttggcttgggtgtgggtgttaagaacagtccacagtgtcctggagtacctctccgctgatctgggggctctttaaacctctctaacaagtttttgtgctaatcctgactgagtagatggaggcagtggagcccagctggcctgtcactatggggcagagggtgactctaccctcaagccctgcatgaagaccccagggtgggcaccacagccctttacagtcacttagcacctgctgctgaacacgagcatgcagacctggtaaggcttgtgagtttcagagaattcctgcaagtccctggaaatgtgggcactggcagctcttctctctcttttttttttttaaatttagtgggcttagaggttttagcctaataaggaaattttacactggacgattttatcccaaataaaagcaaatcatagggacccagtgttgcctaaaaaaccagtccttactggggaggtctagttgtgtctagcctggctctgtgaccagatgccagccattccagcctcctgtggctgcatttcatcccgaaagtgaataaggtgagtgagtgattcaaaggtcccatccagggggtgacaaagaatattccaggtggaagaaactgcatgagcaaaggtatggaggtggaaacccaaatgaacagaggcttaggaggtgtgttcgaaacatgtttggtacaaacggaacttacagagaaagaagccaggtgaaataaggcaggaagagttgagtggagccccattggtgggagaccctgagggttagcaggactgtgtttgttctggtagggattgcagaggagccctagaaggtttgtgagcaggaggctgaccccatcagacctgtgtttccagaagatcaggct

SEQ ID NO: 111043 - DNA, 1011 bp, Homo sapiens
aacagccagggtagggcactttgaaaactgcgggagtgagggccccacctccaaacaagctgcttcatttaggtgggtggacctggacatcagggcttgaaaatactggccattcccatgtgcaggcacatttgagttgagaatcagtgctttcagtgaaggggctggactttgaggacttatattctcatccagattgaatattcagtgattccatgaagtctatctatatttatgctggccacccaacattttaagttttaaaaactattttagaaaacctacgaaataatttcgtatccttacagtgcaatcttcctttttctttctcacctcctcccaccctcttttagctcctacagccattcgattacttcttttgtggtttcatagttttaaatgtttgtagaaaggtgttggtcagtcagaaggttgtagtgaatcttttaaacaattattttggagtacaaactatgttttgtgtttgcatagaccatctctgtggggtttaaaagctactaacagcttatccaatttgccatttcacaaccagggaagctgaataatgctacttcttttttacatgggatgaaagatcaagacccaaaggacagaaagataaggcagaggggatgaaaaaggggcccctgtgtcaggggctaacagtcattagcacttcacctatgcccagatgcctcctcagccagctaacagggacacctgatcactccttggcaagatgtaacacattaatctgacctgttgtctaattgtaagcatgaagcaggcattgaggcattagatcaccacagcatgaagcaaaagagccaagacagaccactgcacaggagcggccttctgtgccttcgcccatgtttgtgttctggcacctgtcaccttatattggaaatcacatatgcgtgagcctcctaaagtcagagggaatcatgtcttactcattgtaggaggcatattcaaatcttcatgattgaatctagtcctgtcaggctg

SEQ ID NO: 111044 - DNA, 1238 bp, Homo sapiens
agtttttacccccttcctttataccttacgaccaacaaatacaaataactgcttgtcaataaaaacaagccacaaatctgttccttctggacaatgattacgtagcattttttttgtgtgaagtgctcatttgaactccttacaatgagaaagcatttcatctaagggaaaaaacacaatgtgtccggccatatttttgaagtcttagaatgtgttaccatcatataacgggaaaaatgctagaattttaaatacacagtgcttcagacttatttaatatttgtttcttacttgttgacagaaaaacaaagcagcaaatgtaaagtaaaatgactttttattctaaatattgtttcaggagctctttcctaaatccttgtgaataaaattacacttgcagtgtatttataatcctttataatccctaaatccttaaaaagcaagttgacccaaatgtttaaataaggactttatttacagaactgaatatttctaattctcttgggatgtcattatctggctacatatgaaacagtattcacttatgcatgcttcagaaacttcatacattactgtgcatttgttagtatgtgaacaaagaaacttgttttggttgtgagcaaaatgcagacttactttcaaaattgagttttagtataaactcaaataggttggcagaagaggagtttaatttttatgtatctaaataaggcctgtttcttcattaaaagaaaattaaaactaagccccacacccttattgaatctgtcccaataagatgctttttgggttcttgtttgtgctatagttggttttgatttacttcgtctgcaaacagaaatgacgtagatactattgctccaacaaaactaaaaaaagattttcactaaaagtacccagatcatatcagtgggaataaatccactggcctcagtgtatttgcccaaaaaggatctgtgttttgcagtaaatattgtaattggaagtatatgttcttttagactaaataaagttttacttgaggacatttttcagttaggcatgtttattttgggggtttagtattgtcttccgccttatttatttttacttatctgtatgagccaaagctccagccagctctctcagcccttatcctgttgtaagttgctgactccttttcttgaagatggagtgtcccctttctgggcgtctctaacctcatccttgcctccccccaggtccccatcttctctgcc

SEQ ID NO: 111045 - DNA, 1044 bp, Homo sapiens
ttgcaatttgttgttgaaactatatttggcaatatgccctttgccttcaaatgttctgaaattgttagacctcaattatctcctttatatctgtattacacataacttcttggtgcttctgaatgacggggcacaccttaccctgagcatgagaaccttgagctcaattatgcctgaatactaaaacttagcagagcaaggagagagagactttggtctttgactaaagtgtgtctttttaagattctgagtaaaggataggagagattggtccttggaaaaaaaactaccacaacctcgattgtgaccaagttatgaggtattcttcagtttcttctgaccctgggaatccaggggacagttaagtgatctactttgtgtcatctttttgtttgtaccatttactactgagtcaccaacaaattcatgtgacttcacacattttctctctcctttgatacataatgaaagacatcactgctcacttcagatgcagcagaagacacagcatgtagaaatgtcaggtattttcataagcctcagaggactgaataagctttgaattttctgttcagagtggggttagtaattgggaagactcacgtgacttgataaaataatcttacacacttgcttagaagagtggcaaggttcttgtataaattgattatttttgtttgacaaatgttctttacagaaatcacttttaccaggaaaatcttataaactcctttttggagagtaactatggctttttgttgttgttgttgttttttgttttgagacaaggtctcagtcacccaggctggagtgcagtggtactgtcttggcttactgcagcctccatctcctgggctccagcaatactcctgcctcaggagtagtggggactgcaggcgcacaccaccttggctggctcatttttgtattttgtatagagacgaggtctcgccattttgcccaggatggtcttgagctcctgagctcaagcaatccgcctgccttggcctcccaaagtgctgggattacaggtgtgcactaaca

SEQ ID NO: 111046 - DNA, 1029 bp, Homo sapiens
tgcattcattccgtgagtgccagccacactgcatgttccaaataacacgcctctctctctcctcaggtgcctgagatcatcagctccatccgtcaggcggggaagatcgcccggcaggaggagctgcactgcccgtccgagttcgacgacacgttttccaagaagttcgaggtgctcttctgcggccgcgtgacggtggcgcacaagaaggctccgccggccctgatcgacgagtgcatcgagaagttcaatcacgtcagcggcagccgggggtccgagagcccccgccccaacccgccccatgccgcgcccacagggagccaggagcctgtgcgcaggcccatgcgcaagtccttctcccagcccggcctgcgctcgctggcctttaggaaggagctgcaggatgggggcctccgaagcagcggcttcttcagctccttcgaggagagcgacattgagaaccacctcattagcggacacaatattgtgcagcccacagatatcgaggaaaatcgaactatgctcttcacggtaaaatatcacccagctcgtgcacagccccagtctgccatacgctttcaagagaaaatctgctttatggagcgaagattcttagtcaattgcttttgatttatgtgtgaatccatatattttcatgctgaacaattctattcttaggataagctccttcctttagccataagcctttacagtcatcagggagaaacatgcccatgtgtaatttttatctcacccggtaattataaagacaccttttcagtgtggaaagaacagtgaaaacgtgtaaatgagaccagcagagagatttaaaaaatatatatgaatttcagatgatatatttcaacagaatcttttagttggaaaacaccctctctactattaatatttttatttatgaaacatttaccctttgctaatcaggaagagtggctttgtgagtgacattatatttgaaatttatacccaaactgaaatattaatttagccaatggcttgcttgcttttttt

SEQ ID NO: 111047 - DNA, 1050 bp, Homo sapiens
ggaaggtgaaggaggagcaaaggcacatcttacatggcagcaggcagggcagcgtgtgcaggggaactgccctttataaaaccatcagatctcgtgagatttattcactatcatagaacagcacaggaaagacccactcccatgattcaattacctcccactgggtccctcccatgacatatgggaattatgggagctacaattcaagatgagatttgggtggggacacagccaaaccatatcatttaccttacctgctttaagagctttgagcatacttgtagtattttcagactgtaatcctagctgttattccaattattatctgtcaacctgtgaagagtagtacagaaaactcttaaagcttaaaaaatcttttccaaagattttctgacatctcagcccagctaatttcaaattgactttttggtgactacaacttctcttctctttgattaggttgatgaaattatgatgaccctgaaacaggccttcacggtggccgcagtgcagcagacagctaaggcgccagcccagctgtgtgagggctgccccctgcaaagcctgcacaagctctgtgagaggatagagggtgagtaggggaccctttccagcatgaacacagtgggagttaaaggtcccaggagaactttagatgatactcatctgttggaagattctgcctaacagaggcttgtattagtcacagggattgtaggtggactctcagtgtgcagtgggtgtcttctgtatgtcaggaattgtgccggatgctggtgatacaaagataagaacccagaacccccttctgccacctccctccaaggtattctgaggatggaggaggagttagggaaacaggttaccaaaccggttgcctagtgtttatcaaggttgtgtgagtggtcagtcatactgggcactgcagagatatctagaaagataagaactaaggaacttgtaccagtttctccattacaaggtcattagtaacgtctgctagtacagtttggatggagaggaggtagcagaaaacaggttgcagttgag

SEQ ID NO: 111048 - DNA, 1902 bp, Homo sapiens
tgctgggttatgtggtaagaatgtgtttagttttacaagaaactgctggcctgttttccaaagtggctgtactgttttgcatccccgccaaccataaatgggagttcttgttgttttgtggacatttgggctcagtgtacccataaccctttgatctagcagtgttaagttgggattgtggcattactgccactttcctttttgagaatctaatgcccactttctccagagaaatccactttttgcatataacttgtaaaattttgtaatattggggttcacagcctggagtccaggttgagagtgtctgctgtagcctccaaaatatttaatatttcagtccgaaatttgaaagaacaggaaggcctcaatgaaaacaaacccttctaatcattaactatcctttccttaagtaacaagaacaacttacctttaatctttttcgttaagaaaggactgggtttctttaagaaaggactgtcagaaagtctgggttagtgttacctttgctttgaatgcttattatgtgcagggtaaagttgcttccttagttagctggggaagaagtgaccaagagtggtgttgacccagattcagatccttgtgtagttgatccatttatgtcactgaatttgttttaaagaacagtctggaaatttggagtagggagaggggaggaacaggcaatggatacttgtcaacataaaaaaagatgtattttcaaaatttatagactaaaaactttgtgtatcccaaaacaattcattttactttcttcatatatgataaaatcatacattaaattaggtggactttaaaaaaattcactctggcatttcaaatccaaagcatttgggagcaggaggagaccatagagtttcctctgtgcaccatcctcacttcagcagacagggaagctagaattaaggggcttggcttcacacttctcggcagcagccggaacctacatgtcctgacttctggtccagtgtgctgtgccacgaccctgtctaaaagttaaaaggcatagagagaattttttttttaaagaaagaagaaagaaatgtacatgccatgaagttttgtatggaagggggtgccccatggggattccacagagtgcttcacggtgaacacattcgacataggaaattatgacactgaatcccgttgctgttttccttgcccgttccctaagagtttgtcaatgtttggtcatcatggcccctgacctttgggtatttatatggattttgtgtttttcctcttgttttaaaaactatttatttgttaaacattttgactgtgtctctatctgatattaaagattcatttttagatgggaggacatcagagatgaaaagctaaatctggcccactggctccactgttcctttttaaaaattctctctacttttaggatcattggtgccccctggtgagatgattgagtaaaagcactagtttagtggatggaagctgttagcatttaaaaagacggcttagcaatattgttgacgattaaaaataaatcctgtttctgatttttgttttaaagaaattgagaccgagaaatgagcagcgagagaatgaattgattatttcttttctgagatgtttatatgaagagaaacagaaagaacacatccatattggggagatgaagcaggtatggcatttttgtctcttgtaattgttgccaagtctctgccaagtctctgtataaacaacgttttgaggattttctgaaactctgatacctttttttctccctatgttttattttcctttgttgcacatagaggggaaatttgggagtgttagactatgtatgcttgagaagataagaaaagtttctgcctgcaccatagtggaggcagaacagttgctctaataagagga

SEQ ID NO: 111049 - DNA, 1079 bp, Homo sapiens
ggagcagtttgagaaacacttccttagatggatgagtgcttctcaaatttcaggtgctccgcctcccgggttcaggccattctcttgcctcagcctcctgagtagctgagactggttaaagtgcagattctggttcagtaggcagggtggggggagccctgaaatgctgcatttctgacaagctccaaggcaatgctgctgctcctggtctgcagaccgcctctggggagtgaggtcctagacagcagtcttgtaaatgtgagtttctgagttaaaatccaggggaacatagtgtcgtccagcctccatctaatacacactgatcccaccctgcaattcattgcaagtgtgggaaggctatttgcttatttgttgtgtacagatgaaccacacaccgcccctttcatgtaggaagttacctaggaggagagagatgacagatacagaaacagccccagcatcaagcagagtgtggtaggagcccagaagttacaaataagagacattggtaacttcagtgtcagaagagcaaggggaagggaagttaggtttggtcagtggaaccagggaaaaggtgaggggtgagggggcagtgatgcttttggactaaatcttggtgtaggaattgtgcctatggaagtgaacagagaagaaggcattctagacagaccagtgtcaatagacataccatgaagacattcatgtcactcagtgggctttccagtaagccttattgcttgctttttatttttctccaaaaggcagatctaggaatatatacatattcattcttcaggactcgatagttgtgaagattcttttaaaaggatttaaaagtctgtctaagattgcaatttctagagtcattctaagagagatgcaacttttcagaagctgcttgtatgtattgtatatgtttaagtgtactttacatctttcttttattcatcttgaattgagaaactactatattctattttatgtaattggatcccttctaaaaaattgatcacctaggagttgcaaagaaaccaaatagccctgaaacttgacaaatgaaaatggccctttcagttgtc

SEQ ID NO: 111050 - DNA, 3328 bp, Homo sapiens
cctaattcttatacaattaaatgtatgtaacttctccctttggtaaacacatttctttttttttttttttcaaattaaaaccctcaatacttgttacctaaaaggcactcaactgtgtaaatgaacaggtagaattcagtctccagtccactgttagatgcattcattcttgtttactctattcctgttgatttattttttctcttccaacaatttcaataggagcaagctgctacaattcctctttttgaatattttgaatatattaaaaatatattggccactagccacgtcctgggtgcagtgttaaacatcagtttgcttgagtggtagtagttcattcctttgaaaaagcgtgcatcgtgaaggcatacaactttaaaatattgtcatgattctcaacaaatgtttgagcactcactccatagatttattgcatacctaataaaacaataacttatgtttgtgtaacattttacaacataaaaagtacttttggttgtatcatcttgctttgttcttgaaactcagatacatttttactttaccctcttacagaagaaattgaggtgcagaaagaaattatttgccctgaattgcagcagtaagtgcctacagagtgattttccatattctaagaatattgatacagttcttaatctcaaattatgaagtcgaatctcaacagtagatcagattcggagagagccttaaaatgtgggtttaacatgagtgaacacatgtggcaaagataaagaacttggttaagcagtggagacaagttctccagcactcacaccccttagaagctgcagtaaacagtcctgttttctagagagagggcactattcatggcgttgttcagaacgttacagattgtggcttatgtccttcactcctgcacttggccagtctccccatttctccagcaagccagcagtgtgtccttgaggagcgggcatttatttaatggaccttcattttcttctgcttttggtggtggcttctagatggcattataatcagaacacatacttagatactgcaatgtttgcccgtgcaggaactagagatttataaatcccacatattccccatggtgtgtctgatctgctgtgtgtttgctcccaggagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaagtaagatttgtttaaatttgttgcataaatagctggggcatatctgtgactagccaggtatgtgcatcccaggtatgtttattgagtgagagaaatgagtcaggctttactcttggtttggagataaaactggaagcagtgacatgttcgttcgagctgcttgtgagtatacaagcaatgggtacttgtattgtcaggaagcaagtgaaagtgagcaaaaatggtacctaacatgcatagtcattactcctcaaacaaagtaagagacgttgttgactgtggaactttgctgctgtgaggaagagggcaagcggatgagtctccccatctgaagccctggagcagggttataatgggagggagaggcgctgatccttacaggcagagcaagagaggtatgctggcctcatagggtgacaggggtgcttcagcttctggtcctagctctgccgtgaactaattgtgacctggacgaatttgctaaattctctgaataacaaaattggagtagatgttttctaaaatctctcactgtaagaattctagattcttctaacaagatttattcattgtaatagttgggttcctgtgaccagttagaatcgtctggttatggagaagagtaatcagaagttccccccattccttccaagtgtcccttagtgattcatttaactctgtgtgccagagactataaatggacacagttatctttaaaaacaactttaaacaattttaaaaatctctcacctaatatgaatcaaggtcacacctgtgtacagtcgctgccttcttctgaccagcagccgcagaagtcccaggacctatgtgttcgtgtagttcatacacggatcattgagagtgtgagttagtacagaagtgtttggaatgttctgagtaaagaagtgtgagcattaacagtcctggatgatggagcagagcctcccagctttgttttctgtcagccattggaaagagttcttggttctttggaattcagcggggtagtggtgatcccaaaagcaggggacatgtcagaaggtactgcttaataaatacacgcttttagagacacacatcgttgggttgtagctgtgtaagtttcttgtgtttaacaccctgtctgcacattacttctgtgctgcctcaccactgcctgcccactcctctgttgttggcgttttcagtgatcattgaaacattcctgtctggagagtcctagttctcttgtgaagtctgctgtttctcaaaagccagagttgataggacttagtatcagtacttttcctttctccatgaagaatgtagctttataatagatgatgtcacacatccgtaatgggagggatgaggagatgcctgtctgtctgcctctctagcatggcccattctgctttctttcccccttgtgagctcttttccgatttatctacaggaaataagacattgaaattcagggcaggatattgttcattttaaagggaaatgtattttttaaagttcagtttttttttgcttttgtttatactttaattaaaaattttttttcctgccagttcctgaaaaagaaaatagagaaagaaatattattgttcctgggcgaagtggctcactcctgtaatcccagagctttgggagactgaggtgggaggttgcttgaggccaagagttcaaggtcacagtcagctgtgatcgtgctaccgcactccagcctgggtgatagagtgagacctattaaaaaaaaaaagtattgttgggagcataaacacgtgggaaatggtcaagaacggccgtcaatatactctgtttttcactgaaaactacctttgccagagagcgagcagagatgaggaaaaggagtggaagaagtcctccactctgatagtgttactggaacaacgagacaaaagcggtgt

SEQ ID NO: 111051 - DNA, 1086 bp, Homo sapiens
tgggattacaggtgtgagccacgctcccggccaagattttaaacattatttaccaaagtaggaacgtggtaattatggtcttatataattctgaaaatgatttctagtaccaaactatgaattttatacttgaaagaatgatgggtttttcacagaaagttgaagttattatggtttgtttcctgttcaggtgtttttgctggagaatgttcgatgaacagcagttctggtgataagttatggatgtacacagctggtgtggtttttaggattttattttgcagcagcatcttcctcaaacagttgccaggggacggctttccttcttcttactggtaccagcctttctcttgcagacaaggcagtatgggagggttgggagacaaaacagaagctgttggtttcttcagcctggcaaggattcagattgcaggttgtagattggaggccgtcagtggggatacctttccggacaaagtggtgtttctgcctggcactgcttgccagagaagtttcagttcttcattctccgtcagagaaacccatatggaccacattctgatagttttcttctgtttccctaacaccgaaggctcagcccctggtgcaggtcccagtgtacagcaggctgcatacagttagaccagatgttcttgtagtacgaaaagtcaccgagtttccattcacttgtgggtggcaggtatggccctccttacctcccatggcccaggtttctctgtcctgccgttttcacattttccaggctttcacctccaggtaccaaaattcacatcatttagagattgtgtctgcctgccaatacgcggatgtaccagtgagggattgttctcgcctgacgagaggtctggatgatgagagagcagagctggccctggggctcagtggtgacaccctcgagcttggctgcttctgttcttctgcttcctctgcttggattccttcgcctttggcttcccctccagttccaagcagaacaaaacaggagatatcaaggaggaaagggtgacccctctatatctggagagcaaaactgtcgcggaaatccctagtgtacttccatttgtg

SEQ ID NO: 111052 - DNA, 1052 bp, Homo sapiens
aaaaacagttttcaaggagcatttgaacttgtccactttaagtcataaaatggattaaagtgtttgaaatctattgggattgtaaatttatgtcagtgtactgactttcaagagatcttgatgatcatgtcgtctgttttcattttctactacatgagaacattgaagcctgaaacttaacacaaacccgagttccccacttgcctaagagtcatggatacctaaaaagtatgctacttcccaagttgatttctttcaggatatgggcccttcaaaggaaagcagtgaggctggggttttccaggtggaaaggtcacatttccacatataactcagcgaacattgtgttgggttgggagaagaattggttcactattttaaactttttgtttcatcttgaggacttccccatcccctctcctccgcaaagcacaaaagtatttcctaatttttaagtcatgggcttcctttaatggattctgaactcagatcacgtccagataagcattgtgtaatgggatgggtggggttagatattttagtcacagatgcatgagaggagggagggtggaggacagcaaagtttataactggagcctatagtagtttatctcttgtcatcggccaggtcacagagtctcacttcaggacagctgtgcaagcagaacccccatcacggttttcttgatgcctttgacagtcacctgtacatgcctctgggacctttcctcctcctttctctttttgttttttttcccttggtcacatgtttcattctactaaatgtctaaccagctcttctctgtaaattacagagctgtgatggcaccttgcttgttgattatttctggttgaatagtttccaatgggacttctctggagataagtcctgtattagtccgttctcacactgctaataaaaacatacctgagactgggtaatttataaaggaaagaggttgactcacagttcagcatggctggggagacctcaggaaacttacaatcgtggtggaaggggaagcaaacatgtccttcacatggcagcagga

SEQ ID NO: 111053 - DNA, 1045 bp, Homo sapiens
tctgcaggcactccctgtcccttcgctgggccccgtggggaactacttgcagtcatcaaattcatcatgctgctttcttttaattcccacacttgccaaggtgggactgccccgcatctccttcccagtcgtgtgtcagaactcagcactggacctttcccctttccccactcccacccctcctcaccccgacgaacgtctcacttgggatcatctcttctgaggttggacctgcacagccgccctctgcactctcgccaccttatgggctgcccttgaccccttggcacacagacctggaagttggcctgctcagctgtctccttaggggtggagcttggttttctttcatcactgttctgcgatgaattgaatgcatgattggtcacaggaaggtaggggagggataaacaccttatgatatgtttcttataaggttttatatgtagaaagttatatgaaagtgtcagatatctatatatgaagtatatgtgaagttttatgatagttttgcataatttaagaataaactctttaaaggagctgagtcccaatcccttgggtcgagagttgcgtggctcccggggcctgcttgtttccttccactctgcgtgttcgttgctggcccctcataggctgtcccagacctctttgacttctctcctttctgcccagtcttccctgagacgctccaggctccctggcctcctgcttctcggagcttctcttgtgtttgttttctgtgctcagggcgccatggtgctataggccacagaggaggcgtctggggtccctcggggcaggtgcagcaggaggaagccgtctccgagggcatgaccttggaactgagcattgacagaggagagtcagccagacaaagaaaggccaaaaccccacccctctcccaccctatttctacgtgaccatgggccctggacacagcaagacggtgaccccgggcctcctattgttgcgaggagcccctgggaaaatgttggcattttcttcatagaacaggtttctcttctccagtattcttcagtaa

SEQ ID NO: 111054 - DNA, 1758 bp, Homo sapiens
actgcatagttatcatacccatgtcttagagttttgtgagtgtaaattattgtatataaagctctgagaacagtttggtacacagtaggcactgtatgaacattttctgtaattatcaataatataattattaaataacattttcagaaggagataaaaatattacaccttaaaaagcaggtatctttaaattcttcctcagctactgaagttttgcttactatttgacatatcatttgtttcacgtttgtggctcagacgtggcttatgccaatgcatattaacacaggaattttaaatttggtgatattattatattttatctgaatgaacagaatttgctgatttgacactgtgtttgaatgtgcattttttgttgaaaaatgacaattctggaatgccgtctccctttccagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaaggttggtttgccatcttgatattgaacaggcctggtcttatcttggctctgaagttaatcacatcagacataagcatgctgtcttaaaaatacagcagcacgatagtctaatgtatacatctatctatatctgtttactttttcagagtaatattaacactgtttactttctggtgatctaatgatagtttcaccaacaatattcattattcctctatggtcactgttagtacagtgtttagaacttctgagatccaagctttaaatctaagctctaacacgctgaaaggtgcttttcattttgttttgttttcccctctgtctctctctctctctactttatcctcagccatggtctgtgcctgtgtgttaggtatgaacttttcttgtgtaagtcattaacatacgtaacttcactctgtgtgctttttcagtgatttgcaagtaatctgaaaaaaaagaattagctgagttctacctgtactgatatcaatagtgtcaaaatatgacatgaactttgaaagtttagattttgttcatttcctgtttccatgctgacactggaaccaattaatgttatcttcaaagtagcttaagatgcaaagtttacatactctttggaaagagcatgagtcttagggtatctagagaactgcccggtgataaagtagtgaagattttgagcaggaagtctgcataatctctttcaaagggaagatgtagcagatggttcagtcaccctgccattgccccagaacaattttggaattacagtacatttcattcagcatcattcttgattgcaaattttgatcttttaaaatgaccttgatgcttgtatagagctaaaaagtcattaagacaccaactctgaggaataagctcctgagaatgtgttgcatctgtgagtttcagttgcatagctagtgtcatagcgagtggatagacgttctctgtgcatgtccctacaatgcttgtgagttatgacaacactgtgtacgagcaacatagtttctgcagttgaaaagtacgaattcatagaatgtaaagagatagtgtctatatcttttgactgaaaacagaaaatgagatataaaggaataagacctttcgacatgaaagtaaccccacagttggaataggctagtaagctttcc

SEQ ID NO: 111055 - DNA, 1018 bp, Homo sapiens
cactggaacggggaaactgggattggcctagacccggcagtggagtcccaggtgccctgcctgcccggctgactccgcccagggaggcctcccacagaagctcctccagactccacctgttacctcccccactcctctcacccaaggctgtgctgtggccaagtcagttgtttagtctacactttctgtttagtctacaccatggctacctcaaggcccagtgaaggtgtgtagtataaagcaaaatcaaatccatatttcagttttccttaaaaagtgaccttcatattctggccagaagaacagaatggttggttggatatattttgagttttcatgggtttttgttttcctgcctcttgttatactttctgaaattggcttttagtctaaacaggttttttttttttttttttttttttggcaatgtgttttcctccaaagagtaagaataataggcctcatggctgggtcgtgttctacagtttgtgaatattttctcaacctttgtcaaatttcatctttacacatcctgtgtgaaattgggcacgtgccgttatttccaacttagaggggatgaatgagcccttaagagcttgagttctctgcccacattgcgagttactcagtgccagaaggagttctggaacccaggtctcctcagtctccataccacatcccttctagggcaccatgttgcttctgtgtttcttggctctgcccactccatgccagcacaactctccccacccctgctttggtggaatcatgttcctttggggtagatcacaccagccagaggcaactgctctcagcttagcagatggtactcatcacattattcttgaagccttgggtcaggagcctgccccacccatctgcatccatttgtccagccctcagacaattgccactgttttcatgtctattctttgactctctatcctgggtagacaacatggactgcccagcatcctgtcttctgtctggggctcccactgtcgtcctgaccacgctg

SEQ ID NO: 111056 - DNA, 1052 bp, Homo sapiens
gaaatagccactctacaagcggtgtcaattagcatgggctctggtttctgtgtgaggtagtttgctaacatgagagggtatctgattagctaaaacgataacactgacagattaaattcagaataactaaaccttccctgtgttcctttatgccacatgactcctgcatattctgctaccagcacctgtttgataccagacggaggggtccatttgggatgggacaggagcatcagcagaaatgcagaagtggggaagtgctccatcttcttggaagctgagctggcaagggtaatggaatgaaagagattgtgaatatttttgagactatgaggaaaccagtacactggtgttgcccagtacagaagccacatgtggctgttaagcacttgagatgtggctactccaaattgaggcgtgctgtcagtataaagaacacactggatttcaaagacttggcatgaaaaaagaatgcctaatgtctcagtatttttatattgattatgttgaagtgatagtattttgtgtatgttgggtgtaacaaaatatctaattaaaattaacttcacctgttattttctaatgtgggtgctagaaactgttacatcctgcatgggggtcacattccagttcagttgcatgtgctgctacccattgttctacacacacacacacacacacacctgcacacaacctagaggggtcagagaccccaggagcccctgcttctggtgcccaggctaagcgctggagtggaagataaagctgggagggtgggtaaggaggtgagtgcacggagctccaggctaacagagtggataatttgttctttgagcactggggagctatggattgcttactagcagcaaggtgacttgtgcagggtatatctgggggagatttactgggggaagagatagaggaggcaagaagtgaatacagaacgagaaatcaggacagtggttaggagaccgtagctttcctcttgagtcaagttcagataacacatctggactgatgaaattctttttcaggaagctgaggaagagccc

SEQ ID NO: 111057 - DNA, 1032 bp, Homo sapiens
accacgcctgactaattttttctattcttagtagcgatggggtttcgccatgttgggcaggctggtctcgaactcctgacctcaggcgatccttccacctaggcctctgaaagtgctgggattacaggcatgagccaccacacctggccaacagttttcttttttcgattgaagttcagctatttgcaggaccgaaggtagttctgattactttcacctgtacttccaccaaaaaataaataaaacaaccatgagtaattgctgatttttaattgaaagcattattccaggaataactggtggacttcgtttgcagaggaagtggcaaagactgattgatattatgatccagcttctaaagattttgctgcttaatctgaagcacattggatttctggttcaataggctttctttttttgtttttattattacaactaatatgtattcttttcacagggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacaggtatagagtgttccttatgtctttaatacaacaaaatgctaagaatgtttcttatccctctccagatgtgcctcaggagctttttcaccgtcaggtaacattgtaatagctgtcactgctgataaaggactctgtgctaggcattattccaagcgcttcatctgcacttccctctaaggaagacactgttcatcgtctcaatttgtagattggaaaactgagtctccaagagattataaattgggcccagtcacacagctagcaagtgtcagagctggactggaaacccaggcctctctgactctagggccttccctcttgcccccatca

SEQ ID NO: 111058 - DNA, 1549 bp, Homo sapiens
gtcatcactgagtcatctctgccctggggccccaggcactggagctgctgcttgcagaaagttctggggctctggaagagaaatttttccttcggctcataaatgggtaaaaagacgttaacaaacaagcagactccactttggaaatgatagcccttctattgcagagtaatttgaagctctctgaagctcactctaatgacttcataaatcaaagctgcagcttgtaaaggtaagatatttttctgtagactttgtaggcagtggtgagactcggagtttcataaacattatgcatagagatgccagtgtctacatcattcctggatcccacagactcctgctgtgctaagtgggtcgttgtccagctggccaagggctcctgggattagaggcgggaagtgggatctcaaggccgcactggcttgtgatgtcactttgcaagaactgcttttttttccacagtccatcccatctttcagtacttaaaaacagaaaagataggtttttacaaaccatttctatttttagcactgatgacttagagaatggtgatggagatagcttagttttatatttcaaagcctgccattcagtcactatagtcttttttggcctagggcccatttcattataagcctttaagtctggataaactctaaaaacatgtagaactttgttgactaagtaaaatatttcagtttgcaccaccttagctcatatattagttaataggttacctggcattaagtatgtatctgctccttggaggggcggctgccagtgatgtgtgcgccttaaccttcacatgatactcacaccttgctgaatggcagttcttctacctggtgtcacataatgtcaatagccccttcctgtatttttctagcttgagtacagcagggccctgggagagacgcttgctctgttcactttctcatcacatctacctttgggggaagaaaaatctaaaaaacaggacctggcttgctcctgatggaggaggaggctgcagtgttcagcctctgatgtttttctataggacatgctgccaaatagatgagggaggaggaggagtataaaaactaagggtttggcaaaaaacacagaagccacctgcaatatagtgaaggcttcagagagactttaggatgaaaatagactgaaaacaagattgtttctgtggccaggaaaatctccagctattcaggtgacatgatgccgcgtgatgatgagtgtgtccagtctgtctgtgctgttgttctgcacagcactgtcatcagccttcagcgtcccctttacccgttactcatagaatgtagcggagccacgactggaggaccgcagccttccagaagaaagttgagaaggctcagccttgacaaagacaaaggtggctggaaaaagagatgcagtgcaagctcacataggaagattgcactttgagatcatgaagtttagtttcaaatagagttccaatacacagtaacgcaataagagggttgctgaaatgtcctcaaagaaaagcagttcctttgtgttgttccca

SEQ ID NO: 111059 - DNA, 1036 bp, Homo sapiens
agatcccttagctaagagagcgcctgctcaacctgccaggcgtgtgctgggaacttccaggagttgcctcgtttaattctcacagccatcctgggaggtaggcgctgtctgccccaggtgggaggccaggaactgtggctgagagaggttaagtaccgagctcaagtcattcatagagtcgccagtggagccgcaattttaaggctgactcaaagcctctgagccagttacctcggctgtcaaatggagataataatccctgctgacctcacggtcgctctgaaggacaaaagagaatcagttcaatccagtaaacaattctctctctccctcttactcccctcgcacacatgcacacacaccccacagatataatggattttagtttttaggcatcaaatgacttttgtgccttattaatattatccactgaatcaaaaacagcaagctgaaaaattcatctcaaggaagagaaaataagattgttgggaatggtgagaaaggaaacatggtttttgaaaattgattccagggaagataggctagtttgaatgccagtagggagccatcagaagaagtagttttacactgatttttaacaatattggagttgcttaaggcaatgcaatagagaggcagtttctgcccttttaaagcctgacttcactttctgaatgtgtgttctgatctagcagggttttttttttttttcttttaagatggtcccagcttgactgcattctcagatccatcagataaacgttagggcttcactgctgtgctgagaggccccagcccctggggttctctcatagaaacaactggaaagaaaggaaatgccttgggcagcagcagcagcagctgtcttctgattctgctttccgccctgccttccttaccaagagaaagtacagacacggacggcttgagtcacttaggcacttaggagttgtttttcacacgtgtggtgttttcgtcaccattactattgtgggaaagaagacaactcaggcatcgtttcgtattcactcatctg

SEQ ID NO: 111060 - DNA, 1048 bp, Homo sapiens
cagctcagctgaggctatgaacctcttccctcgtccatatgaaaagtccagacggggatagaatctgtgtcttcaattccctctgccctgacccctttgtagtcgctctgagcttaggctcctgtgctataatttctgatcggggcgccagtgctgacagtggattaaaaggtcagaagactggcccttttcatctcaaggaatcaaataaatgagaatccgcatgctggattttaattctaaccagtaaacatctgttgatcaaagacccatgtcagtcctatgctggagaccgagaataatgaaatgagtaagatttggccccttcctcccagcctgtctacatctggatgtgcagtcattctactgaagatagttctagatacaagaactaactcagcaatttcccggtactaatttaactgaaattcacaagtgttgttcaaatacaagtttgggactttgaggggatgtatttattggctccaaagaaagcccatggtaaatatctttccacacatccattttccaaggaaatcataatgattctgtgtccggaattggtgggttcttggtctcactaacttcaagaatgaagccgtggaccctcgcggtgagtgttaacagttcttaaaggtggtgcgtctggagtttgttccttctgatgttcgaacgtgttcagagtttcttccttctggtggattcatggtctcgctggcttcaggagtgaagctgcagaccttccccgtgagtgttacagctcttaaggcggcctggagttgttcgttcctcctggtgggttcgtggtttcacaggcctcaggagtgaagctgccaactttcgcagtgagtgctacatctcataaaagcagtggagacccaagagtgagcagcagcaagatttatgaaaagactgaaaaaacaaacctcccacactgctgaagtggaccccaacgcgttgctgctgcgcccagggcgcctgcttttattcccttatctggccccacccacatcctgctgattggtccattttacagagagccgattgg

SEQ ID NO: 111061 - DNA, 1048 bp, Homo sapiens
gactggccttatctgttgctaagaaacttataagaaacttacactcccagattaccttgtgctacgccatatcctgttttgaatttccaaaggagaataaataagaagaaatgatagtattaacaaaatagcttccatttgttaaacccttcctatgtgccagtctccatgcttggtttatatttagtatctcagtgtagacctcacagccattctaggaggcagtggtcactgtccccttttcactgacgagaaaactgacaatgagaagccagttctcccaaagttgcccagatggtaaacggcgaagtgagggtttgaccccaggcctgcctgtctgactgtaaaacttggcctcataaccactaaaggagcagataattatttagaggaaaaaaacaaatgtggggtcttcttcaagatagtgacaatggagattataaagcacaggagtgtaggaggagtggcacggtgtagcaatgtgtgctacgatgacaaggaagagggagttgaatgctacccagagacggctgcagcaggggaagccacttacccatgcgaacaggttctagaaagatgtgggaaaatgaaaaatgttggtggggggaggtggcgtgaagttggtaagattatggaggagggacttttcttccgaaattttcattaatattgttgatacatatttctaattagaacttgtcagagacactggaactgcttcctaaagggcatagaaaatgtcttatttcagcttaaggtttatccaaattgagtcggtaaatggtttgtcaactcactgtgctccgtgtggaggcagggagcttgtgtgaatgagttacggccacattcaccaaatctctcactttctttggtttcgcacagagtctctaaaaagccctgcaatgggaggattgagtgtattttctctctgctctcttggggaggctcccaagagaaaggaaatgatgccagggtgggcagctccaggagctgggatgcttgggggctcctttgtggaactgtctgaacttggggagttcagagagct

SEQ ID NO: 111062 - DNA, 1433 bp, Homo sapiens
ctcactgcaacctctgcctcccgggttcaggcgattctcccacctcagcctcctgagtagctgggattacagggacccaccaatatggttggctaaatttctgtatttttagtagagacaggttttcaccatgttggccaggctggttttaaactcctgacctcaggtgatctgcctgcttcagcctccctaagtgctgggatgaacaggtgtgagccaccgcacctggcctccactatactcttaagcctcgaagtcctctgctggattctcagcatttagctagtagatgagaaaagagagaaaagtcatggtggattgcatgagaggcacctggccaagcatggagttggtgaacatggcttctgactcacatccccttaccagaacttaggcacagggctaaagctaactgcagggaagtctgggaaatgtagtctagttgtgtgtccaggaggaagaggaaaatggattggtgggtgcctggcttgtctcttacacacaatggattgagtgtgttaaaagaaaaacctcagacaaatcaaatttaaagaatttagttgagcaaaaaatgattcatgaattgggcagcccccaaaccagaataggttcatagagattccagtgctaccttgtggttgaagatttatgagcagaaaaaggacagtgatgtacagaaaatggaggtgaggtacagaaacagccagattggttacaggtcggcatttgccttatttgaacacaatttgaagagttggccacatttgattggctgaaattcagtgtttggcataagagtaggttacaatctgtctacacatccagttaggttatagttcactatgtacagagacatctttaggccaaatttacaaagaggccactttaggttaaatttaacaagtgaaacattttcattatgtcaaattttaatgtttttgtttggcacctatgtgatagctcgttcctgtttataaaagactttgcttatgctatattctttctcactgattacatcttgggaattattaatatttcatatttctgtttattcagaatcctctcatttttgctcttattatttctggttattccattcttttttcaaaattctctgccttctattttgcagacttgcatttcagtcagaatgaattcaatctctcctccaacacctcagtggatatttttttctgtgtttcatagagttcttacagctatttttatgtaacgtaaaactcttaaactttgcaataagagatcaaacattaaaaaaaaatgaaattattggattcattaaataaaaccccagaaacacatacaactcatagaaacacttcaatgtactatgttaaggtcaaagcaggtaacttttgtttaaggagttacctgctttgaccaggagttgcagaagtcatagcttaatttttaca

SEQ ID NO: 111063 - DNA, 1034 bp, Homo sapiens
taagctaaaggatgaaaaccctaatatctacatggactcaatctatgatttgctaatcattgctacagtttagctgagtcgaggacagtggttttgatagatacctcaagggaagtagtgttgccagatggccaatgtcttcctttattctttaaaattctctaatttttttttctttaaaattctctaaatgttaatcgttcactaaaatcagtaagcctcttgaactgtgttcttgtttttgtgatagagtagggtgcctgatggggagaagatcttaactttttgcaacctgaaaagctgccctgtggaggattgagaagtactttctgcctttctgatgagcctgtgatctatttttggtacagactggttggggaggggctactttgtgggactacttggcaggcccagataccaacaataatggatgactagcgtttaggtggtgctcaccatgtgccaggcacccttctaagtgccttaccaatgtgcattcatagattcctcaaatggccctataatgcggtattcctatcttgttgatgagaagactgagacacaggaatatgaaatacactttcaaacctaagttgtctgatgccaaagtccatgttcccaacattgtgattcccttttaaatgatttatgccagggtagacagggatgtgccactcaaagggacaaacatcaaccaggacaggcctgtggaatatggaattccagggactcacagaaagaagtggtcaagggtaagacacagggaagagaatctggcacctccaatgtttaagcaacgtgatgattcagactatttgggaatcgttaaagaatggggaggttaagggtatctgaactgtgtatgtttttgtagtctacaatctgaactaagctacttatttttggatgcaattacagggggtgatggtgatcaatgtaggaaaagggtacaatttattatttagtttatttacttattcaatacatatttatggagtgtttactgttccatctgcaccagacagctacaaaaa

SEQ ID NO: 111064 - DNA, 1132 bp, Homo sapiens
cctaaacctactcctgtattttccattttccagaaggcttggtgcttaggaagccaattctgaggctttttaaggtcctgagttgcctttgaaatgatcaaagagacagttagactcaatatggttaagttataaatgcgttttctgagttttgattctttgcaaattagccatccatggagggcacgtgacataacgggagcaggtcttggcacaaaggcaggaactgcagcagggaggtgggtgggcagggagcgagggagatgagatgcggggctcctctgagcatggggagtgacctgaggctctgctcgggctgcagaggccaggctggggaaggaggcccggtggcctgaggcatagtggtcaaaggacagtgcatactcaggcaaagttaagaccagcatcggcaccaattggcattagtgagtgtaattcagccattgggaaccagccaggatactaatctgtggccccaagctcagcagccagtgcagccaggtgagctgtacagcccagtgggaggagaagctcaccctccttcagaggagataggcaccaaggcggggagagaccatcctagaaggaggaagagagattgggacatggctccggattattgagcaggctgtgatgtgggggatgaggacacaagaaaagaaccaacattcactgatcacctactctgtgccaaatgattttacatgcatcatctccagttctttcaacagtcctgtgagggggtattagtgtccccactttacaggtaaggtcacaatttgccagcggtcacagagtaatcagaggccatagcagaggcagaatctgagcacaaaccttcctgactctttgcccccaacacagggtgggcaggagttccccaaggggctccaggactcccaggatgcacacagtccaactctggttgactttgtgcctaaactcttcttttttttttttgagacagagttgacctgtcacccaggctggagtgcagtggcacgatcttggcttactgcaaccaccgcctcctggagtcaagcgattctcctgcctcagccttttgagtagctgggattacaggcacccgccaccacgcccagctaatttttgaatttttagtaaggtgagg

SEQ ID NO: 111065 - DNA, 1830 bp, Homo sapiens
gcagcgtggctgaaggcggaagacgccttaggcaactgcctgcagccgagcctgatggggacccagggacagatccctggatcaggacccatgggacctacctaacatttccaagtggctttcttagagatggcagatgagatctggaattgtcatattcatttttttgggcagatagctactgacaaggagaagcacttttctggtttaaattttatagcagtatacaataatactagaagaatgtgaatgagacttatttttaataagtcaagttaaacggaaattggaaattgctcaccttcttgtatttcactaaaataaacattttacacttaaccactgaatttcttactcagaatttatgtttccattaatatcacccaagacattttaaatatattgattatattctcacaagagtctggtatatgggaaaaagtatgaagtggtattctgacaagtacctgaaatgtgccagcaaaatcaagtggggaataggccagttgttcattataggtttttccacacagcagttttgtgctatccttttctgtacgaatttgaggagcatttttataagagaaattcatctggatgatctgcctcaccctagggaagaagacttgcttttaggggaaaaaacaatctgctagcattaatatctacaaattttttggagttagtaatagtgtttaaggaaagtgtccacgagtgatttcttctggtttgaaaagaggtatgttagttgaccttaggctgttaatagaaacctgaaattagatgttcgattaaattaaactccctagagaaactggtatcttcatttctgcagtcagtgggctttgctgcagaactatttattagaagaaaaaaacctaatgtactatcggtaagttcaatgatgatacattgtaaagaacatttagcttgcatgaaagggaatgcaagtacaaaaatctcaacatgggaataacaaagaaaagtaactgcttagaccacaaaaccttgtcaggtacaaaacgacaacagagttttgcagaaagctattgttttattcactgcaaagtttctaaattaaaacccaatcttcttgttgctatgggcacagtgatgctctttttttcctttttttttctttttttttttccttacctgtacttagtctgcacacaccacattcttaaatctctgataacgtaagcttgagttaaacagtcctggctaacaaagtaaagagaaataatgggaaaggaactgtgaatggattttactatcttaaaaataacccaaagggaaaatagacattttagaatgacttctagaaattagtactctggtgtacagattgcataataatttttagataaatgtcaggaacagaatcacattcttaaaaggcgaatttctataaacgtgtgtatatgttgaacagatgagcagctctgcaaagatgtgtataactgcatttgaaaaagacagtgaaaattttgggttactgtagatgtcccacagtctgtcttggaatttagttctgtgactaaaggaggcttacagttgctccaattttggttctgtggggtaccccaattgtaatctgaattcctaacagcagtgctctatcttttttcctcttgatgcactgaggctgaaccataatcattaccctaactcggaatttgatctgagctagggactagccattggaatggggcagaaagggacaaaagaaatcaggagggaggctagtgttcattaggaaggtctctgctgcttgaatatgataaaatcacatttcacttatgatgtttactgtatgtggcagctctt

SEQ ID NO: 111066 - DNA, 1779 bp, Homo sapiens
gttttacaataatatttttcattttttaaaaatattctatcagttgtgggttaatgaatttctaggataactatttaagacctgccttaatattagttttctgttggttcttgagaaactaagatttaaggaaatatttgcttgaaaaagaaaagttttggaaagtgcttttgtaaacttacttggggattttttttttttaatcaaaaggaatcatctacagcatctctgtggaattaatttaaagagttgctgaagcagcaaatcaggctctcttctccccaaaattgatgataatggtgcgttttaaatgtcacattccaccacattctttatgtataaatggaaaatataaaatatgatattaagagagttattagtatcaaatagttggctactgataaccttctatgaaaaaagctgggagttttagaagtcccaataacttctttctcctttgggaaaagcagctggaaatacttagctgacctgtaggacaagagacttttaagcttaaaattcataagtaactccaatcgaagcaggtttttttgtttgttttggttccaaagttgttaacaatctaactaggtttggtaaacagagtctttatttggctttccccaaattctttcttctctcttttgcagggagatgaagtggttaatagagataattagggtctaatatattctatcagaaaaaaattctgcaagcttctaaatgctaagctgaatagttggggaaaattatcctatcttatagttgctatgattaccagaaagatgggaacaagagttttaatttcttaaccatataaatcatgattcctaatttaatttcattgtgtctccatcgccccttgagatacttgccttcttaatattttcaaatcaacatttttgctataaaacgacagatttcttaggcagcatttcttgttctctgttttcacacccagttgagtttaagaaaaataaaatacacacaacctcattctttaaggtactaggaattacaattacattattctggaacttggattctttctgaagtgcatcatttatcattggttctagctttttaaaaaagcaaatccctagaatcttaaaacaattgatatctagtttgctagtatgtgatattctagtcagaattcctcttgggagtgagttggaagagggttatggtggtcgctagcattctcattttcaagaccactctgttcctttcttagaccatgtttctcatcttaagcagtcatgcccgagctggagacaggaaaccagacagcagtctgccctgataagggacagcattgtctgaaggcggggaatagccctgcttttacccccaactcagctctctttgcttgaaatttagtagtcatagaagaggcacaatgctgttgacagtttctgaaccaaaactaggattcatttcttccaaagcaaaaaaatagtgtcctcggccgggcgcggtggctcacacctgtaatttcagcactttgggaggccgaagtgggtggatcacctgaggtcaggagttcgagaccagcctagccaacatggcaaaaccccatctttactaaaagtacaaaaattatccgggcgtggtggtgggcgcctgtaatcccagctactcaggaggctgaggcaggagaattgcctgaacctgggaggtggaggttgcagtgagccgagattgtgccactgcactgcagcctgggcaacaagagtgagactctgtctcaaaaaaaaaaaaaaaaaaaaaaaaaaa

SEQ ID NO: 111067 - DNA, 1021 bp, Homo sapiens
tgagtacctacttattagagctaatctcaaattatgtgcaatcattactctgagttatgccataggatggagtagatctacagtgatctaacctgaaaaggcattttgaaatcttaattgcctgctggaacctccccctggcactgcttcccatgggccagtgtggctgtgcacacccacaccctccctactggggaaagaccccagcattaggcgattttacctaaaagtcggtcccacagcacaggctctgaagcagaacagaaagtgcccgggtctgcaggcagacacgcttctgttcctggctgcagctccaaccagctctgtgaaattgggcgagtcatttcacctctgttcctccatttcctcatttctaaaatggggatgaggacctgacccttccacctttgtgcagttattatgaggatttccgtatttacttgggtcaagctgccaatttttctcagcagttatatcgacaatgcaggtgcactggctaggaagaataattgcctaatttggggccttcagaatgtgtcttttgatcttgcatccaagtgtgcgtactgagacagggtgggcagcaggggccagttggaaggagtggaaactgtcactaatgtaaacagactgtccccacgttctgtcttctccggggaccaacctgttcacagaaatcactatcatgtacttactgttggtggtgtaatgttgtcctctgcctggggaggtggaagagtggtgtgccaaggccaccagtcttaagtcagactaccttgggttcaagtcctggctctacgagttagcagctgtgtgatgttaggcaggttacttgacctctctgtttcagtgttcttttcagtaaaacgggaaggtagtaaccacctcattgacattaaacagcgcctggggattgccaatcacgaaggtggtggtgattggcaggaaacctgtgacatcacttagccccttgccttccttgatcccttttcaaaaacctgtgtttgtgcacacacccctt

SEQ ID NO: 111068 - DNA, 1081 bp, Homo sapiens
attgtcagagagcataaacaagtgtgtaaccctagtagggaaaatgattcgagtttgctgcagtttctctaagaagggtgtggaatgccactagccagatggccttgaacttagagggtagcataggtgtgggtgtccccgcccccagccctgctttgctaggcctcagtttggaaacttgtcaggcttctgcttggttgttacctttgcacctgtccttattgacatgcaaaatcaattgcttcacttggtctttccgaagtacagggtgtgggcagaatcttatctgaagccatgtcctgtttggacaagttggacttgccttggcaactctccatagggtggagcagatgggtggaggcaggaaagtaaaattgggtggcttgttagcagagagaggagagagggtgggttgtttgctcactggatcattatatttcatctgaaatgaaataattaacttctttcccatttataatacacattaatgcaaaataactaattcatgaggggcgaagatttagaaacaccccatggaatttttctccttttcaaaccagtcatagaagagtaggacaggtgaaaatcacagagtggcatgaaaatttccaagaatgtctaggtaggaaattccaggtaggtgccagtgcttagctttgtttcagggagcctccagcttaaaaatgcctgctgacatctgttgcctgtcccctgtatttctggctagggcaactgtccttaaataatacttgagccattgggggattttgaagaatttgggtaaagaaacgaagagagaaaagtttctctggaaaggaagtttagctacagggatgttgcttgcctgcccagttttcctagccaagaattacacacacacatgcacacaccgccttttttttttttctttttttgccttaagttcctttggggagtaagggtaggggaagataacatgttttctctttgaaaaatccaaaaacttagaagagttgaaagggaggcttagcgatggtgtgttagtgtattgctccgtatgcctagccgaggtcagctgggagacggaagtttgcttggagga

SEQ ID NO: 111069 - DNA, 1101 bp, Homo sapiens
aaagaacaatagtgatttaaataatgtcttaatgataaaaagatgtagcacattaatgtgtaattcatttctaaaaggattcagtagtcgttgctgtgggcattagacaaagtcattgaaagctatgtgagctaaatggtagacttagaatttgaacgaaaaggaactccagagcccatcatcttaatttattctgctgtgctgcaattagtggtcgtaaagcgtgcaggatgacatgaagtggggagatgctggcctcgctcagaagctgttgttgcagtggtacagttgtgaagtgacaaggccttatatgagacctcatacaggatgtaggcagctgttaactttgaaactgaatctagtcagagttttatttaagggtgggggatagacctctaaggctagtgtatgttagcaaagaggcaaacgccagacatttttgctccggaagttggaaccaacacatttagtgttgtgtgtacagaatatacatccagattttatgtgcatatggatataaatgagggcaaaaggagtgtgtgtgtgtgtgtgtgtgtgtgtgtgtgtgtgtgttttaatctcacttgatagacctaaatccttgagaagcagatagggagccatgctctgcattttacaaatgatcactcttgccccatggctgcgttagtttgcagcctgcttgagtctcaaaaccatggctccttccttatacacctgagaatgtgaatgctttaatttagaagcatttgcatcaagatactctctagtgggatagatgagtctggaagagtgaattcagtgtaaaaagctgggggtgaggaggtgggaggctgccacagggtgaccagccgtgagtcagggctgctaaatgatctgacctcattgatgtaagcaggagatctcacatcttttgtttatggtccactgtgaggcactggacaacaattcttagaaccatgttcatccgtacagctgctagtctgggaactgcttaataatagatcccaagacacaaaagcgttttcatccctcattacgaaatcatctatttttcactggctgttgcggttagttcttgctggaatacataagagggta

SEQ ID NO: 111070 - DNA, 1081 bp, Homo sapiens
acgtaggaaaccagctagccaggaaagaatcacttgaaactaggcacccagtaccactgcagtgaggcagccccaataatatttgccttaagaaacgcttcctttccagaggcagacttaaaagtacagctttgaaatccatttgctcgattgtggtgtggcaactttaggattatttataaaggcactcaaaggtacatcaaattctatttgttacagatttacaaaaagatttctttgttctaaatatacaaaactatatttagaacaaaaagcataaggatcagatttccctattgagttgtgtatgcgaattatagcaaacttaagaggggctgtctcagctcaaaacagtggacaagatatcttatatgtattagctctgtaacttcttggttataataatcccaaaccatctctttgaaaatgggagtggagaccaaaaagtgtgagatcccaagactcttcatctagccttggcctgaaccaacatcagcgtcttcagagatgcggcaggttaactgtgctcagaatgtttgagggacacagctcaagcagagatatcctggtttggggacatcctcaaaaaactcatgaaattaaacaaccatagggtacaaagttacaaatagactattttgaacctgaaaatattcatggctaccatttatagctttatcttgggaacagacattgttccgagatataaccttctgagataacattattatcatccccagtttacagagaggaaactaagacacagagagggcgagatcttggcccaggatcacagagactgtcagtgacagagctggatttgtaactggagcccacagcctttcggtgcacctttatgtgtaaaataaacaactggaaagggcagtcagaattactgcacagaaacgattagattcccaacccataaaatccaataattgggagagatttctaaagttatctgaaaaagatagtctcccagtatcccaaagacatataaaagttttatagttaataattaaatttctaccccagcactttatttcctgaatttcttttaatggaaatgaaatattttcat

SEQ ID NO: 111071 - DNA, 1095 bp, Homo sapiens
taaaattctcctcccgtttttttggcagagagccaatgaaacattacggtattagttcattttcttcttgcttgtcttgcagtagtttataatgcactgtgttattgaagaacaaatgtatgaacatatcttggaaataatatttgtcaagcattaactcaaagatctttactacctttacagaaaaaaaaaatagctcttttctttttccttttgcaggagaaaaaccctacaaatgtacatgggaagggtgcacatggaagtttgctcggtctgatgaactaacaagacatttccgaaaacatactggaatcaaacctttccagtgcccggactgtgaccgcagcttctcccgttctgaccatcttgccctccataggaaacgccacatgctagtctgattgcctctgtgtcctgcctcagcgtgactccccactcacctggctctctctctgtcctgcctcccattatctaacacattttttacatgtacattttaatttgattcagctggtctgaatctctgaatttatatcatccaaaacttccatatggtcagtagtagatgttctctaatcctccctctccttaccacgggtcagacctaaagaatgtgaacacttttttttttttttctggggatgctaagcaaacccttcttacagatacgtttaatgtaataagaacaagggaacatgtaaactaacataaccaattgtcagttctccatgtattcctcaaaagaatgtcagagtaaatgtattagaaatacagtatccagactgctagtccttgccagagacattcttacctctgccctgtgataatattttatgcttgacagtgaaaacaagtgtggccccttgcaccggttagctagaagtacagccagatttcaagctagtgcagtcacctcttccgtcattcttcacaaatcttgtcaacctggatcttagacttcatctgaatcgagttctttgccctcctttgtgcctgcagctcatatggaggtctttgccaccaatgggagatgagcccaaactttcgatctaggtgggtgatgtgtagcagttcaagggaagggtgctgtgtttt

SEQ ID NO: 111072 - DNA, 1032 bp, Homo sapiens
tcatttgtattcatgacacataccataaagcatctgctaatgctttaatggattgattcaattaagacctgagtgacactatttgtaaatataactagttgtgaagcacacatacctttattttgggaatttatgagaaaatatagaaaaccacagatcagggattcatatatgtagctcaaaaattcccaaaagtttactgttagagttggcaatttcctatcactatttcagtgtcagaacaaactgaaaataatggctcgtgtttatgttgaagataaatagcaccattattgggggaagttattcaaaagcaggcttttgagcaccatagtctaaatgccaataaaaataattcatacatagaaatgtcattggtcctgaatttgaagaaagtgagcaacagtagttaaatgtgggtgcatataaccaaattccccttcatcaagaatggaggagaagagagaagaatgaaatcctgaagattcatcccagccgcaactcaggatccaacacaactttaactgggaggaatacattgtttgatcatttttaaaacatctgtgaatgagtgattccggaggcctgtgaattgtgtggggagcttgctttgatggcactgtgttaataaaagttgtagggactgtgcacctaagaggctaagaggtcccactcatccgccctgtgaaccagctgtaaagaaatgtagttaagaaatgcaaagaaatgtgttatcttggcacttgggtttgattttcctttttttaaagcactgcaaaacttctttaggatactaaaacatcctaattgggctgtttttttgttttgttttgtttttcagctaaaggcaaagataatttttttttcagctgaagtttttcttttttgcaactatgacatgaattgagtgataaaatggctctttgaaaagtagatattgtctgtattgtaaatgcttagtcatattcatggcaaagtgttcatttcttgagatggttctttcacaacacacaagaatcaagatggaacgca

SEQ ID NO: 111073 - DNA, 1094 bp, Homo sapiens
aaaactggaaaatctagattacggtaatttaaaaagaaaaaaaatattttaaatgcatcagagggctgggcgaagcaaaaaggattagaaagggccccactctggagagaggagaactgcagagaggtgagttgctaactagcagccacttatcccctgggggcccctcatcctgccactgggcagaggaaaagtcacttcctgggatgaccgcatctaaggccagctttcctcttttattcttcatcacaactgtctcagggcttgcactgcaatttgtcattaaatgtcagcttcattgcatttttatttgtctctctgcgtatgctataaccttcatgtgggcaggaagagtctgtccatcttgttcgttgttgcattcccaggcctggtatacggtagatgcttagtaaatatgtgttgggttggattggaatgaatggaatggaatatgaacagtgaaagctttccagctctttcagatttcctggattctagaggccccttttctccccagaggctctgttcccttaaggctttgtcaataggaccaaacctaagctccttgctgatagaatggcatcctctgagtcctgctctaacacctccagggcttggaagtaggtggggttgcgagccttatcagcaaccctctaatctcccaggccacacccaaactagcacctccaggcccttctctccctaaccacagaatgccttgcagctctaacagaaaaagtgtaagaactcctgttttgagggcctacctggcatccagtttctgtttaactcaaccccatttctcaatctctccaaagccctgcaagttcctcaagtccacgtgctctcaaacccctgccccagattctaaaaccaggcctgtccactctcagtcttattgcctggcctctgggcccaccttccccattctcactagaccctggaccacccaccctctctggggtcccatccagggggagcccacaccccatgagtgaagaccgtatagagagaaaaaatctaaatggaagtccgcagttgctgggtactttaaaaatgtctttctaaggccgggcgcggtggctcatgtctgt

SEQ ID NO: 111074 - DNA, 1035 bp, Homo sapiens
cgtccagccttgggcacgtgagtggacttctggactccctggtatatacagagatttcctcagccttttttctcccacatatctttctccatatatctttgcatatttcccagactttttgatgtgtctgctgcttgccccctctgttagcccttgctcaggtggctgcagctagtatgtttgcctttaattgtttacagcaaacaccagccagaaggctgttccagccctgagaaagttctaaggtgtacaaaacaaaggcaagcccctgagtgtgaatccctcaggcagcaaccagacaggtcaaaacacacaaccacaattctttgataacaaggcctatattgccccttctggcatgagcaagctatataactggttataaaaagtattacattaaattatggggacagaaatgactctactagtgaatgaagaaatcatttagattttatggttagtaagtggaggtttgagagtaaccatccgatctttattaatcttagtgtatattatatttctagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaat

SEQ ID NO: 111075 - DNA, 1015 bp, Homo sapiens
gaaaagtgcccccaatggctcggggccaagtcagaggtgggctgcagggtcccccagcccgggcacgaagggagcaggtccctgtaagacagaggcctcgtcccagggtgcgcctgccctcggccttggcacagggagctcaggccttgacctccccgctcccctcgccttactcctcccccaacagccgacccacgccctgcctgctcttccagtccagccaacactctaagcaggcaccgcctccactcgcagcccccgggatgggtcccactccctaccgcagatccccaggccccctccacccagtcggctagccctcgcctctgccatccggtgagtatttccaggcacctcagaccaggcgcctgaacgtcactgccttttcttaagtaggaagacatctctctatgggctgtgagagcattacctatgccctactgatcccatcatttcccatcctaaacatcttgaaggacacaggcaggtggcttcttaaatcagtgtgctctgaactccctgtgacctcagccaacctgtgacaactgagaatgagacaggctctatcctcagagcctctttttgccctctctgcagcctagtggctccttccctaccccacccataggcctgcgtccccgccctcctttcttccatcaagcctgagcttgggaaagaatctgataaacttcttacattgtaacctttaagtgaaggaatgagacgttagggatggatttgaggcacaagtgagacagtgcagaaggaatttgagggttggagggggctttcttgaatctgagcgattcagaccataaaagtaaacttgtctttgtttatttgaccaggcttacatcaaacatggtttctcttttattaatatcaaacacaatgtatttcaattcagtaaatatctgagggacagaaaccaacctaggtgctgttggtcacagtcttggaggacagaatggcagaagtaaatactccataaatacatggaatagaaatctgtgca

SEQ ID NO: 111076 - DNA, 1224 bp, Homo sapiens
cagcacctcagactgtgaccttatttggagatagggttgttgctggtgtgataagttaggatgaggtcatattggtcacgcgctaaccaaataggcctggtgtccttataagcagagggaaatctggacacagacatgcatggagggaaggtgatgtggagacacagggagaaagcagccatgtcaagacacagagagagactggagttttgcagccacaaggcaaggaacacttggggctaccagaagctggaagaagcaagaaagaatcctagaggctttggagagatcaaggccctgataccaccatgctttcagatgtctagcctccagaaccacgagaaaataacccagtttatggtactttgttagagcagccctaggaaactaatatacttgaaaccaagaaaacaacctaattagaataagaagtaaacctgctgtttctcatggagaacatcattagactttgcatccagtgttttaaagagaaaaaacaggaaggtgaaagggaatattttccacttttctctgcgcctactaaggtgaagctaaataacatgactgatttccaaagaaaataaccagaggccatacctccaagtaaatgctgagcctttcagacttgttaccctgttaatagaaacacttgagccaatcagtaacatttttttcttttggttaaagtcaagtgccacaatgaagcaaagaaaactcttatctctgccaggcgcggtggctcatgcctgtaatccagcagtttgggaggccgaggccggtggatcactaggtcaggagtttaagaccagcctggccaacatggtgaaaccccgtctctactaaaaatacataagttagctgggcgtggtggcgtgtgcctgtaatcccagctactttggaggctgaggcaggagaatcgcttcaacccaggaggtggaggctgcggtgagccgatattgtgccactgcactccaggctgggcgacagggcgagactcagtctcaaaaaaaaaaaaaaaaaaaaaatgaaaactcttatcttgcatggcttataaagtaggctctgagggcaacagtgaatattcaaaattaataattttaccagagattctgaagtacatacatcacagatattaagtaataaaaggaaccttcatctgacactttaaaaaaaacaaacaggccaggcgcggtggctcacgcctgtaatcccagcactttgcag

SEQ ID NO: 111077 - DNA, 1053 bp, Homo sapiens
accctgaaaaataattgcttttataaaaaattaaatcatttgaagtcatgtattatgatcaaccccatctgttcaacacacacacacacacacacacacacgtttttaggaaagatgagaaattaaatgttcatttcaaattgttgctaaattgctttcctgagatgttatatcctggacctccgggatggctatgattggaatctgtctgcctttatttctaacatgaaaacaccatggcccgcctgtgcagaaggtgacttcccaggtatctgagcaccttggggaagctaatttctacaaaccgcaaaggaactctcttatttccctattcaggcccctaccttgtattcagcactttacttcagcctgccgaaggctgaacttccttcaacccctttgagccctcatctgaggtccatagttccttagctggtattgctgaggctgtagcacatcctcactcacccctgccagggcctcagctcatcacactgctcatttagctatgagcttgatgtgcagcccagggtgacactcagagaaaacagagccttctcttcttggttgggtataatatttaagctaaggcctatgctttaagatttgggactcaattttgccctttcgatctgtctatatcaatacctgaaagcagtttttcttgaactcattttactttgattttgagatccgcttttgatgcttcttatttaataaggcacaggcacaggcctacattcattatttagactagaactgattttgcacttgatgttaagagaaaaaactggcacgcttgttcagggtaattgcatagaatgaaatgaatgcaatttatgtaaagcattattgaaggaataaaaaacttccaaggtaagcctgttaaatcattcatttagtaactgactgacatttgcacagatctggatcctgcgctttgccagattttaaagcaaagcaaagaaacaattacctaaaagtggtggtgaaaaacagtattgtaagaaatcctggaaggtggatctattttaagtgattattctctcttaa

SEQ ID NO: 111078 - DNA, 1037 bp, Homo sapiens
aactacattttttttttctacccgtgttactgcatctccagagaaccatgctgacacatttttcccgtacattctcactgctgcctataatccatcactacaaagagaggccttaaaaactgcactcaagggagacatgatttcctttccctttctctgtcagaaaagcaactcataatagggaaggaaaagattgcatttaggttaaaggaatataaataagaaagagtctgcctctttctctctttaagacgctaagcctcaaaagggttcttggttttaaaaaggccatcaccccttgacctacactaaacattaatattatatacctggtaataaagccagaggatttttagtgagagctatgaaagggaaaggatggctaagacaggtttctttggtggatgaaagtcacaggctcataaatacaactttgcgaggttagtcttgtggttagctagtacttaaaatttgtgattccctcgactatatgggttgacgggggaactatagactttttctcagacaagacagcagtgctcaaaattacgacttgaaaacagaaacgaccagaattcctaaggtgaccaaaaagccccacagaactgtgttaaaactgtcctcatatttggacacatgtactgagtaagaggggagcccagggaaaaatgccatttttgccttttaaaaattaattttgccattgaaaacaacgttatagcttttaatttattaatcaaataagattttcattgactggacaaaatttccaccaacttaccccacatttaactggtgtcaaatgattatttagctaatgcttattatcagtcatagcttaatactttcactgctaatgctgggtagaaagcctaaatttttaaaatatttgagctccttaggtgcactcaagctagggttccgtgtatctgctaatttaaatggctaacaaaagcccccagtgaacaaagtccccagtgaaatgcggtgcaaatctctatgtcgctactgatgcagctgtagggtgggggactgga

SEQ ID NO: 111079 - DNA, 1060 bp, Homo sapiens
actgagatcatcctgagcaacatgatgaaaccccgtctctactaaaatacaaaaaattaactgggcgtggtggcgcacgcctataatcccagctactccggaggctgaagcaggaaaatcacttgaatctgggaggcagaggttgtagtgagccaagatcacgccactgcactccagcctggtgagagagaaagactccatctcaaaaaaataaatacataaataaataatttcttttcccttgaatctgggaaggtttgtgatttgcttataaccaatcaaaggcagaggaagtgacactgcatgactaagtcagaaaaggcaaagaaattcctgtcttgcttttcagaacactcatactggagccttgaaccactacgtaaaagtccaaaaccttaaggccaccatgatgtgaagacacccagactagcccaggtagaaagaccacataaaggaaacaatcagcagagtgaaaaggcaacctacagaatgagagaaaatattttcaaactgtttatctgataaaaggttaatatccaaaacacatcaggaactcctataactcaattgcaaaaaatatatatatcaaatatttttaaatgggcagaggactttcatagacatttctccaacaaagatatatggcctattgatatatgtgaaaaggtgctcaatattactaatcattaggaaaatgaaagtcaaaactacaatcagaaacacctcgcacctgtcaggatgaccattactaagaaaaaaaaaaaaaagaacaggtgcagtggctcacacctgtaatcccaatacttccggaggccgaggcgggtggatcacatgaggtcaggagtttgagaccagcctggccaacacatggtgaaaccccgtctctactaaaaatacaaaaaaaaaaaaaaaattagctgggcatggtagcaggcgtctgtaatcccagctactcaggaggctgaggcaggagaatcgcttgaaactaggaggcagaggttgcagtgagctgagatcgtgccactgcatttcagctttgacagcagagtgaaactccatc

SEQ ID NO: 111080 - DNA, 1383 bp, Homo sapiens
taaatttttgtagagatggggcctcactatattacccaggctggtctcaaacccctggcctcaagcaatcatcccacctcaacctcccaaagcgctgagattataggcatgaacaccacacctggcctccccgccccagttttgacaaacaaaagaaaaaaaatgtttccagatattgtcagatgtccctggggtgacaaaacagctcccagctgagaaccactgcatgaaacgcttcacttatattagatcatttaaaaaatttttttttatttccatagatttttggggaacaggttatatgagtaagttctttagtggtgatttgtgaaattttggtgcacccatcatctgagcagtaaacactgaacctaatttgtaacatttaattgttgtaaccaccttatgaaatagttactatcattatttccatgttagtcacttcaggccagttctattctaggtaacctaatcagccagaaagtaaacttaaaagacaatccataacctggatcagcctaactacttatctttcttttcttttttttatttttgagacagggtctcgctcttttgcccaggctggagtgcagtggcacaagcaaggctcactgcagcctcaacctcctgggctcaagcaatcctcccaactcggcttcctgagtagctgagactacaggcacacatcaccaggcccagctaatttttgtattttttattttgtatttattttgtatttgtatttgtattttagagaaggggtttcgccatgttggccaggctggtctcaagctcctaggcgcaagtgatccactcagcctcccaaaatgctgggattacaggcgtgagccaccgctcttggcccctaattacccctaattgtgttactggcagataatcatctactttggcaacacagcaattcttagattaacacatttttgtggggaaaaataatctctttttaacaaggtctacctgagtatggagagggtccccggaaattccagtatcctcattcattttgtggtccattcaaaaaatatttacccaacactaacaagacactaggcagcgtcctgaacgctggagatctagcagcaagcacgcaaggttctcacgctcacattctagtgagagcgtacattccaatgagagagagtaattaagtaaataataatttattttcagttattgtgggtgtcctgaaaaaaaaatcgggcaaagtatgagggtgagatgtgccagcagaaagttgggcagggcacatgttggtttaaataaggatgttaatgaaggccttgtcattaatacaacacttgggaaaaggcaaaaccacagagacagaaaatagatcagtggttgccagaggctggagacaga

SEQ ID NO: 111081 - DNA, 1387 bp, Homo sapiens
tgatccacctgcctcagcctcccaaagtgctgggattacaggtgtgaaccaccgcgcctggtgtacattggctcttcagggcttctgtctggaagtgacacttaacttccactgctatttcattggccaaaagtcacttgactacacccaacttcaaggagatggggaaatgcatttctaccatgtgcccagaaagaggagaactggaatagtctgtgaacggtcttaatgactactaaagaggcttcagagtcccatgagctaacacagaatctaaataaatcaaaagccaaatatgtcagtacagtattctatttagaaaatagaaaacagcatttctttgtgtatgtgagtgtgtttaaacagaattatgctaatgagaattatgaagaatgtcttttattagtttgaaatgaaatgcttttgagaacttcacaattaagtttgttattttggccaaatgaatttcattctttttaaattgtatgtccattcaataaacatttgttgaatgtgtataaggggccaggtgtagtggctcaagactgtgcagtcccagcactttgggaggccaaggtgggaggattcttcagtccaggagttttgagaccaatctggacaacgtagtgagaccctatgcctacaaaaaataaataaaattagctgggtgtagtggcatgtgtctccagtccgagcttccttgggggcgggggtagggaggtgagatgattgatcatttgtgcttggcaggtcaaggctgcagtgagccatgatcaggccactgccctccaacctacgggacagcaagaccttgtctcaaaaataaataaataaaaaataaataaataaataaataaatgaaagtgtataaggcactgtgttaggcctgtgaggataaaaagataaatgagggtcgggcatagtggctcacgcttttaatcccagcactttggtaggctcaggtgggcagatcacctgaggtcaggagttcgagaccagcctggccaacatggtgaaaccacatctctactaaaattacaaaaaatattagctgggcatcatggtgcacgcctgtaatcccagctactccagaggctgaggcaggagaatcgcttgaacccgggaagcagaggttgcggtaagctgacatcacgccactgcacttcatcctgggcgacagagtgagactccatcccaaaaataaataaataaataagtggggagtttacaatcacaatagaaaatagctatacttgagttttctctccctttctctttaaggcatcatttacagtatgtaaatgatgtgtatacacacatatataaaatagtgaaaaatactaaatatataaactgttacactttgttcctctctgcctttttggac

SEQ ID NO: 111082 - DNA, 1036 bp, Homo sapiens
aagcctgtcactgttaatgtcacactgacattcatcaattttttttttttttttttgagacagagtctcgctctgttacccaggctggagtgcagtggcgtgatctcggcttactgcaacctctgcctcccgttcaagccattctcctgcctcagcctcccaagtatctgggactacagacatgtgccaccactcccggctaatttttgtatttttagtagagatgctgtttcaccatgttggccaggctggtcttgaactcctgacctcaagtgatccgcccacgtccgcctcccaaagtgctgggattacaggcgtgagccaccacacctggcctcatcaattttttaaatataactttggaacaattctttttcttatataatattttgcaaataatatatagtaaatatatagtaaacattctgagcatactacagattgatatcttaaaatgttagacataatgaagaaatgcatatgatatactaattactcgttttaaccgtcataatatttacatggatttcagaacttaaactgaaattttgagttattagaaaaaggggaagacagctaagtggtcttacatactcagaatctcattaaccatggtggatctggacagtttaaagcaggaattaagggacagcgtatgttggtcatgttttatcaattgtattctaacaaggaaaaatgtctgtctgagtcttagacttctggtaatttctactgccatccacctaagtgatttaaaagtttcttgtcttttaactttgactttgcctctgtagcctagctaccttttctccatgacagtcatctaagtcattactttgctattaaaatacaaacttagtcttcttataacatgaggaattttagaccttaagtaacagagctgtcaccttttatgtgagcaataggatcctaagtccttaattgaggaggaattcataccagggctagcaaaatctatatggcggcccaccatgtaaccatagtataaacatgatttatacttcccttgatttac

SEQ ID NO: 111083 - DNA, 1016 bp, Homo sapiens
tcaaggagttcatgaaccctctgaaggctatctgtatgctgcatccatcaaagttcttagttttaagcaactgaagttgactggatgatttaaacagaaataggaagttattgaatcataatagttcccagaactgctgggaaggctgaagaattggcatacgaaaaggataggtcctacagttacacagttgaccttttaaactccaaattgtttaagcagaaaacctgtctttatgccatttattgctcacattttattttacctgtgtttcacttggaactagagagtgaagttttaagtgtttagaatcagatatattaggcatgaaaacaatggtatgtacatacacacacctcatagttaactacgtaactacataacttgctcatttaactttaggaagtatattagtaaggcataggctaaaatgatataacaaagagattcagaaacacagtggcttaaattagatggaagtttgtttttctatcacctcataggtgggcaagtggcccagggcggataggtagctctgcttcacaagttcattcagagacccaggttcctgttatattgtttctccttcctgtaggatattatcttttctccatgattgaagcttactcagctgtccctcagcatgccaacctgtaggaaggaccgaagagaggaagagaaaacattaagcaagcgacacaagttgcacatatcagttctgcacatattcattggtcacatggccacaactggttacaaaggaggctcagaaatacagtcttaccctaggtagccatgtctccagctaaaagtcatttactgtggtagatataaagaatggatcttgggttataatcaacagagtgcaggaagtgaagatggctgaatagaactcttcagagttctttggatctaatttttaagtgaatttttccctattaacattttatatatatatatatatatatatatatatatatatatatatatacacacacacacacacacacacacac

SEQ ID NO: 111084 - DNA, 1003 bp, Homo sapiens
tgtgatgattaaatcggtacatgtgaagtgcctaacctatggtaggtgctcagagaaggttagcttctttccttgataataaagtcttaactattaaaaaaaaagccatggtatatttatacaccatattttgtctattctaagacatattttaacacctctgaatttccatgcatattacaaccaatggtgacttgtcaaagagatggcagtgatgaaacagttgtcactgccttcatgtgcagtttgttttccttttcatgtatatacagagtgatatatgatacttacatgtgtcatttcaaacatagcatacttttttaatgacacacacattgacagtgtgttttataactgatggcaccttaaattcaatgagataacaacataagaagagcctctttgttctaagcataatggcacatgtcttatttatcatttcatatattctttttgcagactttatgcagttggtggtcgtgatggaagttcttgtctcaaatcagtagaatgttttgatcctcatactaataagtggacactgtgtgcacagatgtcaaaaaggagaggtggcgtaggagtgacgacctggaatggactgctgtatgctataggggggcacgatgctcccgcatccaacttgacttccagactctcagactgtgtggaaaggtaatttcctgggaagaaaaactaggaacaaaaaagatatatataagtctctgatacttacatatatttggagaacgtgttggagaattggaagggaaagtcggcattcaaaaatgcaaagcaacttcactttataacagcctgctctcacaggaagtgatacttccagaaaaataagtttgtattgagcatgcactacatgcaaggcaattttattttatatgggatattggacctaataagaagaggagcttgatgaattttaggcagaatgacttaagggctgtagactaaataaaaagcaaaaaggatagggacatttctatgtgtt

SEQ ID NO: 111085 - DNA, 1840 bp, Homo sapiens
atgacatgtagtctgaaaattgcctaacatgtggcaagtggaacattctgattaagcttatgttcttacatcccaggttttctgatgcttgggaaatgtgcaggattctgaatgatgaggctgcctggaatgagttggccagagcttgtctacatcacatggaagtggagtttgcaatccgtgtttatcggagaattggaaatgttggcatagtgatgtccttggaacaaataaaggtaaacagcatgttatagaattatcaagttaaaatttaaatgctattttaagttaaatgcagtctaaattttttgcatttaatcttacctcttaaacaagtgaatcgatagaacgttaccacttcctactgatcaaagtccttaaaaaaaaaaaaaagttaaactcttgcattttttttctcatcagaattgcttttatttgtagggaatagaggactacaatcttttggcaggacaccttgccatgtttaccaacgattataacctggctcaggacttgtaccttgcatccagctgtcctattgctgccctggaggtatggcagcaagtaagaatggaaattgtgtaagaggtatccagtggggaaatgggggaaaaaaaaatggggccgggtgcagccgctcacgcctctaattccagcactttgggaggccaaggtggatggatcgcctgaggtcagaagtcctagaccagcctgaccaatatgatgaaacctcatctcagctaaaaatacaaaaattagccggacgtggtggcatgtgcctgtaatcccagctactcaggaggctgagacaggagaactgcttgaacctgggaggtggaggttgcagtgagcctgtaatcccagctactgtaatctcctgccccagcaggagaattgcttgaacctaggaggcagagattgcagtgagccaagattgtaccactgcactccagcctgggtgacagagcgagactccgtctcaaaaaaaaaaaaaaggaaagaacataagaatatcaaaggaggatcaccccttctatataattaaaatttctcagcacagacactatatgccttccccctcctaaaattcaaacatgtcagtttaagaacccctgagtactcattaattataatgttaatcattaaaattataattcaaaaatgtttattctgcattttgtggaggtataaaatgcatggtattataacattactaattgaaatctaaatgtgtccaaagagaacagattgtgtaaattacaaaaacatatacaaggaaaaatatcaccatatattgagtgctcatgtgggccaggcatttttctaagcacttatcatgtattaattcatttaaccctcccaacaatcctatgagataggattggttttttctctattttccagatgggaaaaccgaggcacatttatccttattgtgtgaaattctgttgtgtattaaaaggtgagctaaggactagtgtaccatcactggtttcccagaggtgagcattgcaggagagggcctagagcaggatgaagggcctggttagttcaagggcagggaagaagggaaacctggcaatatagactagcaatgaggggcatagacttcacagtcagacatgtctgggttcaaattccagctctgtgtaagcttggacatgttatttaacctttctgaaccctagatcctatttctttaaagtaggaagaataatatctaacccacgggatatttgtaaggatttaaaaatgagaatgaggtcttttagcacagtgcctgatcaatagtaaagacacataattagctattgtaatcattaatattatttcacctaaa

SEQ ID NO: 111086 - DNA, 1002 bp, Homo sapiens
catcctttcaaaactcaggtaaagctttcattgccttctctcgtctccatcctccaactctccctaccccaaccttcaggatgctgtgggtaacccagcagtcgctcttattttaattgtgccttttcagcctatttctctttctagtctggcacttgtcatcccgtccaactctgaatttactttctgtctctcccatcaaatcatgaccttgagggttgaactgtggctcagttctctctgtatcctgagctcctagcacgcatctgacaggaagaaggtgttgttagatcaacgtaagctgaataaagtaatgacttatttgactgcatattttccaaaattgtgtccacatttataaagatttaagaagatcagctcataaaaattaatgaagatatcagactaatcctcttactcactcaataagtattgacagagcacatgtgagcagaaccatcctgaagagtctatcaagcctctgcatattataaagaactaggtctgtaacagcaccgcatcattaccctccatcgcctaatgtctcatattgttaaggccaaacacagggaatggaaagaaaatgccgtgagactgtaggaagggggttgtgggctggaggggtgagaggagacatcattcatgagacagaacctctgaggttgtgggggagaggaaatagcacttgacaagagatggtcttagtctcttacatttatacagtctcctgggatagtacattgtttaacccctctgaaacctagaaatggtcatctctttagtcttttgggttcaaagcaagcctatgttacaaacgtaggggctactctttcctacacagaaaaggggctggggcttgattctgctgcctgcttgggaagtaacacatacgtatcacggacctacctgcagactgctcttctctggcaatgatgatggcagtctgggcagcttctcggtattgcttcagagccatgtacaagcggaacaggtacttggcat

SEQ ID NO: 111087 - DNA, 1052 bp, Homo sapiens
tacatttacatgtttcaaaatcaaaacaatataagaaagctgagcgtggtggctcatgcctgtaatcccagcactttgggaggccaaggcgggcggatcacttgaggtcagaagtttgaaatcagcctggccaacatggtgaaaccccatatctactaaaaatacaaaaaaattaactgggtgtggtggtgtgtgcctgtaatcccagctacttggaaggctgaggcagaagaattgcttgaacctgggaggcagaggttgcagtgagccgaggacgtgccactgcactccagcctgggtaaagagcaagacgtcgtctcaaaaacaaaacaaaacaacccacacactataataagatgcacatgatgaagcctggtccccctcatctccccgtctccctgtccccacactggagtttggtactgtgcctcctgccccgtgcctcattccacacaaagcagcgtattgtagatatgttctgtatcttgttttgttacttaacaatacagacatctagacaatcactcgaatccaatggagaagggcctggagaaaatctcaatgggggacaaacacctggcaggttatgtcccaagtcactccatgggcctcacctttactagtatatagctgtgcagaatcatgaggttggtggccatctcggagggaattttgatcttctgggatttcagttctgcatacatactgaagagaacatcgtgtgcattccggtagttgccttgaaaaaaggtggtaaaacgacattactgcaaagggtgacatctgaggacattctatggacccccatcttactagtggattttgttaatcttgttattagtaatctcttaataatgtcttattcaaagcaactcagcagatttcctatttatctgtctgtctgtctgtcagagatagggtctcgctctgtcaccaaggctggagtgcaagggcacaatctctgttcactgcaacctctgcctctcaagctcaagtgatcctcccatgcctgggtaatttttgtgttttttgtagagacaaggttttcacca

SEQ ID NO: 111088 - DNA, 1049 bp, Homo sapiens
atggatgtcaaagctggaagacggggatctggtctggtggcatcaaggcacggtgacaccagctctggactgtgatgccttgtgtatgagtcaaataaatactgacttgattaagctgctgttaggttttctgatgcttagagctaaatacaatcctaattgatatgcccatctttttttttttttttttgagatggggtctcactctgttgcccaggctggagtgcaatggcacgatctcggctcactgcaacctctgcctcccgggttcaagcaattctcctgccccagcctcctgagtagctgggactacaggtgtgcaccaccacgcccagccaatttttgtatttttagtagagatagggtttcatcatattggccaggctggtcttgaactactgacctcaagtgatttgtccacctcagccttccaaagtgttgggattataggtgtgagccactgcacctggccccccaccgttttcttattgagcttgcacactggcagctacatttttggaaatactttgagaaatacgattagatagcagaaatagccatctctgcctacctgaccattccctcgatcttctttttgtatttggcatctattttgctgcggtattcaggcctcatcaacatagctgcgaagctgaaagcagagttcttcaggcctgccctgtgacactcaatcacagttgacgtcaggatgggtacaatgtctgcaagagaaaaggggagagcagcaacagcacagtgtctgctgtcctcagtgatacaggcgggattccaccctggttctgtaggaaaacagggtcatggtctctgaactttgctttttctgcaaagaaccagatatgatctgtttaatgaggaaagtacgtagctgtggggtcaggctaactgcccatcaagtgcttttcctttgatgacaccatgttctgccttgtaacactaggacctgcaccccttgaggcaacacttccatgagtttcctttcatgcctcttagatattttttgcatctgacaggactgctgataaaagcat

SEQ ID NO: 111089 - DNA, 1110 bp, Homo sapiens
ggagccaccgatgatgtggccttttggagccacttgatggcacatgccatctttgcagcataaaactgtatacttactcttttcgagatccattgagtcacggccattttgttacttacacaccattcagctttagccttcatcttgttaaatgttggcagtttgtagcaccaccatgatttgatctcttaaagttactgatggggtagattatttgtactaggatgagtagcttcctaaacaagctccagtatgagtatgctcatggtgaaggtctaaggcctgtaactcctaagaattatttgcccactctcacagtcccaggtgcctgtggttcttattcctacagccttacagtatacctccaggcatattagaggaagcaggggactgtgggtaggttttatgatgataataactttgtaccacttagtaaggccaaggcctctggcctgttctctggccggccactgggagggaaggacaggtcctgaagctggaggcatcatgcagttgggatacttggatgctatacaacattactggcaccttgggccctagcttaggcccctgggtaccactgtaatgctcaggttgctggggccatactgtaaaataatatcatcggattcattcacagttgactccctgactcatttctgtcagctgctcagactttggtgactggccttggatggcaaggaagcatatactgatgtgggaaaagaagaagaagtatgtactcccttggagcaagagagagtgtgtgtgtgtgtacagatggtgtgtgttgtatgtgtgatatggggaaaaagaaccttcacacagcctcagagaagatgattccaaacaaacaatgtatgttttcaggggaagtcaaatgacttaattttgtgacgggaattctgtagtatgcagtagaatgactcggcagatagatataagctgatagtttcattcattctttacaagattggttttcctaatttttgatgttttgcttctgggctgattgattctgcttaatagctgtgatttgtataaacaacagcttttcatttcaagctttttacaccattcacatctgtgttcaaacttgacaatgtcctt

SEQ ID NO: 111090 - DNA, 1035 bp, Homo sapiens
tttaattgaccgtaatcattagtctttctatgctttaatctacctatgttgtcagtcatttatgttaaagaccatcatatccctcttaagtaattatttgctgtgacgttggcatcggtgaggtaaccggtatgttgagattagttgcttgaggaggctgagttggcgacatgatctccctgagggccataacatgttggatcaaggtgtgtaccgcaatctgttgttttctctgggagaagtttcctgtaccagcagatcagagttatagaaagggtctgactgccctgtaggtaggtatttggtacagtgttgctttatcttccgtagactgtttggaagccaatgactattaaggaagtaactttgtacggaacataaattctggactgcaattgattttttttcaggccatttatgccagtgttcttcctggagagttgatgagggggtacatgacccagtttcccaccttcccaagctggctggggaagcactcgtctacaggcaaacatgatcgtattgttcaggacctggccttgcatatgagtctcaggtaggtgggattactctgtttcgggtattttatcgatttggtgtatttggcctttatccagtaatgatcatgtgagtcaaaagatttgtgttttagtttttattttattggtaactagatgaatgatcctggataagttccttatattttatgggcctgagttttatcatctgtaatcagtataacacttgttttgccacttaaaaggatactttggacaataaaatggtagatgtcataatttaaaattttaaagactgcgtaagtctgaggtggcactgttactgttattgttattatgcctattagtgggaatagcttcgcagcttcagaataattaataggaaaataattgaactatttaaagaaatgaactattttttaccaatttactctagtagtaaactgacctagtcatttgggataggaaataacagtttagcatgtaacaggaggaggctgctcagatcattgaaaat

SEQ ID NO: 111091 - DNA, 1076 bp, Homo sapiens
gtaattataaataaaactgcttgtaaacatcctgtgcagatttttgtgtgaacatagtttcatttgggtgaataccaagaagcgtggttgctggatcgcgtggtaagagtatgtttaattttgtaagaaactaccaaacggtacagttttgcattcccaccagcaatgaatggaattcctcttgttccatatcctcgttagcatttggtgatgttaccgttttgaattttggccattctaataggtgtgtccctctcttttttcagggcccatttgatgttgcccggaaagtgtttgcagctggagaggagactgctcacatgtcacttgtggacaagtcagatctcttttttcatgattattcaatagcacccctcttcgtccaggaaaattacatacacgtgaagcctgtagcagcagggtgagtgtccagagctggtgagaggtgtgcttagtatccagcactgcgaaggctaaatacccgtgaagaagggacctggggtgtggagagtgggataatccagactggttctttcctgcaggggtgacatgaaaaagcacctgatgcttttaagcagagcagcagacagcatatgcgatggtgacctagtggacagccagatccggagtaagcaaaactggagtcttctgcctgcgcaggtgagcagagggctctccctaacatgcaggctctgcttttactaagagaactaaatagcttttagctgctgtacttattttattttattttgtttactttatttttgagatcgagtctcgctctgttgcccgggctggagtgtagtggtatgatctcggctcactggagcctctgcctcccgggttcaagagattctcctgcctcagcctcctgagtagctgggactacaggtgcccgccaccatacccagctaatcctgtagttattttaaataccagataaatgttatggctcttgtggcaaaaatatagtctgttacagattataatactctgtggtaactatcgtctgtttcctaatctggccttatttttcttttttctttctttctttttttttttttttttttgagaca

SEQ ID NO: 111092 - DNA, 2426 bp, Homo sapiens
tcattgtctgttagtatcatactttatactttacctatgggtttttatattaattttgtaccttctttctttcttaactggcctttcttggcgggggtggtggagttaatttgtattgtgccttcagtggtttccaatattttgattaggagttgggatacagctacgtggaactgaatgcaagtgacacccggagtaagagcagtttgaaggcgattgttgctgagtcactgaacaataccagcatcaaaggcttttattcaagtatgtggctttttgacctcctgttgttgttatataagaaaaatatgttcatttcaatgttcagtaaccagtattgaacacaggttgtgtgccaagcaccctactaaattctggggctaacaagagaataagaaagccgtctgacatcactcttatggggcagtacttaccctttcgtaggtcttagaggtttctaagaatgtgataaaaatgtgtacatgcacatattcgtttttcatgattttagaggattcacaggtgaatcctgtaaagagagaaagaaaataaaaaaccatgtgtaatgcagtgtgacttattacctcattaccttattaacctcactctgcatgtatgtaataaagtatgtaatacagagtgaggtaataaggccagcagatgaagaagtaattatgcttggggcattgagttaaaggggtgataattgttttgaaagacctcaaagaatgagaaagaaaactatttggaggtggaagaggtcactgcaggcaaaggtagtaaaagagaagacagtgtgcaaatgcccactgtgtttcaggttgtagctagtggtcctctatggccagagttcatggaaaataagatgctcaagttaaggaccgcacagtgcctatttagagtctatggtgtgttgttttgtcacctgaattcttggtgccttcacattgttcaaaataatttgctcaggaaatgtcactcttagacgtggctggtgggagggtagattggtacaactctggagagagtccagcaatatttctcaaattacacataccgtctagcccagaaattccaattgctggaatttagctattattttatatgtgcaaagtggcatatatatgccatatagataaggatagtcatttagtatgacataatagaaaaaagcttggaagcatcctatatatttcattaatggtgattaagtaaagtgtgtgatacaagtgtagaatggagtattaaattgccttaaaaaatgaagtgttctgtatctgtaagataaagaatgaatcaccaaaatacataaaatgacaaaactggctgggcatgttggctcacgcctgtaatcccagcactttgggaggctgaggcggacagatcacctgaggtcaggagtttgagaccagcctggtcaacatggtgaaacaccgtctctactaaaaatacaaaaattagctgggtgtggtggcgtgcgcctgtaatctcagctacttgggaggctgaggcaaaagaattgcttgaacccgggaggcggaggttgcagtgagccaatatcgtgccattgcactccagcttgggcaacgagtgaaactctgtctcaaaaaaaaaaaaattcaaaactcagttgtatatttttatgcacatatgtgtacaatatctcttaaaggacatataagagactgttgtttgcctctgggaagggaattggggtctgcaggggaaggggtggcagggagagtttctcttctctgcatattctttttttttttttttctttaacaacactctgtagtccagtgctgcatattcttgtagcttttgaagtttaatatctgttacataattttctacagagcagcagtttttgagcaattgttattttgtttttgtctcatcccattgctcctcaacctgggtcagatggagcagcctcttcagtaagcacgaaacatgctctcatcatggatgaagtagatggcatggcaggcaatgaggataggggaggaattcaggtaattcaagtgctgtatttttgcagtttcactgttgataatttagattgttagaacattgtcattctctcatacttagggcagttaaggcatgttgctgaggagatttttagaacctaaaatagcttgtgtggtatttgtcatttttaaaataattatttttgtgttgcaaacttgcctttcaggaattaattggcctgataaaacatactaaaattcccattatttgtatgtgcaatgatagaaatcatcccaagattcgctctctggttcattattgttttgatcttcgttttcaaagacctcgggttgaacagattaaggtatgatgattgaaattttttttccatcacactagcctatttatttaagggtcaatttttaaaagtacctgataaatatttttaa

SEQ ID NO: 111093 - DNA, 1050 bp, Homo sapiens
tctggtgtgtttgttaatttttatagtttagaaggtggtgatttccacaaacaggaaagtctgttgtgaaaagaccagcccaggttgagtagcccacttggatatctctgattgctctctgtagtacgtttagcaggatagaaattctgtatgtttcatcaggtttcttttttcctcatttttccacttcttaagatgaagaaagagtccaaactggagagaacaccccaaaaaaatgtccaaggaaaaagaaaaattagtccatctaaaaaggaatcagaatctaaaaagagcaggccgacttccaaaagggacagtttggcaaagacaataaaaaaggaaacagatgtgttttggaaaagcctggatttcaaggagcaggtggctgaggagacaagtggtgacagcaaggctaggaatttggctgatgacagcagtgaaaacaaagtggaaaatttgctctgggtggataaatataagccaacctcgctcaagaccataattggacagcaaggtgaccagagctgtgccaacaaactcctacgctggctccgaaactggcaaaagagttcttccgaagataaaaaacacggtgattttacaacctcactcatttttgtgtgtgtgtatatcaacatgtgattgctcagtggcacatatatgagaaaatctaacgattcattcatctgtcagcaagcatttattaagagcttgatctgaacccaggtgcagtactagaccctgctggtggtgttgtgaacaaaacagtccctctcaggagctcacaggcagtgggggaggcatatctgaaccagccattaaaatatatttgccaagtactgctagaggggtaagtccagggtgctgtgaggatgaagatgtgtggtcagggccagggtgtgtgtgctcccatcccagaggaagggatggctaagctaagacttggaaacaaagtaggagctagctaggtgaagggagggagagatgagtgttgggtaggaaagagtatgtgtcccaaggtctgaagccatgtgacagcaagacccctga

SEQ ID NO: 111094 - DNA, 1044 bp, Homo sapiens
ttagggaatgtatctgttattttctttcttttcaatgttactttttcaatgaatgtgctattttttgtttttcttttttaattccagtgttatcttaatttacgaatgtggtttttcacctactaataggccctagaatttttttttttgtaagagaagggaatggtaggatgcaggatgcagttttgatggtttacatttttaatcaacaggccgcagccttggggacaaaaattattgatgaagatggcctgttgaatctgattcggactatgccaggcaagaaatccaagtatgaaatagcagttgaaactgaggttcgtataaaatgaatgtgatttaagttggtgtatattaactttttaatttcatagacatatgtcttgggtggatacaggcttgttggctgaaagattaacatccctgtctaccacaaatggaccaccttagttccttttgagctggaagactctgcttcaagatgtctactttgttgtttttccttatctttgtcagggaatatgagtagagaaaggacagtatattgcatataacatatctacttatcaaactttccttattttccatattactattattactactattttttaattttttgagacagagtctagctctgtccctcaggtcggagtgcagtggtgtgatctcggatcactgcaacttctgcctcctgggttcaagcgattctcctgcctcagcctcctgagtagctggaactacagatacctgacaccacgcctgctaatttttatatttttaatagagacggagtttcaccatgttggccaggctggccttgaactcctgacctcaagtgattcacccacttcagcgtcccaaagtgctgggattataggtgtgagccactgttcccggccatattctcacgttgactttatgcaaaggttattgtttaagagttccttaaaggatattttaataggtattagcatgataaatttgttttcaattagaactgtattaggactttttaaattgtgcagacacctagcctgtatt

SEQ ID NO: 111095 - DNA, 2548 bp, Homo sapiens
caccacagtccaagccttccgtatctcatctgaaactgcagtagctttctaagtggtctccctgcattcactttccccgctctgcagtgtgttttccaaatgacaggccttaagttgggtcacaaactattctcagaattctccagtggattcccgttctataataaagactaaaattattcctattgcctagaaagtcctccaggatttggcccctacctctttcacccgaactcttctggcacgcctccgcattgtgctgcagccacattgaactccaggcacacttccgtctcggcttttccatttgtagttttaattgcccagatattcttgcctgaggtatcttcatttcaggcctccgttaaaatgttgtttatcaaagaggcattccctcactaccttatctcaaagagtacccttcatcactctttaattctttcaccctgttttactttttattcatagaacatttaacttgacagtgtatatttgtttatttgtatatctgtttcctcttctagactttaagttccatgagggcagggattttgtcttttttattcactgctgtatcttaagttcctggtacataatgagtgctcagtaaatatttgtgtactcttggtagtaactgggggatatagcgtattacaggcctggcactggtaaatgtggggatgatggttgaattttggagatagggggaaaaagttattagcatctctaagttcttggatgtttattttgtttttgagacagggtctttgttgttcagactggagtgcagtggtgcaatcacagctaactgcagcctcaacctcctgggtttatatcctcttgcctcagcctccctagtagctgggactacaggtgtgtaccaccatgcctggctaattttttgttaatttttttgaagagaaggagtttcatgatgttgcccagactggtctcgaactcctgagcgcaaatgattctcctatcttggtctccaaaagtgctgggattacaagcatgagccaccatgtctagcctcttgtatactttttataaagttggtagaagtgttttctttgtataaccgaattgatgttttataaaaaatatttggttacatttcatttaagatgaagaagatgactttatgtgtaagaaggcggcctctaaatcaaaagagaatggaagatctacaaatagtcatcttggaacatcaaacatgaaaaagaatgaagaaaacactaagaccaagaataagcctttatcaccaataaaacttacacccacatcagtacttgattattttggaactggaagtgtccaaagatctaataagaagatggtggcaagcaaaagaaaagaggtaagtgttctacatataagcaagtatgctcaggatttatacccattcactaatattaacaggagaaactaggatgtagtaaataggcaacatgttttaataattaaaataattttcctatgattatggataaaatgtattgccctcattttaaaggatgaggaagttggaatgttacatatttaattttttaattcttgaaagcgggaaaagatcatttaagccataagaaaaaatgataattattcgaatttaaattgagttctcagaatggaaactcattttactattgacctcaaccagtcaatattagcgataaatttgtttccaaatgagataataaatagattccttataaatagagcatacctatgctacacttgtgaccttctctactttggcagatattggattcatctgtttctggccatttaggaaacagacataccagataaattatggtgaaagtagtcccctgagttaaagaaagcctgccccatagtgtgtgtttgttgattctatcacttcctccatagaacaatgtaatcattctcacatattggtttgccaatgttctgggctacttgtcaagccaagacattaatctacaggattgggtttttttatttttatttttggtacttctcttgaacatatcaatagaactaagtgagacaggtctgtctataggatatttattagggattggatatggtcagggagtagccataaatttgactttctggctggtgtacattgcagctgttactgatagatacacttatctctcactggtgtatttaatcagcaacagtcaagaaaaagtgccttatttttaacttaaggtttatgctgattttgcttgattttctttgaaatatagctttcacaaaatacagatgagtctggattaaatgatgaagccatcgccaagcaattacagcttgatgaagatgcggaggtattggcattttgcttagaatcattagtaacttgatattctgactagctatttagtccagccaggttttgaattgaacctcattggaagttacatgtaaaataagttaaaatctaataaatgaaaatctaaatttctatacaagataaatgatgagaccaggggagaattatttactgaaagatttatttttagagaagattgatcaagtgctgtgagatgatttt

SEQ ID NO: 111096 - DNA, 1931 bp, Homo sapiens
aaatgacttatacttggctttcgtactgagaccagcactgttctctcctcttgtgtggggaagatgtatgtgaatggcagtggggaaattgcatcgattgcagaatcactcccttaactctgtggtcaggcagatttccttatattgcccgttttatgccttagaattgtaagaagctttgggtaatgtacctgtggccaactgcccaggcctttcccccactttttcttatttaggcattccagtggactcggtacctgtgtggtggataacatcacatttcaagccagtacttttttctcttatttatcattactcagctacctcactagaccccacgaattataaaataaggtttattttaaaaatataactgactctgtttgattctaagaggattcatttgtagtgaatcatgagatctctggtttcttgattgaagatgagcagtcttaggggttttattttatgctgatatgtatagaatgtctgatttaccacataaatgggcaaaagtgctatgtttagtttctcttccatccacttaatttaaccagtatttattgaaggcttggcacatacatgaacctttttctgtctctgaaaccaaaatgatggtttagatttttgactcaaggaaatattgaaaagaaactttatagaaaaaggctttaaacaccttgattccttttttagtttttgttgctaaataaattattttaatccccgtaactggatctcttcattaatttgctttttgtgtattctagaccaaagaaaataaaatcacagaattagaattcagagatctgtttggaaaggccagattctcagcagtatgaattccagaattagacttttttcctttttgccttttaaatagatttttatatggacccccacattttttatttctcttttgttattcttctaaataaatgaatgtatctaacacagagtgttaaagcaatcttctctcccaggcaattcctctgctgtgtgtaggataatgtgataatgctagtttgcttggttgttcgtaccacatttgaggttatgttgcctataaataaaaataaatggtgtttttacaagaagacagatatcctagagggaaaatctaagtgttcaattgttcatgattttcaaccagttctcctcaatttgacttagatctgtttatcattattttattgtaagtttctggggagaagagaacatagtttgcctttggcttcctatgaggcggaatccaatttaagcttattagaaaacaagaacaaatgttaaaaaagaacaactacaactttatttggaatgtttcatctctacacactgtgtaggattgtaaaatatttattttacatgaggatcctcacagcaacacctgttaagtcactgtctgttggaagcagctagttgtcttcttggcctgttttgtcttctttccataatatattggtatagcctttaaaatgttaagggcaaaggaactttaagacaactagttcagaagtcatagtagagaaacagtaggactgctcgttcttcaagttttctggtttcatcaaggcaagatgacagtgttttcagatatgcctgtggcttatagggtaccatatttatttataaaataaatatgaaatcccttatatttgtgagaaatatctcaatgcttaggatcatgaatttgctttttttaatgttattctcataactgtaaggagtatggggaaattggcaaatcagggggcactaaataggtattaaagcaagagagccagtccttgagaattaccctccctttttcttttcataactgtgttttactagagttactcgtaccttcctaggggcctagagagctgtttattttgtagttaacagagaaaaggagccttatttgcactttttgtttaacacaatgaaaa

SEQ ID NO: 111097 - DNA, 1322 bp, Homo sapiens
catcatgttgtatactttagatatatacaataaaatttattttaacaacaccgatttcaaagacttcctacacaaaaaaggtaaactaccttgttaattttttattattgatcccattttgaaatgctaataatttggatctattgggttagataaaatatacagttaaaattaatttcacttgtttctttctacttttaaaaatgtggctgtgagaaaatttgaaattttatatgtggcttgcattttacttctattgcatagtgctttataaacaatgaaaaacagatttaggaaaaatgtaggtttcaagtatttttgcttatattattatacagctagctttttagattattgttatacagatttttaggctttccgtttcactccatgagaaatatttttcatcatcactttgattagatctgtcttctactaggatttattgatttttaaaaactaatttaaccacattaatttcccaagttacaggaaaaggaaagaactgcttataaatatctttatagccaactattgactctagtaaaatgttcttcaaggttggtaaaaacccaaatacttgttgtactgggtaaatatatttacttttagctgtttaatgaagtgagagaccttgagtcttgtttggcgaagattgaccttttattacggtttcatcagggcctgttgtttgatcgaaaatggtgggggtttttcctgtcttgaattgtttgactggtaattttaattgtgcatataattctggaggcagttagtactcctgaagttaaaattatttgaggagtgtttaaatgggaaaaaaattggcgatgttgtgttctctaggtgacaggttaccatgtaataagagtgacttgtgactttggaaaatagtagcagaaaatattcttggggatgtgtgtaacattctctttgctaacttttagagacatatagtcttgtgtatcagacaaataggtatatattctgtatatgatagagagcttctcttagatgtttgcagggaaacctagagtgataaaggtagaaaatttccttcaagtgagtattgtatttttttgattatacttgttaaaaaatcaataatttgtacactaaaattctgtataaaagaaactaaatttagaatttttgaagatgagagatttaaattaataattttaaattacctaagtaaatgttacacacacacacacacacacacacacacacacacacacttatttgagtagcatcttattgtaaaatttctacagcttgctttttcttttttttttttttgagacggagtttcgctcttg

SEQ ID NO: 111098 - DNA, 1056 bp, Homo sapiens
tacgggatgctgtacgtgaaagggccagacccagtgcctgacacattgagtagcagtccaaaggaaaaaataaaaagaaaaacaaagtccataggtgaactttgtaggttacgtgaaacatttgttgatgaaactgttcaaaatatcaaagacaaaaagtaagtgatgtgaacatattttttggaaaatttttaccaaacagacgtttctttgttatgggcaggtggctgattgactcttaacctttttgtgctgttgctaaatatctgcccaggcacactgtgtaaacgaactcttaaattaagaggctctcctcttagctctggctacctttgtgaagttttgaatacgtgggaggggagagtaagaacagtatagtgataggtttattatgtaactgaaggtggtgtgatagggctttccagtgacaccctgaaaaacgtcaaagttagtgtgcagccagccatggccttcaactgtggatcagggctgttgttatcttgtgattttaagtaaacaaaaaggtcagacaatttaagctctgatcacagattttctttcacatgggactagttatttcagacaagcaatttttttctttctgtatccagtcatccattaagatgagcagtttttgaatgttgttttgtgaagagatgtccagctttttatctggactttttatgaacgttaggcagtatttgtgtcatttgctggtagcatatacatgtgaaagtaaacattgtcctcatgttttagctaaaaatcttggggtatgatgtacctgtctcagatggtgttcagtattatgcattattctatttttttcttagaattgagatgtagggaagaagcttgctttattattgcctgttttatcttttcatactttattgtttgaaatgataggtgaatgggaggaagataagccctttccttcatacaagagaatgagactattaaaaaaagcccacaataagattggcataataaaatcacaaatgtaagagtttcaaaaaagaaaagtgcagctttttcaaattaatatagtactgg

SEQ ID NO: 111099 - DNA, 1408 bp, Homo sapiens
tttccagaccagcctggccaacatagtaaaaccctgtctctactaaaaatacaaaaattatctgggcgtggtggcacgcgcctgtagtcccagctactcaggagtctgaggcaggagaatcgcttgaacctggaaggcagaggttgcagtgagctgagatcacgccactgcactccacaacagagcgagactccgtctcaaaaaagaaaaaaaaatagggagattatcctggattatttggatgggctcagtgtagtcacaaggaatagggaggtagaaaaagggtttagagagtgagattaactgtggaggaagattagaggatccgggagatggcaacgtgagggctttcgcttgatgttgctggctttgaagatgcaggaagggtctttgagccaagaatgctggcatccactggagactggaaaaggcaaataaaattctttcttagagtattcagaaaggaacatagccctgctggtaccttgactggcccagtgagacccatatttgccatctatctaacctccagaactggaagataataaatttagtggcttagttgttttaagccactaagtttgtggtcatttattatagctggaataggaaactaatacataggcttagcactgagtaaaagtaacctgtgagaattcacagaagacatgtgccttgaaaaagaccttgaggaattggttcaccgtgactactttaaacatgcactatattataatagttcttttcaaagttttgttttatttttctctcacatacagattcagagtcagaggagacgttgcaggtaaaaaatgccaaaaagccaccagaaaaactgccagtatcttctaaacctggtaaaatttcacggcaggatcctgttacatacatttcagaaacaggtaaggttgcattgtggtatatgagatgccgtgtgtgttatgttcttgagttttttgttggtgtctaaatgtacctccttcactttgaatggaatttctactgcctttttgctttgttgagttatatttgtcagggaaggctgggatcatcttttgcatttccagtagattaaggaccaattacagggaaattgctcttggaattttttttaagtgcttgtattgaatcatataagttgaagcttaatcttgaatcacatattaaaatagtattgggttgttttagaactacttttttaatgcaagctttttatctggcaggccaaagtcaataatctaagtgtagagtgattactcatatttgtgatttataatttagcacggatgttgaattccttgtattctctggtgacactacaaatttaagtattgggttttttaaagaagattgttttgtacttaaatttagttctgttacatctgttttaagagtaatgaaagtgcaa

SEQ ID NO: 111100 - DNA, 1995 bp, Homo sapiens
attctttgttgtggaggactgtcctgtgcattgtaggatgtttagtagcatccctgatctacctgttacatgacagtaaacctccctacccccatttgtgataagtaaaaatgtttctagacattgacaaatgccttctggggggcggggatgcaaaattccccctggttaaaacgactgagcccaaatctaacgagaaaaaaggatagccccgtctctactaaaaatacaaaaaattagccaggcattgtggcgggtttctgtggtcccagctactcagaaggctgaggcaggagaatggcgtgaacctgggaggcggagcttgcagtgagccgagatcgtgccactgcgctccagcctggatgacagagtgagactccgtctcaaaaaaaaaaaagatagttatataggcttctttatgttctaattatattgtgatgtttataggtaaatagctcccgtaaagaggatgacttcaaacaaaagcaaccaagcaagaaaaagaggatcatctatgattcaggtaataatttcttctgaggagctttaaaattttaaagttattgtatatcccttagaacagtgctttaaactatgttctaaggatgggtgcggtggctcatgcctgtaatcgcaatcgcagcactttgggaggcaaaggcaggcagatgacttgaggtcaggagttcgagaccagcctggccaacatggtgaaaccccttctctgttaaaaatacaaaaattagctgggcgtggtggcacgcgcctgcaatcccagctactcaggaggctgagatatgagaattgcttgaatcccagaggcagaggttgcagtgagccaagatcgccactgcactccaatctgggtagtgagactttgtctcaagaaaaaacaaaaaaattataaataaataaatcaactatgttctgagatacgtagctctctgagatgttaataagtcctgtgagaagagggctgtatgctcaagtaaaatttcaaacaattttattatagaacttatcagaaccaaaatatgtttgtattaaagattccttcagaaagtgatatagtatgcagcatttgtcaaacttattttgaatgtgatatatgtgtttttatttaatttaattaatttatttagagacagtcttgccctgttgcccaggttggagtgcagtggtgcgatctgggctcactgcaacctctacctcccaggttcaagcgattcttgcgctttggccacctgtagctggaaccacaggcgtgcagcaccacatctagctaatttttataattttagtagagatgaaattttataattttagtagagatggggtttcaccacgtagacaaggctggtctcaaactcctggcctcaaacaattcgccttcctcggcctctcaaagtcttgggattacaggcatgagcctctggccctattattttttaaaatacttgtattaatttcttttccagttgaggttgttggaagttaaatttgaaaaatagtgccttagaatactgtttttaaagcaaagatctaaaatttaatttttgtgctttattgaaagatctggcttttttgggttgcatttaaaaaggaataaacacaatttaaaggcttttctttgaacataattttaaaatagggaacatgaatttttttgcatgccttttatgatgcacaaaatgatggtaaaatggtagaattcagaaagtttcagtttttgcttttgtggacaagatctgctgtattaattctctctttctgttttatttttatctggtgtgaatttttttttttttttgagacggaattttgctctgtcacccaggctggagtgcaatggcatgatcttgggtcagtgtaacctctgtctcctgggttcaagcgattctcctgcctcagcctcccaggtagctgggattacaggtgcccaccaccatgcccagctaatttttgtagcttttagtagaaaaggggtttcaccat

SEQ ID NO: 111101 - DNA, 1106 bp, Homo sapiens
acatgctagaaaatatctagcctctccccagttccaaagtcacttctgtattttaggttttgttttgtttttgtttgtttgtttgttttatagtagtatcccatttcttggtaccaaaatctgtattatacagtcagagttctgtagagaaacagaaccaataggatgtatgtgtgtatacatagagagatttattaccaagaattggtagagctgatgttttagttggagtccaacggcaggaagaaagtgtcccagagatatcccagctctaaggcagtcgggcaggaggaattccctctcattcagcagagggttggcctttgttctttccaggctttcagctgattagatgaggcttaatgccattagggagggcagtctgctttacttagtcaattgatttaaatattaagctcattcaaaaacacccttgtagaaacacctaatatgatgtttgaccaaatatctggacatcttgtggttcagtcaggttcacatatgaaattagcctccacaggtcacatttcctctttgcatgttctagttattttggatttatcttggacattgtgaacgatacagtgtaggaactttggatcctgttattccttcaaagagtgttcttttggtttatcaggcattgatcttggctgtactcaagctccaaactcttgtctcccctgtaatgggcagcagctgaaatctttattcaattcttttaaccttagctaagctataggagttgttccacatatgtataattcaggagatagccagagatttgggtaaagtttacaggcagaatttgggatttctttctgtggctttctcctttacttgataccttcttctcttacttttgaggtgtggttgattctgactctgtccttgatccagtggtatatataaattataattgctcatttgttccattttcttgcaagctagttgattgttcttatgtttttgaagttttattataatggatagaaatagtttctatttctaccttataattgattacaatcagttttttcactgccttcttgatgctttctgagaaaatttgaatatgttagaaatgtgatgtttaactacaaaat

SEQ ID NO: 111102 - DNA, 1281 bp, Homo sapiens
tgattcttcttttatcaccaatttactgttaaggctatctagtgaatttttattttacatattgtattttttaattctagaattttcatttgtttcttttttgtagctttaatttctgtcttttatgtccttgagtgtaattatagtagctgctttagtttttattttgagatggagttttgctctcattgcccaggttggagtgcaatggcacgatctcggctcaccgcaacctctgcctcctgggttcaagcaattctcctgcctcagcctcccaagtagctgggattttaggcatgagcccccatgcccggctaattttgtatttttagtagagttggggtttctccatattggccaggctggtctcaaactcccgatctcaggtgatctacctgcctcggcctcctgaagtgctgggattacaggtgtgagccaccgtgcccggcctagtagctgctttaaaattcttatctgctaattctgacatctgtgttgtatcaaaattggtcttcattaaatgccttttgtcctgattctttgggtcatgtgttagttcaggccaccatgacaaaatactacaaaatagatggtactggctgattaggtgtctggtgagggcctttttcctgctttgtacatggctgccttctcgtgttgtcctcacatagcctcttcttagtgcatatgggtggagagagagattgagcactggtggagaaagagagatagagattgaatgagcactctggtgtctgttcttatagaatgctaatcctgtcagatcagagccccacccttacgaccttatttatccttaattacttgtttagaggttccaactccaaatatagccaccctgagggttagggcttcaacgtgtgaattttggggacacagacattcaggatataacattccatccatggccacccagaatttatgtccttcttgcatgcaaaatacattcattccatcataacagcccccaaagtcttaactcatttcagcatcaagtctgaagtccacagtctcatgtcaatatcatccaaatcagatatgggtgatacttgaggtatgaatcatcctgagggaaaattttcttttgctgtgaacctgtgaaaccagataaggaatgtgcttctaaaatatgatagtagaacagacatataggatagacattaccattccaaagaggagaaatcagaagggagggaggggtgatggatcccaaacaagtccaaaacctagcaaggcaaattcaatcagaacataagcctt

SEQ ID NO: 111103 - DNA, 1053 bp, Homo sapiens
aacctctgcctcctgggttcaagcaattctcctgcctcagactcccaagtagctggaattacaggcacctgccaccatgcccagctaattttttgtatttttagtagaaacggggtttcaccatgttggccaggctggtctcgaactcctgacctcaagtgatccacccacctcggcctcccaaagtggagggattacaggcgtgagccaccgcgcctggccgacaaattattcttaactcaggtaaagttatcagttaacttttgcacatgaaaagaaagctactatattcgtggaactatcttggtatggaaaaattactcagggtaacccagtgtgtacataaagctgtcccatcttacaattgaagttataattttatgcggttaatgtttattcgtgaatctcctgttttttgcttttaggacattcggaaattctttggagtaataccaagtggaaagaaacttgtaagtgaaacagtaaagaagaatgagaaaacaaagtctgatgaagaaactttaaaagcaaagaaaggaataaaggaaatcaaggttagttttctgggtataattttgcattgaatgaaatgtaaaataaactcagttcttataagttttttttttttttttttttttttttttttttcctgagacagagtcttgctctgtcgcccaggctgtagtgcagtggtgcaatctcggcagactgcaagctccgcctcctgggttcatgccattctcctgcctcagtctcccgagtagctgggactacaggcgcccgccaccacacccagctaattttttctattttttagtagagacggggtttcaccgtgttagccaggatggtctcgatctcctgacctcgtgatctgcccgccttggcctcccaaagtgctgagattacaggcgtgagccaccgtgccagccattcactccattctttatgccctagttgtcatatatattacacctacatatgttaatactgcacaattcaatgtaattttactttaaatagatgtgtattttttaaaaaaattaaggcaaa

SEQ ID NO: 111104 - DNA, 1035 bp, Homo sapiens
cacatttccctttcagtttttaagcacttccttattttctggcacaagatgcccaccttcatctcattcttctcctggaaaaagccatttctccaaggagtacaaggtccttttggtggggaataggattttagaaacaagctctgggagctggggttgggattgggatgcatcatctttaactagaaaattaacctcttagcagactaatcatacacacttgctgagattaatgctttctgaaggtttttaacgtaagacatttttatttgatcttgccttgccccatagcaagactgccttttataaacatcctttcaataccatgatgttctgagttttcaaaacattaaaactggccatctaggctaggaggattttactcaaataatgaattatatacggatttaacttcatgctcacatgatcaatgttctcttagtttaatgttctagataactggttggcagatggcaaacgggcagtgatatggttttgtaattaaactatgaaagatgacacacgaaaaaacaattagagggaagatatttaccaaaggttaattatagttttttcctggtgtatttaaattctgtcatgaggggaaaaagaagtactttaaaacaagtacttaacttttactttcccttattaatcttgaatttgggaatgtttttcttaagggctttgttttagtttggactcaagggcctagcaggcaattattgccactagggaaaatgaaacccaagtcatgactacattgtgtttgtatagcgctttagagttcccagagcaccttcccagagtcactgagtcctcacagcacacctgtgaggtgggtgcgattactccgtcactatatagttgccaagcctgagtttcaaaggggcagaactagaacaggagtccagggctctctccttcgtggagagacacagaatgagactctgtcagatccaagtgtcaaccttgggagtttctagggatagtctactgtcctttccacccataacccatttattcatctgttgg

SEQ ID NO: 111105 - DNA, 1032 bp, Homo sapiens
gtgtaccaagccaatttcctgatgcatttgaacagaatcacttcaaaccccaccatatataacctagggtttaaagttaaatgaactggaaaatggcttcccaatgttttctcaaacaacttgttttccaagccaggacctgggtgtggctccttctctgttttctggtctccttgggagatttcaagggctggaataggcctggcgtggtggcctgtaatcccagcactttgggaggcagaggtaggcagatcacttgagcctccatctgccagcgcatgcttgacctaaatgagcttgtttttcacagcccgagtctgtggcttcgtccccacagttcagcgatcctcatctgtacgtgtggaacgccactggcaacagactgttgcaccgagtggaaggggtgaggctgaaaacacgacccgctcaatgcacagattttgtaaacatcaaaaaacaacttgagatgttggcaagaatgaaagtcacccactaccggtttgctctggattgggcctcggtccttcccactggcaacctgtccgcggtgaaccgacaggccctgaggtactacaggtgcgtggtcagtgaggggctgaagcttggcatctccgcgatggtcaccctgtattatccgacccacgcccacctaggcctccccgagcctctgttgcatgccgacgggtggctgaacccatcgacggccgaggccttccaggcctacgctgggctgtgcttccaggagctgggggacctggtgaagctctggatcaccatcaacgagcctaaccggctaagtgacatctacaaccgctctggcaacgacacctacggggcggcgcacaacctgctggtggcccacgccctggcctggcgcctctacgaccggcagttcaggccctcacagcgcggggccgtgtcgctgtcgctgcacgcggactgggcggaacccgccaacccctatgctgactcgcactggagggcggccgagcgcttcctgcagttcgagatcgcctggttcgccgagccgct

SEQ ID NO: 111106 - DNA, 1114 bp, Homo sapiens
ctggccccagctaatttttaagttttttgtagaggcagggtcttgctatgttgtccaggctggtcttgaacttgcaggctcaagcagttcttcccccttggcctcttaaaacatacctggctcggcctcttgatgcattttgattccattggggtggggaggggtgggaagaagggagattcttagtatcaaaataatggctgtccagaaatactctgatactagctatggtcagcaacatttaatgaaaacccttatgttaaaaataaacccctgcctcctggcttcaagcgattctcctgcctcagcctcctgagtagctgggagtataggcacgtaccaccacacccagctaattttttgtatttttactagagatgggtttcacagtgttagccaggatggtttcgatctcctgacctcatgatccgcccgcctcggcctcccaaagtgctgagattacaggcgtgagccactgtgcccggcctcaaaatcttaagaaaaggttcttttggtgcatggagttttacatggaataaattagtgcctctgcaatttaaatattttttacacagatttgatgctgtgcaaatgccctctccccttttaggtgttgcttgttcagtatctcaagcccagaaagatgaattaatccttgaaggaaatgacattgagcttgtttcaaattcaggtttgtatgtttactatgtctaactatgcctacaagattttgtctaaatcttgtttaaaatacagtattttgctaatttttatttgattagctttttaaattgtgaaaataaaaaggtcacattctgaaattttaagtacagcacataatgaaatactttctttttaagatgggttaggctgatgtattaattgctttatcttcactcctatagcggctttgattcagcaagccacaacagttaaaaacaaggatatcaggaaatttttggatggtatctatgtctctgaaaaaggaactgttcagcaggctgatgaataagatctaagaggtaagttcttacagtgtcttaagttttattactgctctagttgaatgaagctcttaatttactaaaagacttaaactgaatttgtagtaata

SEQ ID NO: 111107 - DNA, 2573 bp, Homo sapiens
caagtacgtaatgacgacagacgttctttctttgctgcgtctactgcgaggtaaggatgtttctgtgctcgtgggggtactgggaatctgaaaccatctgctctgggaaaggctgcggcgcggctcccactctcggaaccttgtcctgtttgtcccccagctcggcaagcgccatatgagcctggcggcgccagatgcgaatcctgttgtgggctttttggcctattcccgcccctcagtcttgccgggatggcaccgcccgcataggacttccagggttgggctgagtgggagttcgactgctgggcctcgtaattctcgctttggggctgctccttccaggctgggacacactggggcccgctgtcggtctcccgtcctccgacatcttgtctggaacttccgcctggcagtctccagtaggagtggagctctgtgcggcgtagtttggtggaaaaacgggccttgcgtcggcctcacccccagtgtttgtgtttcagaatgaagactattctcagcaatcagactgtcgacattccagaaaatggtatgagacttgatgtcttttacttacatctttactgcacgttccaagcgttgtgtggcctgacgagtgtgttctctcttctagtcgacattactctgaagggacgcacagttatcgtgaagggccccagaggaaccctgcggagggacttcaatcacatcaatgtagaactcagccttcttggaaagaaaaaaaagagggtgagggtttttcttctgataattcagttgctcgttggaaggtggtttataacagcatcacatttggttgctttaacaattttcgaattaaggttcagtgcttcagctttaaatgttgctgtccagaataccagcctgttcagtgaaattgaaaaaccagattctgaacacagccaattatataaagctcaaatgtaatagtggtcatcagtgacacgtcttaatggtgttagaagtttggtttattttcctagtgattgctttgtaaaaatcacaggaaccggcagtaggtcatttaaacctgatgatttaattttccagaagggaagtttgttgcaacttctacaaagcttaactgttgggaggttttataggtggttggatttttccagttgaaaaccatgtgctttgataagggttaattctagaatcttaaagtaattcggtaagtggtctgttgtcttttaagcctgcatatttctggaaagaatacattttttgttctgttacagctccgggttgacaaatggtggggtaacagaaaggaactggctaccgttcggactatttgtagtcatgtacagaacatgatcaagggtgttacactggtaagcagatgtatcagacttccttgttttggaaagggaggtttctcaaacctgtgctttatacagcgtaagtgtctctttcagagaatgggtcatgtattttatttggtgtaatacgcaagaacttggcaaaaataggcatctgtgggtctttaagcgatagagctgagagcaaagaccagatgggtacaacatgtttgtttttttctgttgttgggttttttttttttttaatcaaggctggggtctcgctattttgtccaggctgagctcaagtgatcctcccaccttggcctcccatagtactgggattgcaggcatgagccaccatgcatggctagatgggtacaacttttaaaaagtaggctaatgatgaattttcataccttccgaattctttaagataggaaatctacagttgcagtactagttggtagtcacatctcaccatcaggaccccttgttgggatagaaaaagatgtagtttctgagttttctgtctgctgccataatgtatgtcattattctttccaacccaccgtctctcccctcaagataaaaagttcatgctgaaatggttttctttgcattataccttctagaatgcacctgataatggcaccctgtacatctattataaatctgttaagattcccccatctacccttgctcttagccttaagttccttgaaggcagggggcctgcctttggcttggtggtctcaattcctgccatgtgctgtaccttagtaactcagtaaatgttagtctaatgtctaagatcagggctttggggttctcattaaaagaaggcagcattgttcattgagggcataagagctagtgaaataaagcctccgcaaggagctttacagtccactgaatagacagaacaatgtttataaggcttggttcaggtgacagttattagaaaatcttggcagtgagtgttacgttttaaaataagtataagcatcttagaaaattttaaaactattaaaaatattcctcagcattgctaatagcttgcttatttatttaacatagggcttccgttacaagatgaggtctgtgtatgctcacttccccatcaacgttgttatccaggagaatgggtctcttgttgaaatccgaaatttcttgggtgaaaaatatatccgcagggttcggatgagaccaggtatgtgcataccctcagacagaattaagaaatttttc

SEQ ID NO: 111108 - DNA, 1014 bp, Homo sapiens
cccagcagtcgaactcccactcagcccaaccctggaagtcctatgcgggcggtgccatcccggcaagactgaggggcgggaataggccaaaaagcccacaacaggattcgcatctggcgccgccaggctcatatggcgcttgccgagctgggggacaaacaggacaaggttccgagagtgggagccgcgccgcagcctttcccagagcagatggtttcagattcccagtacccccacgagcacagaaacatccttacctcgcagtagacgcagcaaagaaagaacgtctgtcgtcattacgtacttgtatcgcgtaaggggcctgcgtattgcgtcatgagtgcgcgacgcacgtaaggctaaagcagccaatcgtggagcagcttggctgcttgtcataaatggagcgacgtaatttcgacctgtcctttcccgggagttagcgatccctcaacccctgcactgcgctagtcctaaagaggaaatgtctctacgctgcggggatgcagcccgcaccctggggccccgggtgagcggcggggcgaacgggtttgggcgtggggtggggggatcctatcccttcagagcgcccatgcccaataataaaggccagtgcatttactgaacatttactactagccaacggcagttttaaacgtttttcgtgtaatctcatgtaattatcccgccagccccatgatatagagtctctggcatcagtttgtttgcaagtctctctgggccagcaccgaggacttattttctgcttagagtggtttgtaccctatatttatggagcactgcagtgagcaccccacatagctattctgtcttggactcttactgtgtgtgagacaccactctagccgcagagaacacaaacctgtccgctaggcttcagcggcagacattgagaagtgcagtagcaatcgtgcaacaccctaacaggcactctttgagttgtcgaaggttcttttgagatacatgtgcagactcgtggattttgtagtgttt

SEQ ID NO: 111109 - DNA, 1030 bp, Homo sapiens
ccaggctcaagtgatcctctctcctcagccttctgagtagctgggagtataggtgcacattaccacgcctgactaactttgattttttgtagaggcaggatttcactatgttgcccagactggttccagactcctgggctcaagcaatcctcctgcctcagcttcccaaagtgctggaattacaggcatgagccagcgcacttggtcttaacagcatttttgaatagtgaatgtcttcaaaaatatgttgtaaacaatgagaagtttaaaatgtctaatcacagtcaccaactgtttagttggtggatattgtcaacctaatggtgttccatttccttttgcatacaggtatgtgaggaagctcgatgtcccaatattggagagtgttggggaggtggagaatatgccaccgccacagccacgatcatggtagggccagcctcaacctctatggctttagtctagaaactgaaagggactattttgtgtcttcctcctaaaaatgtgcattatgaatctctggtcagatttttcattacatttgcatttatgaaaaatattaagaaaaaacctgatggaataatccaacctgttgtaatctcacccttctctgaataaatctattattggttctttcatttatgtgatagttaatcacgtgctgccttgagatacctctcctatcaatgtttggaaacattattcatgattgcttagctttttatgtgttttctgtttaacatattcaacaagaaggagctgtgctttctgtttttacatccatagagacctgtacattgatctgtcatatattttatgtcttttaaaatcatctttttttattattgaatagatataaaagtatcttcataggccgggtgcagtggctcatgcctgtaagctcagcattttgggaggccaaggcaggcagatcatttgaacccaggagttcaagaccagctgggcaacatggtaaaaccttgtccatacaaaaaaaaagtttttaaaaattagctgggcatggtggcac

SEQ ID NO: 111110 - DNA, 1050 bp, Homo sapiens
ctttccagtgaaaattccagaatcatgcatttctttacctaatatgtggcagtgttgtatacttaccagcagagggcagcttagtcttcagaaaagaaatgaacttgaaagtttcaaccctctgacatgtgggttcagcttatttttttctttgttcagtatggagactctcttacttctgctttttttcctttctcttctaatttttcgcttcagaattctggtttctcaatgcataaactgaagtaatttcttccattctacttttctctgccccaggcttgagatagaactagggagcccagtgaggccttttctttcctaaattaacaggcatctgtgcataaatgctacctttgaactatgtgatttaagataatgtgcagaatgtacttctctggtctttcaggttgcttgcataactatgtacttggttgaacttgtaattcttgctgacaacagtcctgctgttttccagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaaggtaaagaaattgaaaaatgaaaaatctttcccatgtaatttgagtaatagcaggaacccactcactttgaaggcccttctaagaacaaagaaaagtatatggttatagatggcagcatgaaaaggaaaccaacttgcacatgcaccctcaaatctaaaatacaagttaaaaaaaaaaaagcaaaggaaataaattttcttggaatttcatggagtgatatgcatgacgctcaggatacaaaatttatatcccattttattccccatcctttgcatccactgaaagcatgatttcatccacttttctcattctatcattggacacttttggagagccagcctggtaccaggcactgacagttcatagatcaatgagactaatccaggcctctgagaaagagcttacttgtagcattgtcacataaca

SEQ ID NO: 111111 - DNA, 1522 bp, Homo sapiens
tggacaacatgatgaaaccctgtctctactaaaaatataaaaaaagtggtggggtgtggtggcgcatgcctgtagtcccagttacttgggaggctgaggcaggagaatcgcttgaacctgggaggcagaggttgcagtgagccgagattacactactgcactctagcctgggcaaagaacaagactccatctcaaaaaaaaaaaaaagactttaaaacttatttttaaggactataataatatattatgtacaataaagaaagggaataagaaaaggcttacatttcatttcagattgtgaagtcctttaggataaccgtctcattcatttatgtatcttcagggcttagctggaatctgcctgccctagttatccggcatatagatagtagcttcctaacaaaaatttattgaatgagttctctagatgcttcaagctatttcttctgattattatatttataaaatgtattatttctatggaactaacagaggattaaatcagggctactgatgattgttaactccacactttaaccagtagttcagggtatatcttgaaatccctatctcacaggcactctgttctttatcccatatacttacatcaggtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtataaaaaatgaagcattagaatctggttattcttatgtaaatactgatgtgttaaagttgcccataattaattctagcttaaaactttcctttgcattgggattctaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggttagtatatagcattcaactcttcattaaattaaagccaaatatttatttatttcaagcctgataaactacacagatacttttttaatagtagtaagaggttatgcttttgaagatcatattcttgcacattcaaattatgaaataattttcacaagggagatcatatatgagggtataaaagattctgaaaaattctgaaatcttaaaatagtaatttggtttttatcactctttccctctttaccctttttcttaatcatctgtcctctctaatttaaaacattttccctttctaacccatccattgtctcctcaaattgagctcatcagtatcttatatatctccctcagtaatttgcgtcaacgcaatgaaatataaactagatgtataaaattgct

SEQ ID NO: 111112 - DNA, 1052 bp, Homo sapiens
cctataatcccagcactttgggaagctgagatgggaggattgtttgagcccaggaatgtgagaccagcctggacaacccagtgaaaccccaaaaccccatctctgccaaaaaaagatacaaaaattagccaggcctcatggctcctgtggtcctagctacttgggaggctgagatgggaggatcatttgagcccaggaggcggaggctgcagtgagctgagattgcaccactgcactccagcctgggtgacagagtgagaccctgtccctatttaaaaaatgagatgtgcacttatggcctttggtatatgatccttaacttgtctacaaaggtaatttgagcacaacctagacctttaaattacaatattaccatgccctttaacaaatgtaattctatactattaggttatctcatatcactggcaagctatatgtacaattccttttcttttttctttttagccaggactaaaagaagtggtagaatcctgtcgaggaaaaaatctttttttttctaccaatattgatgatgccatcaaagaagctgatcttgtatttatttctgtaagtattttcctttgttgtgtgaattttaatgtattcttgtctatataaaagtttcatcatactttaatagtaaatccattggtattaagcctcaacattgcttagtatagagttgtccggtgaattttggttgtcactttgtctgacagttcacaaaaccccgtaatcatctagtcaaatatgtcattacaagtcattgaacaagtaaactcaaagttctaatttgagatttagaactaggaaatgggcgggtgcggtggctcacgcctgtaatcccagcattgtgggaggccaaggtgggcagatcacaaggtcaagagattgagaccatcctggccaacatggtgaaaccccgtctctactaagaatacaaaaattagctgggcgtggtggtgtgcacccgcagtcccagctactcaagaggctgaggcaggagaatcgcttgaaccaaggaggcagaggttgcagtgagccgagatcgc

SEQ ID NO: 111113 - DNA, 1145 bp, Homo sapiens
ataatttatttttaaaatgagtgcctcttgggaagcttcttttctgttctaacagttccctgttaaaatgaaaatcttaggccagtgcagtggctcacacctgtaatcccagcactttgggaggctgaggtgggtggatcacttgaggtcaggagttcgagaccagcctggccaacatggtgaaaccctgtctctactaaaaatacagaaaaattagccagggttggtgcatgtgcctgtaatcccagctactcaggaggccaaagcaggagaattgcttgaacccgggaggtggaggttgcagtgaaccaagatcgcaccactgcattccagcctaagcaatagagcgagactccctctcaaaaaaaaaaaaagaagaaaatcttaaagctgtattagggcctgttaggttactgatatttgaatgcctatttacttatttactacattgagtcttttgttatcctctgacctataaaatattttaataaattactggtttacttcaagggaaaagaaggaaaatgagaaacatacatctttttttcactccttatctcattcctgtttggtgatgggatggattggggtaggaaggaatgttaatatgagagaaattttaaaatgtataaaaaagtaaaaggttgtattgttttgctcagtttgaaataaagtgaataccaatagcacttaaaaatgtctgcatgggctgggcacggtggctcacgcctgtaatcccagcactttgggaggccgaggcaggcgaatcacctgaggtcaggagttcgagaccagcctgaccaacatggtgaaaccttatctctactaaaaatgcaaaaattagccaggcatggtggtgtgtgcctataatcccagctactggggaagctgaggcaggaaattgcttgaacctgggagacggaggttgcagtaagctgagatcgtgccactgcactccaatcagggcgacagagcgagactctgtctcaaaataaataaataaataaaaatgtctgcatgacccatatggttatgaagtttttttcctagcaaatgattgcagattatttatgggggctagaagatattttgctatcaatgtaaggatttttttccccttaggtcagtctattcactgtttagat

SEQ ID NO: 111114 - DNA, 1050 bp, Homo sapiens
acatcactgttgtacaaattccctctctcttccattctacagggaaaaatgagacaaatggtggaaaatcacagtgttatttaatctagtgttccctcatgtaaaaacatatgaaaagtccaaataagcatatatttgggatgggatggttgggggcattgctgctcagttgtttctctatgtgttagattggttgcactgggatttaataagtcaatttttaaaaaagtaataaattttaaatttttttgaatttttaaaaagtcaattaaataatttatttctttctaatgccagggacaagatccaccagctcctcctgtggactaactttgtgatatgggaagtgaaaatagttaacaccttgcacgaccaaacgaacgaagatgaccagagtactcttaaccccattagaactgtttttccttttgtatctgcaatatgggatggtattgttttcatgagcttctagaaatttcacttgcaagtttatttttgcttcctgtgttactgccattcctatttacagtatatttgagtgaatgattatatttttaaaaagttacatggggcttttttggttgtcctaaacttacaaacattccactcattctgtttgtaactgtgattataatttttgtgataatttctggcctgattgaaggaaatttgagaggtctgcatttatatattttaaatagatttgataggtttttaaattgctttttttcataaggtatttataaagttatttggggttgtctgggattgtgtgaaagaaaattagaaccacgctgtatttacatttaccttggtagtttatttgtggatggcagttttctgtagttttggggactgtggtagctcttggattgttttgcaaattacagctgaaatctgtgtcatggattaaactggcttatgtggctagaataggaagagagaaaaaatgaaatggttgtttactaattttatactcccattaaaaatctctaatgttaagaaaaccttaaataaacatgattgatcaatatggcagatgatttacag

SEQ ID NO: 111115 - DNA, 1050 bp, Homo sapiens
caattcaagtgattcttaattgagtgggcgagaactgctgtatctccaaagttgtaatagtgccacttgtgaagttgtgatttgttgaatataaataaatgaagacttggtatactctaatccagtggtccccaaccttttttgcaccagggaccattttcatagaagacagttttttcagtgggctggggcaggggtggggggcgtggggagaatggttttgggatgaagctattctacctcagatcatcagacattattttttcataaggatcgtgcagcctagatccctcgcatgcagtcgctccagtgagaatctaatgccaccgctgatctgatagaaggcagagctcaggtggtaatgctcaggtggtaatgcttgctggcccgcacctcacctccttctgctgtgctgccaggttcctaacaggccacagaccagtaccagtccatggcctggaggctggggacccctgcactaatctatacctgatctatacagtggcctctggccatgctgacgtagttgcttctgtatattcctgttgtattctgtggaaaataaacttctgttgtcctttcttgcctgctgtagtctcttccttttgaatagtatgccctctgaaaagggtgtctttaagctttcactttcttgtaaaattataagaatttcagggattggctgggtgcagtggctcacgcctgtcatcccagcactttgggagactgatcaccagaggtcaggagtttgagaccagcctgaccaacatggtgaaaccccgtctctactaaaagtacaaaaattagttggatgtggtggcgcgtgcctgtagtgccaattactcgagagattaaggcagagaatcactggaacccgggaggtggaggttgcagtgagtctagattgcgccactgcactccagcctgggcaacagagcaagactccgtctcaaaaaagaaaaaaaaaattgtaatgatgagtttcagggagttttaatcctgcgtgagtttagatcacagagaattgtgacatcaagggcatgtaatggg

SEQ ID NO: 111116 - DNA, 3243 bp, Homo sapiens
gatatccccggtagtccctgggtggtcctccttgcggccgcccttctgcctgtgaggaagcagcagtgttcccctcctccttccgccgccttcccctcccctcccagagcgctaggatggacggtctcgcgggcgggtggtctggggtggaacatggtttggggaggtgatggacagggggcaactcctcggagggatggaagctcacaagagaacccgaggcggtggccgcagctggaaatgtggctgtggggtggggagggagcaggccgagcctgagaaaacccgggaagtgggttgggggaaggggaaaggtggtaactggatcccaagagcagtgctgctcgaaggcccacacttttgagggtattcggggttattgcctgtcaggccttcactgttcttttcttggggaaggagcagtgagtccttaggtattgattaaaaaggaaggacattcagagttagtccttcttagttgggtgttaggagtcaaagggagacataatagaatactgtcttatttggtggcaggggtaagggaattttcacctgagttagcaagttaattccaaataagataattatctcttttccacttaacccccaaattcctaggcctcatctttattgacatctcaatcttttgagtgggcaaaggcaaggtgtttggtgtattaaagacatgtaaatatttttagttaggaaacaaataatggaatgtatgagtagcttatttcaaaatattgtttacaagttacagatcagagagactgtcttaagacagtgcctctgtgactcgtgttgtgccacgaaacttcattatgatgtccctcatagttaacttgattcttacttttgaaaagcagacctattaaaaatgtgaaatttcaccagattaatacattgtttcatctccttattgagatttatcacgacttaacagattttcaaaaaagttgcctcccgttgctcttaagtcctgcagaatttagatacatttgtactacgtttatttatgtaagatattcacagtgctctagtaatttgactcaaaattatgcaagtattagtacagtttctcataccaagatcaacaagaatgccagattgtcttccccacatgaattaaacaaaaagtaatacagaaaatgattattttcaagattcacataccattattgaatatatcattgctatttgtgtttttcttttacagttagtactttaatagtgtcaataataatttgtgaaattcagcattctaagtatgtgatgagtatacatggagaaaaaattatttaaaattcaaaaatgacaacagacttattgaaagtagtatataagtcatggtcggttttacagagcatgtgtatgaactctgacctctatgtttgttcatatgccaaaactctgaatggaaggatgactttgtattttgtggtacaatgcagaaatagagtcataagtgtctgtactgatacaatgaaacagcaattttaacttatttaatatgaaaatgtattccaggttagttgacatatatactcctaatgaaagcagttgttgttgccaacaactgaaaacatttcttgtttaataaggttgtacaagcctgaaacttaatagacttttaatgctttattttctgttacttacggtaacagaaacagtaagttactgctctggtaattaatgtggtctctttgctttttatgagctgacttttcaccgtggtattcttagtactaagttgaagattaccagaaatacttgtattgctctctagtaatgcatattaaaaaaacactgctctttatacgtaagggatgttgaagccttacttcagataagcatcaaaagtgtttcagaagaagaaaacaggaaatgcaaacagacaggttttttgttgtttttgttgtttgtttgttttgttttgttttgtttagaacagtacctgtataaatatggaaggaaacttctgggaaaataagttggaaagaacatttaggaaagggtcacatcatttaatcttggaataaatataaccaataaatagcttattttcaccagtattttttgatattttagtagccccagttctataagtgtattgttattttcaactcattgaagacttgtagtatagtccatgtgtttcctttttaagggtgtaaatacagtcttttgaatggctgatcaaataaatgtttcatcatgtcacttttttggtaaatcagcactttaccgaagtttatttcatgtgtttgtatgcttgtgtttactaagaacactggttgatttaaggactttttggggtggccttataagagcctttgtaaagatagctgacgcttactggattctggttatgagagattataagtggccgttcttagagtgtgttaaaatacagccaacaagataaatgtgaaaaagcaaggtgcagaatagtgtggaagaggccatttgtgtcaaaaagaagggcatgtgtgtatttgcctgtatgggtaaaaggtttcatgagaaattggtaaaattgattgctttctgtgtagagagttgggtgtctggggtatagatattttttgaattttgtgtcatacaaatgtgatttacttaaaggcatcatttggcctctttcccttaagacagtgtttggaaatttgtcagatgtttctttttattaattaatatttattttctttgttttagatgtttgtttttaaatatgagtgtgaattttaagtagttttaaataatattccaaagttgttaggcatggaatattgatgtaaagtacattttataattagttattttatgagtaggattacataagtaaattattaattgtgaggatataaacccataatcaatgttttattcataagttttattatttactattagttattgctgctgttaataactagctgccatttgtagaatggctagttgttcttagtatcatttgtttttacgttattgctaattcttaagcacagttctttagatgtcctatttcctagatgagaaaatagagatttagagaagttaaattatttgtctgcaatcacagagcctgggatttggatctaggtctgcttgtgttcatattgtcccacgctgtcatgacttgctaaggataggcatgcttttaattaatttaaaaaatcgagcctggtttgtattactggttaaaggatttaaacacagtttaatttgctagtttaaactcat

SEQ ID NO: 111117 - DNA, 1063 bp, Homo sapiens
agttaagactgacctcaaatttcaggagacagtcccaaaggaattctggtaatattgcaattttttttttctgagacagttttgctcttgttgcccaggctggagtgcagtggcacaatctcagctcattgcaacctctgcctcccgggttcaagcgattctcctgcctcagtctcccgagaagctgggattacaggcatgcaccaccacgctcagctaattttgtatttttagtagagaccgggtttctccatggtggtcagtcaggctggtctcgaactccgggactcaggtgatctgccagccttggcctcccgaagtgctgggattgcaggcgtgagccaccgcgcctggccgagattcttaagtaaatgaacttttctttaggcacatgaattggaactatggaacaaagagattattgatacaattattcaagaagcacatttgcatatttagaacagaaaggttgcacagctcttacatactcaaacatagttttagagttagatcatgatcttaactttcttcatggttaccttttggggaggaaaaccaccctttttcatattaaagtaaaatgtgtacgtaataaagtgtgactggcatccaaatcaagaaacagacccttcccagtaccatgggaatctgcctgcctttctagttactttcctgacttctaataaccgattagttttgagtatgtttgagtaaaagaatagatgtgagtatatattatgtattttaagtttgaaagttttcaaaagatgcttttcaaaatctttcttaagaaaaatatagtgtcttagaaaatgtgccaaaatgtattgaatttcagagctgaaacagatctaggccaaacttctcatctataaaatcaggaaattgaggcccaaggaggttgattgtttctcagagaaacagagctggttaatggtgaacccaggctttttgcataccagtttagtcataataagtagttggtttttgggaatatccttttcataaatgatagtataaaagctgactgctaatacaactttacagaaggggataacaatgc

SEQ ID NO: 111118 - DNA, 2454 bp, Homo sapiens
ccgcatcctccgcagctgctggcctgggtgctaagcccctcactgcccagggccagcagggccagtcggccgctcagagtgctgagcccgccaagcccacgcccacctggaaatctagctggcctgcaaacgccgtgcgcagccccggttcccacccgtgcctctcccttcacacctccctgcaggctgagggagctggctccggcctcggccatcccaggaaggggctcccacagtgcagcggtgggctgaagggctcctcaagtgtggccagaatgggcactgaggccgaggaggcaccaagagtgagcaagggctgtgagggctgccagcacgctgtcacctctcattctgacctacctttcctgacctatttcctgttaagtcacagatacacacttgcattcctacacatacctcagactttcagtctccctcaaaccttcagcaatacaaaattgcttgctatttagttgtttcatctgtctggaataagcccttatcttttttctttacctttcgaaacctacttgtcctaaaataccacccctggtaagcctttcttgaagccaaagtttccttctgtttttcattgtcagacttcatgagagcagttatcttactattgataattgtacatatgtccttctactcctggtagattaaactccttgagggctcatattcatttttttctctttagcaccttgtagggttccttgaatgtagaagccttagtaatttaaagcacaccaaaaaagtctttgataggtatctaattttgaggagctgctgctaaaagtgctcttaggacataggtttagggcaggcttccgttacttttagcaaatgtgtgattatggatttttctagtgattagaaatgtaggaccagctagtctatgtactcttttctctcagttaactatgggtgtcttgcttttaggtttctttgtttcaagtgaagcatcttacttggttttgtcatacccaattttgggttgtctgatgctgttgcttctcagcgagctgataataaaacattttatgctttttcttaaatcactgtagtgacttagtttttgttgtatagaatatagcacagtttttgcctcctattagacattcagttatttccagtttcttgatagtgtacatgtgtgagaattttgagtgtatatctctgaaagtgatacatactgagtggtcattgagtgttggatgaaattttaggtgtttatattgttaggtgctttctttccatctgcccataggcactgtgaatgtgagtcattgaaagcagagttctttctcactgatcttccattccccattgcttagcaccattgcctgctaagcaggagatacttgttttcctgaatgagtttaaggatattcctaagctctagagagctcatccccaaccattgtgaaagtttcatcctgattctgggactaggaagagttgaatatattgataaaggtggcctccaggtaaagttggatttctgttgcatgtaagtgttaataatgtagtcaggtcttgaattaggatgatggaatgtccaagcccaaaactgggaaacaagatagtgggaaggtaattttttttttttttctgtagttttcccttttgaagatctcactggcatctatttagtatatatgacatcatctgtggttcaattctttagtgtaactttacattttttatttattcacatatttactgaatgctacctatgttaataaaatggacatgatccttgctgttatggaataaattatggctcagtaaggcagtgagaaattgaacagctaataagtgtgtttgttgactttaagtaaggggacctatggaagttgggtattctagcctcagggaaagagtttcttgggaataaccggtaactgatacttacaggataaattagaatgaccatgatcaactctgtatacgtatagatagttaataatcattttacaatgaataatggaaaaacattttattgtttttttctatgtatatatgtttttatttattagagactaggtctcagtttgttgcccaggctggagtgcagtggtatgatcatagctcactgtaaccctgaactccagggctcaagtgattctcctgcctcagccttccgagtagctagtactacaggtagacaccactgtgcccagttaattatttttaaattatttgtagagactgagttttgccatgttacccaggctggtcttgaactcctggcctcaagtgattttcctgccttggctttctaaaatgctgagattacaggcctgagcccctgcctggccaacttctgtttttctttttttcttttcctgatggactgtcctacgactgtttttatttttttaaccaaaactgcgtcataacctcttcttggtttaagggaggctaggaaatcttctttagttgagc

SEQ ID NO: 111119 - DNA, 2413 bp, Homo sapiens
taaaattttctgccccaacatcattatcaagagtcagcatattacaatgataaatttagcatttactgtgtggcaggcattgttctatatactttattcgttaaattcaccagcgaaccctatgaggaactatcttatccttagttgacagaggatgaaactggagtacaaagtagttaattaacttgttcatagctagtaagttttaaaaaggttaaacaacaatatactttgtatttagtccttaaatgataaaatcttccagtgtttagtttttcccactagaatgtaagctccaagtgggcagggacttaggttttgttcactaacatttgagatagcatatactagaacctagtcattatttgaaagaatttttacagtgatgatggtaacaatgacaatatcatttcactgagagatggccttggaaatacattagaaccgctttgagttcttcactgttggttgttgacaataatgttttttttatctcattcaaattagcttcaacgttatgtgctattttgcatgcttcatgtatatcttaataaaatagttgatttgaaaattgctaacttctatagcttcttccctcttttttttttttttttttttggtgacagagtcttgcttcgtagcccaggctggagtgcagtggtgtgatcttggttcactgcaacctctgcctcccgggttcaagcaattctcatgcctcagcctcctgagtagctgggattacagacatgtgctaccatgcccagttaatttttgtatttgtagtagagacagggttttgccatatgggccaggctggtctcaagtttcttgcctcaaatgattcatctgcctcggcctcctagagtactggaattacaggggtgaaacatcctgcctggcctagctgctatagcttttatatatctctgttccttttgtgcattagaaatgccttgaagcccccagggaacatcaggaaaaaaaaaaaaaaaaaaaaaaacaaccagaggtcccgctatgtgtttagctgagttgggagaagaaagtttagaaaagcaatctttgacctatccttatgaaaaatttacagtgataacacaattcttcagaatttcacccaaaagctacagctgccttggttgttgcagtcattgaagtgaataacacattattttattatttatttttagatactacatttttttcttagactgtggaaacaggactgtgaaattaattttgtaaaatcgggctttaatttttttttttttttttttgagacagaatctcggtctatcatccaggctgcatgtagtggtgcaatctcggctcactgcaacctccacctcccaagttcaagccattcttctgcctcagtctcccgagtagctgggactacaggtgcctgtcagcacacctggctaatttttgtatttttagtagagatggggtttcaccatgttggccaagctagtctcaaactcctgacctcaaatgatccacccgccttggcctcccaaagtgttgggattacagtcgtgagccactgcacccagccaaattaaaggttttatagttaatgttgttagggaaaggggaactatgctgcttacttctatccaagaaacttaattctgaaagtattctcattttacagtaataaaattgagagttaggtgttaagtgttatacctgaatgaataccacaagtaagcgacagaactaggattcagcacacatatgtcttactccaaaggccatgacttttgtaatactgtcatctttcaccattctccatgtcttgcttatagttcctgactcttaaagtaagactttaagttcgcttgtgggagcagggggattggagttttagattgtgaaataactggatgtttgaattaaactgtggtggtataaagaataattgttgcttgatggaaaattgagctgtgaaaaatttttggcttaactttgttttctttttatctttagttctgtgcaaataaagaccctattctaagccctctagaattttttttttttttttttgagacagagtctcactgtgttacccaaactggagtgcaatggcgaaatctcggctcactccaacctccacaccctggattcaaacgattctcgtgcctcaacctcccaagtagcggggactacaggcacacaccaccatgcccggctaatttttccggatttcaccatgttggcctcaaactcttgactcagtgatctgccttggcctcccaaactgttgggattacaggcacgagccaccgcatgcacctgaccagaatgctttttcataatgtaattcatcatgatgatggtattttcttgagcttatttagtacattttttcatacaataataatgttctttctatagagtgaaaaaaaga

SEQ ID NO: 111120 - DNA, 4060 bp, Homo sapiens
actaaaagctttcctgaataaagaaaataaacatttggactacagcctgtatgaagacatgagtgaatgaaatgctgaatgacagaaagaagaactttaaaaacaaaagcaacattttaccaatgagatatttaaggcaaggtctgttttagataccatatgaagggtaactgagtgtctacagtccatatgatttagaggtttaccatgccagatcttttattctattaaattctaacctataatacctgtaacaaagctctgctaaaactgttttatggaaagaaaaaaattagctaaaattcagtaagaaataccagtctatattcagtatctaaatttagtattttttaaattgctgtttatctaaaccaaatgaagttaccctccatataatttatagatgtttaagattattctgattaaatgtttcagacaagttctaatacgcacaatattttgatacagaaaaaagtacttgccttcatatggtgtgtctggaggtcctgctatttctcctcttaattctgtaaaattctcatctacaagatctactttaatttgatttttgctcgtcttaaaaataaacagaaaataaatgttagttatgtcagcaagaaaaacgcctaaagtattacctataaaaaatcttgaaaccccctctttcataagcttgattatctgctctagtaaaataagtctcggcttttctaggacttaattatccagttttaagaatatttaaaacaaactaataaattctaacttcattgttttaaacgaaataacaccactatgaacaacaatacaatggcttcttgactttctaggaatgttattagggaaaaatagtataaaagctattttatgtttgccaattccatgtatatcaggcccaaagcgataaatctaatcatccacagatgaacactaagatattatattctgcactatacccccacgatacatgggttctgcttaaacagaaaattcagggtcattaaaagccatttaggccataaactctcacttgaactaaccataacaactttaaatgtttagtttaactgactgaaatagtacactatccaccagaatggtgaaagctctagctacctaacagattctcctttccatgaaaaattccagaggactaaatgcctcaaaagaaaaggccttcttcaatttgtttttctgcttagtttattaaaacggcaactacctacttcaaaaaaccagatttctactttaaatttatctacattgacttattttgcactttaaactactccaagtactttcctatctatagcattactgagtctcttaaccttatgacagtccattctcagagccatgataaccttaaatgattcagaaaaccatccagtgggactcacattaacattcgtaagtgcctgccagcaaatgggctctccacttatattctcaaacctatgttaaaaatacagtaaatcctctcgattttttaaaccaaaatccctaaagaacaggttacatcttcctttttttgagacggagtcttgctcttgctgcccaggctggagtgcgatggcacgatctcggctcactgcaacctccacctcctgggttcaagtgactctcctgcttcagcctcctgagtagctgggattacaggcacccactaccatgctcagctaatttttgttatttttagtcaagacggggtttcgccacgttggccaggcttgtctcgaactcctgacctcgcgatacgcccgccttggcctcccaaagtgctgggattatagacgtgaggcaccgtgcccggcctatatcttcattttttttggttagaattccatattgttacctgattgacacaacatatctactcttatgttttttgcttttagactgactttcttaaacttgattactagatgaaacagtgtaagaattactgtctttggcttcctcctccaacccaaaaaaaaaaaccacaatttttactctttttctatgttaaatattttttagtacagaacgtttagttcataaacaatacatgacttaaaacccatatttttcaaagttcacatcactccaaattaatcctgttttttaataaaaacataggatttaaaaacttactttctaattagtacttttttttacatttttctgaaaatattttttatccaaaaactaaatttaactataaatatgtacaataagaaactacttcttatgccctaaaaaatcattaacaactttggtatttgtggtagaggagaaaatgtacattttagcaacagtaaaactactctgatggccgggcgcggtggctcatgcctgtaatcccagcactttgggaggctgaggcgggcagatcacgaggtcaggagatcgagaccatcctggctaacacggtgaaaccctgtctctactaaaaatacaaaaaaattagccaggtgtggtggcgggcacctgcagtcccagctactcgggaggctgaggcaggagaatggtgtgaaaccaggaggcggagcttgcagtgagccgagatcacgccactgcactccagcctgggtgacagaacgagactccgtctcaaaaaaaccaaaaacacaaaaatttagttgggcatggtggtgcacacctgtagtcctgctactcgggaagctgaggcaggagaatcacttgaaccagggagacggaggttgcaatgagccaagatcgtgccactgcactatggcctgggtgaaagagcgagactccatctcaaaataaataaataaataaaaataaaaaattgtctagtatctatgcataatgttaaaagaaaattggaggcatccaactttcactgaccaatttaagaagccagtgttaacttacacttgcatttctcctcttaaggcttcttacaggaataatcatcttgctaatcatcaatgctttcaaagatctcgatagctttccacaatcccccctccaaaaagtagtatgtaaataacccaaagatgataggatactaaaggatctgattaaagttttttgggaaaggagagggagattagaaaagctgctttttgggactgcccaaatctctggctagtaaaatgctaaataattattccttttcatacctctgtccttatttctgtctacatcacccccaaattattattatttgtttaagacacggtctcactcccatcaccctggctggaatgcagcagtgcgatctcagctcactgcacctcaacttcccaagctcaggtgattctcccacctcggcctaaccagtcgctgggacgagaggtgtgcaccaccatgcctggctaaagttttaaatttttagtagagagggggttttgccatgtttctcaggctggtcttgaactcctgggctcaagtgatccaccacctttggcctcctgccttggcctccaaaagtgctgcgattacaggtgtgaggtaccgcatccagcccccaaattataagtcagaaaaaaattgctctttttttcactctatagaaagaacattattattgtatgaaaaaatgtactaaataagctcaagaaaataccatcatcatgatgaattacattatgaaaaagcattctggtcaggtgcatgcggtggctcgtgcctgtaatcccaacagtttgggaggccaaggcagatcactgagtcaagagtttgaggccaacatggtgaaatccggaaaaattagccgggcatggtggtgtgtgcctgtagtccccgctacttgggaggttgaggcacgagaatcgtttgaatccagggtgtggaggttggagtgagccgagatttcgccattgcactccagtttgggtaacacagtgagactctgtctcaaaaaaaaaaaaaaaaaattctagagggcttagaatagggtctttatttgcacagaactaaagataaaaagaaaacaaagttaagccaaaaatttttcacagctcaattttccatcaagcaacaattattctttataccaccacagtttaattcaaacatccagttatttcacaatctaaaactccaa

SEQ ID NO: 111121 - DNA, 1033 bp, Homo sapiens
cgaaaccccgtcttgactaaaaataacaaaaattagctgagcatggtagtgggtgcctgtaatcccagctactcaggaggctgaagcaggagagtcacttgaacccaggaggtggaggttgcagtgagccgagatcgtgccatcgcactccagcctgggcagcaagagcaagactccgtctcaaaaaaaggaagatgtaacctgttctttagggattttggtttaaaaaatcgagaggatttactgtatttttaacataggtttgagaatataagtggagagcccatttgctggcaggcacttacgaatgttaatgtgagtcccactggatggttttctgaatcatttaaggttatcatggctctgagaatggactgtcataaggttaagagactcagtaatgctatagataggaaagtacttggagtagtttaaagtgcaaaataagtcaatgtagataaatttaaagtagaaatctggttttttgaagtaggtagttgccgttttaataaactaagcagaaaaacaaattgaagaaggccttttcttttgaggcatttagtcctctggaatttttcatggaaaggagaatctgttaggtagctagagctttcaccattctggtggatagtgtactatttcagtcagttaaactaaacatttaaagttgttatggttagttcaagtgagagtttatggcctaaatggcttttaatgaccctgaattttctgtttaagcagaacccatgtatcgtgggggtatagtgcagaatataatatcttagtgttcatctgtggatgattagatttatcgctttgggcctgatatacatggaattggcaaacataaaatagcttttatactatttttccctaataacattcctagaaagtcaagaagccattgtattgttgttcatagtggtgttatttcgtttaaaacaatgaagttagaatttattagtttgttttaaatattcttaaaactggataattaagtcctagaaaagccgagacttattttactagagca

SEQ ID NO: 111122 - DNA, 1355 bp, Homo sapiens
tttaatcagaataatcttaaacatctataaattatatggagggtaacttcatttggtttagataaacagcaatttaaaaaatactaaatttagatactgaatatagactggtatttcttactgaattttagctaatttttttctttccataaaacagttttagcagagctttgttacaggtattataggttagaatttaatagaataaaagatctggcatggtaaacctctaaatcatatggactgtagacactcagttacccttcatatggtatctaaaacagaccttgccttaaatatctcattggtaaaatgttgcttttgtttttaaagttcttctttctgtcattcagcatttcattcactcatgtcttcatacaggctgtagtccaaatgtttattttctttattcaggaaagcttttagtgattatttcaagccatagaaaggaggtggctttgctgaacttggtgttcacaaattaagtctgtagctactttagaccatggaatcgggtggtaagatacagaaataaaccttatagcattttactttcttattaggtgagtcttcattaattaatattactgtaaatttagattatatagcatataaccaaggctcttgcattaataactattcaaatatttgtttattagaaaacatataacaatatatggtaaccctaattatacagtctttacatgtattttctcatttaatcctttcagcaaatcttactaggtaaatacaacgattgctgtttcatagatgaagaaacaagttaagagaagtaacttgtttaaggtcaaccatctaagtagcacaactgatagcctttgtcttcaaagcctgtgcttttaatcactttatgtaaatcagaattgacttaatattggaagtggtggtgatgtctgttttgttttatctatttttttatatgcaaagttttactgttacccaagctggagagcagtggcatggtcatagctcattataaatttgaattcctaggctcaggtaatcctccagcttcctcagtagctagtactacaggtgcatgccaccatatccagttaaatactttgtgtgtgttttttgttgttcattttttgattgtttgttttttgagactgagtctctctgtcacccagcctggagtgcggtggtgaaatcttggctcactgcatcctccatctcccagaatcaagtgattctcctgccttagcctcctgagtagctgggattacaggcgcaccaccatgccggctaatttttgtatttttagtagagacagggtttcacaataacggccaggctggtcttgaacttctgaccttaggtgatccgcctgt

SEQ ID NO: 111123 - DNA, 1297 bp, Homo sapiens
gataccaactagagataaaaataccagaaacatacccatttaatccccctaaggtattgtaagcctatttttgtgcatgaagttacaaaatattttatatttctgacctcattttattaatatatattttagggcttattaaagtcacagctttatgaattgcttactgtgtaaacttgatgtggacaggattttagataatggcaggtggctggcttctgaaattagaatgaaaagcaaactcacccaaaggcagccagtaatggctcaaaactggaataggatgtacatctgacaatggctcatatactagatctagaaatacgtggcagtgttcccaaatttagagagcccttttacacatagacagaggttcttacttgactcaaagaagtatgtgttttaggagagtaccttctacattcagtcattatttgagtactttgtgccaagaactatagcagtaactaagacttatactgttcctgctttcatagagctcacattatagtggggaaaaaaaactgagcatggaattgcaactgtgataaatgttgaaagggagtatggaataccctaagatcatgtataacagggggacccaacctaaacttatttttggattgaaccactttctttatgtctctgcttttactgtcatcagcactttaggcattcaactttattccctgttttgtctattatttaatcacccttccatcttttccatttctactcattctctgcactgttggtctagaaatcttcctagagttcagttttgatcatgctgcttttctttccctgaataaagtctaaactccatggcttggcacttgaaacctagaacctgaccccagtcttgtttcccactctaatcttctaccacttccacccacaatgtgggtctcattttccatcttagattgtttatttgtaggtgatgcttattcttccacagctttctatcagtttcacttaaatctttgtccctattatttaaaattctagttttctatgaggcccgagtatcactttcttcattaagctgagttcatcaaatgtttctccctctcctctctcagtagcattttatacaatttatatagtggcaacacaaatatagttccaactcatgtattattttggatatgtatctttctctagcttttatgctcctgagtcatataggtcttttacacctatatattatcagtaattcccaatagtatagtgtcccttgggcatatgatagcagtcactcagaatgttctagaatttgttcattcaacctatt

SEQ ID NO: 111124 - DNA, 1061 bp, Homo sapiens
aatatgaaaattagccaggagtgatggcgcacgcctgtagtcccaactactcaggaggctgaggcagaagaattgagctcaggagctcgaggatgcagtgagccgagattgcgccactgcacttcagccaaggtgacagagtaagaccctgtctcaaaaataaataaaaaaggccacgcgcagtggctcatgcctgtaatcctagcattttgggaggctgaggcgggcggatcactgggaattccagaccagcctggccaacatggtgaaaccctgtcactactaaaaaatagaaaaattagtcgggtgtggtggcgcacacacgtagtcccagctactggggagactgaggcgggagagtcacttcggcccgggagacagaggttgcagtgaaccgagatcgcaccaccgcactccagcccaggcaaccaagtgagactctgtctcaataaaagtaaaaaaataagattaaaacaaaaggcaaaatacacttcacatatcttcagctcacttgactgaaccgtaatccttctgacatcttcaatagtgttttaaaattatattttctaatcttgttgaaaatactaaaccacatggggttttttgtatgtgtttgttttgttttgtttttgagacggagtctcgctctgtcccccaggctggagtgcagtggcacgatctcagctcactgcaagctccatctccctttacgccattctcctgcctcagccatccgagtagttgggactgcagtagctgggactacaggcgcccgccatcacgcctggctaatttttttttttttctttttttttctttttttttttttttttttgagacggcgtctggctctgtcgcccaggctggagtgcagtggcacaatctcggctcactgcaagctccgcttcccaggttcacgccattctcctgcctcagcctcccgagtagctgggactacaggcgcccgccaccgcgcccggctaattttttgtatttttagtagagacggggtttcaccgtgttagccaggatggtctcaatctcctgaccttgtgatccac

SEQ ID NO: 111125 - DNA, 1086 bp, Homo sapiens
ggctcagtggctcacgcctataatcctagtactttgggagcctatgtcgggtggatctcttaagcccaggagttcaagaccagcctgggtaatatggtgaaacccccaacactattagaaataaaagaattggctgggtgtggtggtgtgtgcctatagtcacagctacttttaagatggatcacctgagtctgggaagttgaggttgcagtgagccacagcagtgagaccttctctgggggggaaaaaagggagaaatgtttgttgtacataagccctatattactgtcttacttagcttgcattgtatttgatatttagccttataataacatttttgccgtaatattaagtgcacattcattccatgtgagtcgcttacatctggagatgctttattaagtaggatggatacagtgtcttttagggaagaccggacaaacaaggcagaaatcacagaagtgtaattaatatactatgacaaaggaaactgcaggtgtgtggaatagatcaggaagaagtgatatggaaagtgaaacttgaagagtaggaattagttgggagaagagggcacagaggtatgttattgagaaaacaaatatgtatgaaggcccagaacaggggaaaagtttaatatgactttttgagcaggagagtggagtgtgggatagaggtaaaaattgagatttcaggagtagtctaaggccaggttaagagtgtgggcttggccgggcatgatggctccatgcctctaatcccagcacttagggaggccgaggcgggtggatcacctgaggtcaggagtttgagaccagcctggccaacatggcgaaaccccatcttgccatgttggcgctccaagatcgcgccactgcactccagactccagcctgagcgacagcgcgagactccttctcaaaaaaaaagagagagagagtgggcccacatgaagggaatgagaggtcattaatggtccttaaagcagcatagtgatgcaaatcagatttgttttaaagggctctctttagttttggtgcggaaaataaattggagggaacagaagggaaggcagtaaagtcaggagac

SEQ ID NO: 111126 - DNA, 1029 bp, Homo sapiens
ccacttactatttgtgcttccattcactggttttacttacttttttcctcaaacctattctgcaccctgcctcacatgaagaaaagtgccatttactatttatgtttttattttatgtactattttatttaccaaaatggattttattctctgttgtattctcatagcatctaccattattctaggtaaattgtaagctcctagtaattgttgggtttgtttaaaggcggaacatttattaaagagtttgaaaacaacatatgttagtgacaacattcagcttactggatcctttgtcttctacaccccttctttcacctaggcaaaatgatgtaatagatatagggacctttctttttttagtttgaagatttcattttcttgtagttctacttaaactgttttatttctgttactgaaaaactcaagtgtgctttatattctaggtccggtttatcactaaaatatggcatcctaatattagttccgtcacaggggctatttgtttggatatcctgaaagatcaatggtaagagattttgaattcaccttctctccttctcatatgaataccaagactgtaagagtgttaaatgtgtaattgcctcaaaacatatattatactttatcttgtttgggcagtaactttaaaagtctcttaagtgcataactgaaaatgcattataattgagatcacaatccatatttaaatagaaacttgttagataatgttagatgctagctttacactttgaaaagccttggatttcatttgttattttggtaaatttgattctttgctatcttaagaagatatttgtgaaagactaaaaaagtagaaagtaagtattgaagtagtcatatcccccttagatggaatgtaagttacaaaattgttgcaggttgtgttaattgagcacagttaagattttggtttatgaattctaacaaggagcacctttgtaggtgatgtcttcatttggatagcggtattgtgctttcactttttttgtctgatttgctctgcac

SEQ ID NO: 111127 - DNA, 1027 bp, Homo sapiens
ggtggtttttcatgcctgtaatcccagcacattgggaggccaaggcgggcggattacgaggtcaggagatcgagaccatcctggctaacactgtgaaaccccgtctctactaaaaaaaaaaatacaaaaaattagctgggcgttaaggcgggcccctgtagtctcagctactctgaaggctgaggcaggagaatggcgtgaacccgggaggcggagcttgcagtgaaccgagactataccactgcactccagcctgggcgacagagccagactccgtctcaggggaaaaaaagaaaaaagaaataggcaaattgtaaagtaaggaagaaaatatatgataggcagatacataattataaatgtctatgacttaactatataattaagataaagatctaagtaacttttagctctacaattttttaatttttattaagaaaatactttgcttttgcctgcagagccctcttaattgggatattttcatgttttgcattttagggcagctgcaatgactctccgcacggtattattgtcattgcaagcactattggcagctgcagagccagatgatccacaggatgctgtagtagcaaatcaggtaagatggccgcttttgaaagactttcttatattatgtatgagtctctagccacttcagtggtttgcacattaacacatgagcatactctattgaaactaaattttgaaatggttttctttcttgtggtaggattattttgtcaggtgtaatagtgaaaatagacttttaacatcctagtttaattggatatagatgctgttttcctaacatgagtattttcaaacacataaagtcaaaagaattacatagtgaacacccatattcctaccatctagattctatgattaatgctcgtgtatgtgtccatctttttatccttcctttcagtgatgatccctccctgctaataattttaatcacctcctatcatgggacttatgtgacatggcacagtttccaatgaccttgtaatttgttgaacag

SEQ ID NO: 111128 - DNA, 2338 bp, Homo sapiens
cttttaaaagaaatattaaagtgaattgaatagttagtaatttatactttgctttactaagtaatggtggttccaaagtatttgataaatttacctctttccaatgcatatgggaagtcttttaataaaattactctattgtgagtttataatcatctcaagttatgtaataagttaggactttgcatgtggggtttccataaatcactgtacactaatgcagctgtaagaaaacagaagaatctagttgtattctagcctgggctgtgggtaatacaaaagctggttacatcgtaaaaaattattctaatgtccacatatttttataagctagtaatctgtgttcagttgtataatgtttgctgctttccagtgtttggaacatctcttaatacctcacttaacctaattttagtcttgctagttatatttgttgaatttggagattaaagtagattaatgttacttgtctttattattgtcaacacaaattgtgagtcgaagcttcaggttaagtggtcttttctcgagtgacataggttgtctataatgcaaagtgaatcacattttaaatgtagatttgttttatttggaaaagtaggattgtaggcgattaagagctgaaatatatcaaatattataactgtaatgtcatgtcaatcaatttttccccccatatagtacaaacaaaatcccgaaatgttcaaacagacagctcgactttgggcacatgtgtatgctggagcaccagtttctagtccagaatacaccaaaaaaatagaaaacctatgtgctatgggctttgatagggtaagtacataagggcatgttgattttgatatattgattgattttaaattattgcaaattcttggctgacaaaagtggtttagaaaataagagaaattcgcagcctgggcaacatggcgaaacccatctctacaaaaattagctggacatggtagtgagtgcctgtaattccagctactctgaaggctgaggtgagagaatcccttgggcccaggaggtcgaggctgcagtgagcgatagtcatgccactgcactccagccttggtgatagagcaagaccctgtctcaaaaaaaaaaaaaaaaaaaaaaaaaaggaaaataagagaaaatctagttttggtaaacatattttctgttttcaaagtcagtgatttttttatttttactaattactgtcattgattttagaagctttccatgcactgcaaatgtaaatcaacttacagaaaagaaacaaggtgttaattcccagtataaagagtgaatgattcagtattgtttaaatgtttccttgagatttaatttcctgtccccttttcttctctacagaatgcagtaatagtggccttgtcttcaaaatcatgggatgtagagactgcaacagaattgcttctgagtaactgaggcatagagagctgctgatatagtcaagcttgcctcttcttgaggagcaccaacatctgttatttttaggattctgcatagatttcttttaaactggcattcttgcctaatgatgttatctaggcaccattggagactgaaaaaaaaaaatccctgctctgtaaataaagctaattaaacgtctgtgtaaatttaaaaaggggaaatactttaattttttttcttaatagtgtaaaaattccctgagctaagctaaaaccatggaagaaacatgctactttagtgtttagcagtgtaccaagactagcaagagtttgcttcaggattttgttgaataattaagataatattttgagtgtgtcagggccattcaaattgttggtgttgcatcacagctaccttaactgtttttaacatggatcctctgtgcctgtgaatttacttgcatgcttgtacttgacttcttaggatgggtagctgaaaagaccaccattttaagcatttgagaattcttaaatatgaaatttattcagaattgaagatggtgacctattcagagcctttttgtccttgtcaacagactgggacagtgtctgattcccccttcaccccccccacccccgccttgccacacacagctaatattctaatggtaaatttctctgtatcaggtggggaaatgtgctgaaggacagtatgtatcccttgcttcatttttaggtcgtaggtttggaatgtcttgtcccagttcttcaaacactcttaaatttttcttaagtaatgtaaaaatggaactgccaattttatttctcttgcaaaaatagtaaatacttgatgttacattattcccaggtttaatgaaagaacccaacttagtttttcagtgaatttgacacctattttt

SEQ ID NO: 111129 - DNA, 1028 bp, Homo sapiens
tatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagtt

SEQ ID NO: 111130 - DNA, 1028 bp, Homo sapiens
ttgatttaaaaattacgtttccattctttttagtatcagtttaaagtaaatgcttaccatcagccagttgctgtcactgggaagaaggcaacttgaagtatttactgataaaatagcctttattcccaagtgtgacttttcttcagtgtctacatattatgtcacacgttctatttgcactgctgcaatatagatcaaagatcttgtggcataggggtaggggagtgttagtatctcccttgtcccatttgttctgttactgcttcattggactgatacaccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaatggtttatatcttatttctgggtgctcatctgtggacaagcaattaagtcttactctaaataagaa

SEQ ID NO: 111131 - DNA, 3452 bp, Homo sapiens
ataatgagatcccgtctgtacaaataatttaaaaattagccagccatggtggtgtgcgcctatagttctagctatttgggaggctcaggctggacgctgagcctggaggaccacttgaacccaggagttggggctgagtgagccatgatcgtgccactgtacttcagcctgagtgacagagtgagatcctgatgcttaagtttaaaaaaaaaaaaaaagattttagataacaactatggaaatgaaatcattttcgtttggtttatatcttctccacatcttttctaactttgcgttctattcttaaccctaaggtaaaaatgcatttgcaaagggagaaaatgaaggccaaacagaagcaggctccagcttctgcaaaaacttggattcacaaatgtccctgaacagaaaatgaagctcacttcagaacacacactctctgccttgaaaactaaagagactattacttccttttcacatgaccacaagtcctctgatggaaatgtacagcagaaactcttgagagagaggctaaaagcaactctgttctcccccttcccctagacttttcttacgaaaagtcaataattaagcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaaaatagaagtctactgaattaattttttaaaagaaaagagatcagattaaatatttctttgtttttccttttggaaacttttatgtataattctttctgcctgcctacttttctgcaaaaatgagatgtacagatttcggttccctgctatgaaaagtgatgtggtagcaattttataaatgttgctttctgatttttatcagagtgagaaaattaaaattattgatttgcaagtagtaaacagttcatattttgatttcccctcattttagtttaatataatttgcaataaatgtacatattgttgtttgtttcataaagcatatcactttaaaatggtttttactcctgtgattatgttggaatatttggaattttaaaggagtaaagactgtccagcatttggttttataatgtttgtcaccagatttttattaatgtaaaaaaaatcaatttttaaaaaatagttggactttggcagcttttaaggaaagttggaggtgttttaggattgctatcaattttcagcattgtgctatttggaaataagtgttttgcttttgtctgatggtctgggctcatttttatgtttattttagaaaactgttgcatcaatatattatgtttcttggcattgttcagcataggtaatgtgtgcactttatgtgtacacataatcatatttaagttttttgcataaaataaatgcttctagatgtcatggcagtctttttaatctttttatcatatgctttcttgtgaattttttcatgttaaagagctaaagtcataacatgattacagtcaactctccattatctatataaaatagtgactaagcctcaggtttttaattttgtgataacaaaataacgaaggcatgtaagacctgattctggaggaacatgaaatttgtcttttctcatgtccagagttctatcctgcccccactgtccactgtagggtcatccgcaaagccctagcagaatgtgctcactccatttccttacacgtttctagcatgggtcagaggaaacaacatttgtgttataacttcgtcttgataggctgtagtgtacatgggatgtaaaacaaacaagtgtatcaaaggtggatgattctgttagagtgaagtttgagagtaaatgtcacttacgtttctcatagataatcaagagttggctgtgtattgactgaaagatgggtaattattttaaatatgcatttacacacatttaggtatcagaagatgcttagggaacaatggataccaatgatagaaaatgatacctttacaggggcagaaaaatccccactcttccttattgcctcttcagaaccctttagaaagtataaaatattgcctccaacatgctgaaaaagagtatctatgcataagtatcagagaagtccctcaagcaatcagtaggtgtgttctatttagagagagtttaaagttctcttagcatcagacaacttgattcctaaggtttccagtgtgtcaccaacaaaaagtgcattgatagggacctttgtctcttcctccctttgattaattgcccggcatcacagtttactagattaccaagtgttacatcatattaaataaaatgtagcagaaccatctgcatcaatatattcctgtttagatttttgcaggagagaagttaaaaggatttgctccttgtatgatgtaagtggcccaccccaattttgtaacatgatgcaagtgtctggcactaagggaagcaagagtagggttgtggaaagaccaagctgatggggagggacttgtttacgggaatttttttagttttccttttcaaaggaaaacattaaaatcccttaggaatttggtattcacatctcagagaactacaacacaaaagtgcagacttatatttgagaattaatgttaaccctttgtgtctagtttgaagcttcttgtatttgtctaaaacaacaagccagaattttgtatctcctttgataaaaagtgtgtataatgtaaagtagttttgcatattcttgtgctgcacatgggctgaatttttaaattttttttaaaaacttgaagcagaaccttgtaatttgtgtaaatgacaagtgtaaaatcctaccataaaatgctaaaaatatgcactgtttcaaataaaaccaagaaatgcagcattatatagtagtgtggagccctgaatattcatgtacccctggtatgtcacaagttgataaaatgtctctgcatattttctgttgagatgctggagtctgaatatcctaattagaaatcaaaagccaccttcaaacttcctggctgggtactctgaggtagcttacagtggctaaggaagaacatagtggatgataaattctgaggcacattcggaatttccaaacgaggtttgttttagggggtggctttttttttgaaatgagatcttaccctgttgcccaggctggagtgcaatgacatgatcatggctcactgtagcaatcctcctgccccaggctcctagaaaagtgctgggattacaggcctgagccaccagacctggccaagaagttatttttttaacctaagaatttaatagcagcctttgattcatattagtctatggttcatccattcattgcaagttctgcactcacatatttagttccataacaaattcaagagagcaagcaga

SEQ ID NO: 111132 - DNA, 1006 bp, Homo sapiens
tacaggcacaagccaccatgcccggctaattttttaaattatttgtagagatgggatctcactatgttgccggggattgtttggaactcctgggctcaagcgatcctcccgctttagcctcctaaagtgctgcgattacaggcgtgagccactgttcccagcctttgctttttaatgagcatttattgagcacattatatatgctatacaccatggtaggtaccaggcacagtcactctcctcaaggagcttactttcctaatgtgatgtaagcagttaactggaagccctcaaatccagactcctttaaaatactttcaaaacactcttttctaatagagatcattaatatttaaggaatttgtgtttatagaattgttttgtgcttttttaggaaattaattctgatcaggctacccagggcaacatcagcagtgaccgaggaaagaaaagaacagtaacagcagctggtgcagagaatatccaacaaaaaacagatgagaaagtagatgaatcgggacctcccgccccttccaaacccaggagaggacgtcgacccaagtctgaatctcagggcaatgctaccaaaaatgatgatctaaataaacctattaacaagggaaggaagagagctgcagtgggtcaggagagccctgggggtttggaagcaggtaatgccaaagcacccaaactgcaagatttagccaaaaaggcagcaccagcagaaagacaaattgacttacaaaggtaatgtacgccattcttcctcaagtgggaatttagacattttgttttattcgtagtatattcttagtgccagtcaccccaaacacctaagcatttgagagagaaacctgcatctggttttcctgggtccgtttataatagcatctgttattatctcataacttccagttttaaggcacaaatttgaagaaaaatcttttttctttgtgtaatttttatttaggatatggtattttgatatttctatttttattaacaa

SEQ ID NO: 111133 - DNA, 1080 bp, Homo sapiens
ttaaaccacttttagcaaaaatgaagcccaagatatgaaatcagttaacatggtttaaagaatagtggggcctcaaatacctaccaaatagcctcttctgacagccccctttttagtagaacactatggaaatgacaactatactatggtctgtagttttatttttgttttaggattttctattcccaaaagataaagcttacagtggttgtgttattttgtctcttgacaattaacccttttgtcaagtagtcttaggcagtcatttctgtcttaatgttattaaggcaaaatggaaattgataccactttatcaaagctaaatggaaaatgatatttttaaagcaatagtctataactacagagtatccgaatcttgctattgttgcttcaattgtcaaggtttcgaaaccagcctaagcctttctttattggtacggtgagagagtgaactttctcttcatggaaatatgaagtcttggtttatttgttttaaacagggaacagagttcagaggcagcagaaactggagttagtgaaaatgaagagaaccctgtgaggattatttcagtcacacctgtaaagaatattgacccagtaaagaataaggtaaattttaaaatttaacaagtggattttttccatggagattattacagtttttccgtagggataagaaatctacagccaacacttcaatgcacatgctacattttaaacttgtgtgtattaccacacaccttctccccgcttcccgcaccccggctatacttcccaaaaatgattctgcttacctccacccactttataagaatttatgtggtctggctgggcacagtggcttacacctgtaatcatctctactaaaaataaaaaaattaccggggcgtggtggttggcaccaaaatcccagctactcaggaggctgaggcaggagaattgcttgaacccaggaggtggaggttgcagtgagctgagataacgccattgtactcaagcctgggtgacagaggcagactctgcctccaaaaaaaaaaaaaaaatttgtgtggtcacctacccgtagtggtatccttttcc

SEQ ID NO: 111134 - DNA, 2150 bp, Homo sapiens
cgggttcgaacttctgacctcaggtgatccacccactttggcctcccaaagtgctgggatgaggctcacaggcatgagtcaccacacccggcccgaatttatgatgtggtggaattcagtgaataaatttaatgaataaactgcattgaaccgtatgaaaacatgtgtgtgctttatttatggtgtgatttaggaaatttatctttgacatttgcctaagtctgcgtgccatcagtttaatttaaagctagacttatggtatggctttgattgttttgattgtttgataaattggtatatgtgttagcacaagtgtatttattattgcaaggcacaatacctaaaaagccttattgagataattaaaatactcatgttcctttgattggtgtttcttttttctttttcttttttttttttaataggacttctgtaacgataagagttatatttcagaagagacaagagtacttctgttaacaggaaaggtattatttacttaataattttgagatctttgtttcatgtgtatcttgcttctgctattcctagaaatacctttaaatgaccactagattgtatagttcctgattcttagggatcacattatggatttaaagcatctaaagcagccatgcttttagaatttttctgccagcaaccactcctctgaaatgccactgtgtgttctcatcagtaatgttaagcacagtttatttacaattcacaaagaagactttcctgggaaatggtataaccaacttaggtatataagataaaagaaataattttatactactaatgaattagacaattcatgttctatgtaagtaatatggtgacacctaaaacagcaaaaggaaatttagttttttgtaaatagttcctaaactattactatatatatatccaatagtttatttataggagcatttattatgtatgtattttgctatattttaggggaactttgtattttgattgaataataaaggatacattaatattacctagttattattaagtagagatatgcttatgacttttgattgtattaaggcaaccaaacacaattttacagaatgatctttttttttcttgagacagtctcattttgtcacccaggctggagtacaatgttgcgatctcagctcactgcaaccttcacctcctgggttcaggcaattctcatgcctcagtctatcgagtagatgggactaccggcttataccaccacacctggctaatttttgtatttttggtagaggttgggtttcactcttttggccagagtggtcttgaactcatggcctcaagtgatccacctcccaaagtgctgggatttgcagtcaggagccagtatgcctggcccagaatgaacatttctggtaaatttaactaattagcacttaacaatatctcttacttgtgtctaaatttacatgtatacatggtaaggtataaacgtgtgtgtttttggggggttttttgtttttgtttttagccaaagcctgctggagtactaggtgcagtaaataagcctttatcagcaacgggaaggaaaccctatgttagaagcactggcactgagactggaagcaatattaatgtaaattcagagctgaacccttcaaccggaaatcgatcaaggcaacttttctctccaattattttgttactagcactcactacttggtttatcttttattcctaaagtgctgtctcataaaatggtcttctgtcattagcggtgttctggtacaaaataatattgatgaattttagtattttcttttctgggtttttttttgttttttttttttttttgagacaaagtctcgctcttgtccccgcccaggctagagtgcaatggcgcaatcttggttcactgcaacctctgcctcccgggttcaagcaattctcctgcctcagcctcccgagtagctggaattacaggcgcctgccaccacgccccgctaatttttgtatttttagtagagacggtgtttcaccatgttggccaggctggtctcgaactcctgacctgaggtgatccgcctgcctcagcctcccaaagtgttgggattacaggcgtaagccaccgcacccagccagtattttcttttttttcttaattttatgtaattttt

SEQ ID NO: 111135 - DNA, 1720 bp, Homo sapiens
aacacccagctaatttttgtatttttagtagagacggggtttcaccatgttagccaggatggtctcgatctcctgacctcttgatctgcccacctcggcctcccaaagtgctaggattacaggcatgagccaccgcgcccagcctcgaatttctgggttcaggcaatctacccaccttagccacccaaagtgctgaggttataggcacgagccaccatatccagctagggtgaatctttatatgccttatgaaactgtcagactttctcatattaagctatgttttcattttttatatgttattttatgctttaattttccatttgaatagaatattattaggataataacatatattagtcattaaggttgatcattttattttattttattcagacaacagaaattcccagctaacatatttattgctttaagctaaagcatctatctacgtctagtctctttaatatgtttacatttaggtgcctatggttcatgcttgaagttttaatgacaaagaatgaaaacaatagccatgcctttatgaagaagatggcagagaacatcaagttaaccagagatgcccagtctccagatgaatccaagacaaatgaagtaagatgagtgttaggccagtgggtgttaagatgtaatagaaaaatatattgtcccacttggttttttttttttttttttggccatacgtagtaatttaaattttagaatgtttacaaaagtaaatgtgtagtcagtttttattgcacttcattacaagtgaattttatttcaggaatctttagtactctgaaaagacattataaccttagagcaagaggataagaataaaatgtacaactatggtatattacgaacttacagtaagagttacagacaaatgcttattctttttgtgtgctttctttgggttggttcatttgtttgttattttccatgcatattggcatccatgttaaattcatatagagggatttttatttatcagaaggctgcataaacagtgctgaacagaaatatggaatgttcaaggaataaataacaaccacagtatccttcttttaactctaaattatacatttagtggaattggtaattatgattattttgcaatactaaaagttatatatgattcgttttcctccctagaaactgtatacagtatgtgatgtggctctctgtgttataaatagtaaaagtgctttgtgcaatgcagattcaccaaaggacccagtcctcccaatgaaattttttacacaacctgaaaaggtaattttcttcctctcatttttcctaccacactaaactgatttcaatgtcaattaccatcaaccattgtggcaaatattgaattgtcttgaccacagagtaaagaaaaaatctgggtttatcaaagagtgggaaattgtcttacacagccctgaacattattctgacttgaacagaagactacacatactgttgatcttatgtttattctaggaatttctagtattaaagttttcagatttttaaaattattttaatctcattttattgaaacatgggtagtatttttgcagataagaaaaattttaaatctttggcacagtgtaaggagggacaggttctctcctctaagcctccatttcttcatctttataatgcagatgttaataatacatatggacaattgctaatatctaggtttatatgaagagtttat

SEQ ID NO: 111136 - DNA, 2838 bp, Homo sapiens
ttatatttcatatcctttaggtatttgtctgatacttcttcactcttaactgcagccctgccatttcagcaggcattaaactagattcctgttacatgtttatatgcaggaaatagattttaaatgatgataggtgattttttttttaattctttgtggtttttttaatcaagtttttttgttttttgttttttgttttttgttttttttgagacagagtcttactctgttgccagggtagagtgcagtggtgcgaccttggctcactgcaacctccacctctcaggttcaagcagttctcctgcctgagtctcccaagtagctgggactacaagtgcgtgccaccacacccagctaattttttgtatttttagtagaaacagggtttcaccatgttggccaggatggtctcaatctcttgacctcgtgatccgtccacctcggcctcccaatgtgctgggattacaggtgtgagccaccatgcctggccactttaatcaagttttctacaatcaatatgtatttctcttaaaatgagggatacagctcctgatgtaaagagtttttcctagccttgcaattactatggttgcaagaataagcagagtttttgggttgtggtgaagtatctaagctagagtttgactagaaatgaaggcaggtaaatttgtaatcagaaagtcacaatgatttgatttgattgtgaaagtcacaatcccctgtgttaagttcatggactcaaagtagctttcccatatttgtacgtcattttaaacataaattatgctctaaggaccttacattcaaaaagggacgaaagcatttttatgaatgatagtggttataggaaatgtttatttcttttttgtttgtttatagtaaatctgatatgtctcgcttgcgattagctgctggtagtgccataatgaagcttgctcaggaaccttgttaccatgaaattattaccccagaacagtttcagctctgtgcacttgttattaatgtaagtaacaatcttatttttgtcaattacttatcttcaaagttgaatacattacttttctatggatacaaatccatttataatgtgaatatatgcacaaaagtcactactattattacctgtttaactgtcttccaattattacattatttattctcccatataattatcttctttttaattgaagacactaaaaatacttaaactgctgttttttatttaataaatggttgccaatttaagtttttctgtgctgctgtaggatgagtgttaccaagtaaggcagatatttgctcagaagctgcataaggcacttgtgaagttactgctcccattggagtatatggcgatctttgccttgtgtgccaaagatcctgtgaaggagagaagagcacacgcacgacaatgtttactgaaaaatatcagtatacgcagggaatacattaagcagaatcctatggctactggtaagtaactcagagttctccgtgtgcaaatatattttgtcaatgtatccatttttaggttttttttttcttgtcatgtgtttctattatagtttataataaaactgggagttttatagaatgctgtcattgtagttatgatgtacttaaaaactgaactcctgagtcctatttatgctgcattaactctggcaaactgcatttttcctatgggatcaggagtgtagtttaatttgaacatattgctcggatgtcagactaaataattttttcctagctttgccagggacctgttgtttaatgggtttaatatctgatacctttgacttcagtatctttcaaaagtgaaatacaactgcataccaggtaccagaaaaagaaattgaaaagtgaagtgtaaagtattttagtatccaggtatcatgttgtgcctaatttagaaataactgagggaaaaaatgaaaacttaagtggttagaactcagtccactaaggcattttataaaggttgtttttaataatgtttttacttcagagaaattattatcactgttgcctgaatatgtagttccatacatgattcacctgctagcccatgatccagattttacaagatcacaagatgttgatcagcttcgtgatatcaaagagtaagtcttgttgtttttcaagaactctaaaaattatgtttagttttcaaaaaatggtaaattttttgtttattatttttatttattatttacattagaattagaatctccttatggttttattcatttattataaatttccagtttcgtctttcaaaaattttcccatctaccaggttttggttgttcattttctgtttgtttgcagctagttaagctatctaagtctttgaaataggttagtttggttatcttagttattatatttgatttttactatttatattgagagggtttgaatatgggaagagtactgaagtatgtgaaataattggagttggaactgaaaacagtggagcatattttttattctttgttctctctagcatgcaacactttcaaatatcttttaaaaaattttgatacataataattgtatacatttatgaggtacacgtaatattttggtacatgcatacaatgtgtaatgagaaaatcagagtaattaagatatccatttcctcttcatcccaggcaattggagctgcaatgagctatgattaagccactgcatgccagcctgggtgatagaacgagaccctgtctctgaaaaataatagtaacaataaaatttttaaaatacaaataaattattgttaactatagtcaccctaccatggtatcaaatgtcagaacttattccttgtatctaagtgta

SEQ ID NO: 111137 - DNA, 1754 bp, Homo sapiens
tggtttttttatgaaacagagttttgctctgtcacccaggctggagtgcagtggcacaatctcagctcactgcaacctctgcctcccgggttcaagcaattctcatgcctcagcctcctgagtagctgggactacaggcgtgtgccaccatgcctgactaatttttttttttttttttttttagtagagacggggttttttagtatagacacggtttcaccatgttggctaggctggtctcaaacgcctgacctcaagtgatccacctgccttggcctcccaaagtgctgggattacaggcgtgagtcaccacccccggcctgtatagtttaaattgttgtttttaaagtatatgttttcaaatagtttcaaaatcttgcacaaacatctaagtatgagaagcctaaattctggaaccagacttttaagcaagttatctatgataataatgtgtctcaattgccttatctgttggaaaaaaaaaaatcttcctcataagaattttttgggagattaaataagttaatacatttacagatctaagaaaagtgcctggcactggttaagcacagagtaaatattagttcgtattgttgctgttattatcccatagacttatttaataaaatgtctgctgatggagatgagtaatctcattaatctaattaaattaattttccctttaattggaattttaagttgctttctttttttagcatgttaatattttataggtacaggcaattaaacttctggtaaggtggctgttgggtatgaaaaacaaccagtctaaatctgccaattcaacccttcggttattatcagcgatgttggttagtgagggtgacctgacagagcaaaagaggatcaggtgagatttttctttctttccagttttcttagtgctgaaattttggtggaatttacataggaattatttacctaatgaatactgaatggtgtaattacaccatgatcttcagggtcagatcttatgtactcatttagggtttgtctgtctgtcagtattgttattttaatagtgccaatatatttttcttcattcctaaagaagaggaactttttccagtaaatacataatcataatcactatattgtactattacagttagcatcaacatttggttcaattaaacaagtatttgttaaacttctacttcataaaacactgtgaaaagcattgcagcaaaaataagtaggaaaagtccctgccttcaaagagcatccctgtattaaagcgattaaataagtggagtgacttgagtcccatgaaagtaataaaaatttaagtggcagccaggcgcggtggcctatgcctgtaatcccagcattttgggaggccgagacgggcagatcacgaggtcaggagttcaagaccagcctggccaatatggtgaaaccccgtctctactaaaacaaaaaacaaaaattagccaggcatggtggcacatgcctgtaatcccagctactcaggaggctgaggcaggagaatcgcttgaaaccagaaggcagaggttgcagtgagctgagatcgtgccaccgcactccagcctgggcaacagagcgagagcctgtctcaaaataaataaataaataaaaataaaaattgcaatggcaactcaagggagagttgaagccttcttgttgttctacagatttgggtgtgtacacttgtatgtgcacacagagattgtttacattgttacacattttcacttttaatctctaaaatt

SEQ ID NO: 111138 - DNA, 1008 bp, Homo sapiens
cctgtagatcagattatatgttcaaacacctcatattgaagggttttgtggtttttgttttttagtttgtttttgagataaagtttcactttctcaccagtgctggagtacagtgatgcaatctctgctcactgcagccccgaattcctaggttcaagcagtccttctgcctcagcctcccaagtagctgagagtacaggcaccaccaccatgcctagctaatttttggatttttttatagagatggggttttgccatgttgcccaggctggtctcaaactcctggactgaagcgatccacccacttcagtctttcaaagtgctaggattacacacatgagccaccacacctagccttatgtgtttatgttagaacattttacttaattttagccttattggttcagtggtgcatttatcctcggaaagtattagtagataattttgaacaatccagtttaaagtacctaagaaccctacctgaaaattaatcctgtttcccttttttttacatataatgactggcctcattttactattagaaatgtattcctattatcataaattggagatagtgtgaccaaaacccagtgaactcttactttgtatgatttaaggtcatttaaaatgcttccacagggtaagaaaaccactggtatagcaaatccattgttgtagattagtcaaaaataatgctgatttgatgaagcaaaaatgtttttctttaaacttctttttgttggattttattttttcttttatcttttttctacattctttcaatcttgctaaattttagtaggtgaattaagaaccaggtgtcttaacatggttgaagttagttatgatcgtattagagaagattggtttgggcatggtaaattcaggaggactcaggaaaatgtactgtttcagtagagtgtctagatatttatcaaacaaattggtaattttgtctgttttatttttatagccactcagtaggagtctgaatgctgatgtgccaga

SEQ ID NO: 111139 - DNA, 1065 bp, Homo sapiens
gaatgttcatctactagatgtgtttgtctattttttataagttcatatatgcacactattttcttcattctacctaatgctttttcatgtcatcaacatttaatttttgaagaatgctttatgtttttctgtcatcctaaaagaagactgttttagtttactcttcattgtcagtgtagaggttaagtatgtggattttgaaagaaatgctaattttcaaatcccaactcccagtttcctagcttcgtcatcttaggaggcttaaataacatctttgtgctttaattttctcatctgtgtaatgactatgatagtcttctttgggtggatgtgaacattagttgaattaatccatgcggaaatacctagaatggtgcctggcacataatagttagatatttttattgccattctactgatatatatgtagctgtatctttgcatactttctttcactagtattatttcagctgtttaatacaacttggccttttgctactctctttctgtagctactttgaaataactgaaggggattataaaagggaattgaaaaattagcaatattgctacttagaaggtaaatgcaaaaatatgtcatggggtaagctttagattatgaattaagggttgcttgttattttgcatatttgtgaggtaactttaaaataaaaattgtctcctgaagtaggctttttcttgaggcattgtatttcttggtttatacttgggggcagagatggagcttttttacaactttctttagatcagataatttttaagagagccttctctactagcatccatccatataggggaagtggaagtcaaccaaaggaatacttgttggtttatgggtttaagaaaaaaaaacaactatattattttttgcaggaccttaattcccattttacatcaaaaagcaaagaggggtactccacaccaagcaaaacaggctgtgcactgtatacacgccatattcacaaataaagaagtccagcttgcacagatttttgaggtatatctaatatataggttgtgtttatattggtctttattttttaa

SEQ ID NO: 111140 - DNA, 1138 bp, Homo sapiens
caaatagttcactttggcatcttaaaaaggttaaggtgaaacttgtgctgagatgttatatttagacttaaaatatgcagaagacatcttttgaaggaaacaatacattgcaaatggcagttgaatcatatgttcagggtattggcaattagttcagagtatattcaactacataccattttcctcacatgataatcatagaacaagcagtctcctgaagtttttattaaatttgtgagctaatagtttaacttgtgaaataattcagtgtccattgtacattctcttcattctccgcattgttctggctaataataaaaagttaccacaattagtccctgccctcaaggagtttatagactagaaataataaattttatacattattagaaaaagatcactgacacaataggatagtttttgatgagtttttcaagggaggaaatcctatacattttttcaaggcaaagaaactattcttagaggaattctaccccaaaggacacagttgaaaatgagcataggtggaagagttaactttggatgtgaggaataaaataccttattcataagaccaatggagaagaaaggagataatcactggaaagcagaaaagcacaatgctaaagacctcaataacaactctgatggcatcactagattatactgctctagaaaaaacaagaagaaaggttaaagttgactttctgtattattttatttggctaataataataatacatttaacaacagtttgattgaaactatcttcctttgtcattcaccagtgttataagaaatctcagtctggtaaatggaatggtgaaagactaaacagataggagagaggaaagacatcttccatttagaagcatagtcaatactcagtcaaggaagtctgtttggtcatggacatccctatctcataattccaaagtccatagaggcaaacttcaggcatatttatacatgtcaaatcagattcataccaactagcatatgttcccatttttggttaaagtgcatggcctggagcctgcagtataggtttcatatgtagccttccattatcataagagggcattgtcacccttgcatttgatgccactaactttataaaataggctcttctctaata

SEQ ID NO: 111141 - DNA, 1515 bp, Homo sapiens
cccaacacaaagaaatgataagtgtttaagataatggatgtgttaattatcctgatctgatcaccatgcattatatgtctggaaacatcactgtgtaccccatgaatatttataatttttgttaattttttataagtgaaaagaatttcaacatctgcatcctatgcatatttggtacttaaattttttttaatgaatactttgacataacaccaaaggaaaaaaaaattagccaaaatcttgttttgaacatttgtaataataattgaatgttctcataatagggtaatatcttcttcagtttactgatctcaaaaccagaagtcacatttgtttttacttaaaatagtaccatgttgctacatcatctgatttttattgaccagataatattctatttcctggtggtaggtattttgaaaaactaattccttaatttttgacaattaaattgttcctaattaatgaatctttataaatacagcatgatgcttccaatgacttgcttctttgctgtaagtttatagaaataaagttactgattcagtaaattatcagtgattaattcatttgtccatgtgtatgtttattatttgtatttttttgagtcagttgtcattgctcacttagcaactactatattattatttttcttaaaactgaaaatgatctctgtatatatggaaatgaatattaaattacttatgtgaatatattaccagagtgctgtgtcatttaattttagttttgttattttttagaagagttactcttatacattaagttttttagggggataaactaagtagaagtttagttatcaagtagaggacaaggttgaacttttttcccccacagaaactcctttgaatttaatattttaaggttctatatatgttctgtcacagtgtgattaggatatagttactactacagtggttactgatttatattttcttctttttatagtgcactagtgaaattgatgaataagtcaatagaggggacagcagatgatgaagaggagggtgtaagtccagatacagctatccgttcaggacttgaacttcttaaggtatttttgaaacagttttgttgccatgtatttccgtggggtcataatttgccttcccttcaggatatgcaagagtcaggcttatttcacaggaaactatttgaaagatttaaaacttgtgttggaaattagatgatgtaaaagtaatgtttttacaacataatataataatgtaattattttacattataaattaatatttgtttcactgtttatcatttccatgccttctatgcttggtagtgattactgtacaatctattcttaacttagtaatagcaagatgtgactttagactttgtggacagggtatgtgactaaatctagaggagggaatatcatcattaaagggagtatttcttggtatatttgtgggattcttgggagactggcatgactagaaaaaaggggtgctttggggaatgatgggagacaaggtt

SEQ ID NO: 111142 - DNA, 1029 bp, Homo sapiens
atcattctaaatataatcaatttcccccctatacatatgtccatacaccttgacatatgtgtgctacagttagttaatggtctataggaagtagatgaaaatgaagtagtcattgtaatgatggctggaacccaggtgaaagtaaaattttaaaaaggaaaaggttgaggactgaatcgtgagggaaattagcaattaagaggctggcagaagataacggacttaaattttctttttaagttttgagcagacatagtcaaaagcagaaaattgggaaagagtgttatcacagaaaccaaagaggggctaaggaggggtcagatgatatccagaagttgattaaatactaagaatcatcgaatggattaggaaatgggaaaaaatcacaatgaacagagcagtttctgtgcggtagcaaggacaaagccagaatgccatggattcagaaaggcataggacagtcctttccaacatgtacatcgtggtacacagagaaggtgatcagtattacttaggcagagaagactactgagtctgttttttactggcccagctcaatagaaagccactaggtaccacttggctacactgaggcttgagcatgttaaagggatacatagccttgtcacccttctaaaccctgcttaggagataaattgacagcaccagtggggacaatcagtgtagacagcgccaatcttggataaaaagcaaaggaggccaggcatggtggctcatgcgtgtaatcccagcactttgggaggccgaggcgggcagatcacgaggtcaggagtttgagactagcctgaccaacatggtgaaaccccgtccctactaaaaatgcaaaaattagcctgacgtggtggcacgcaactgtaatcccagctactcaggaggctgaggctggagaatcacttgaacctaggaggcggaggttgcagtgacccaagatcacattattgcactccagcctgggtgacagagcgagactcaaaaaaaaaaaagcaaaggagaaggctgggtgtggtg

SEQ ID NO: 111143 - DNA, 1004 bp, Homo sapiens
ccagctactctggagcctgaggcaggagaatcatttgaacccaggaggtggaggttgcagtgagccgagatcgtgccactgcactgtagcctggtgacagagttagactcgtctcaaaaaaaaaaaagttgctatatcaaccaataatttcatcaaagaattgtgaggcaaggctgtgttcactcagaaaccacatcatccacttcttttctctgctgtccagatttttcagtcattgctcggggtgtaaaaattttagtcagggtctagagcagacaattcttaaccacttatgctggttttgaatatttcagttccttagtcatttttcttttcaaaaatatgaaagcaaatcacgtttttggtaaaactcctttctttctatagagagaaatagcccggaaacttgcaaatcctaagcaaccaacaaatccttttctagagatggtcaaatttctgttggaaagaatcgcacctgtgcacattgattcagaagccataaggtaagccaagaagtatattcgctcaaaaataaataataatctgcaacgacaatgttgttaatttaaattctgggctcctaaagatacctgaaaacctctgtatgtctctttttaatcacagggttgtacatcattcaagttgaagggaaagccttctcattttatgatctttggctttatataatgctttctgtttttaaagagttcttatgtttatttttagcttatgcgttctcattaaagaaaacttagaacaaagagaaagacagaaaaaggaatattttagatctgtgtggctgttgaccaacctctgagttttcttaagcattttaatggccctgtaatattctgtagtacatattataccactgttcatttgatgtgtgagaacagaatggtatgttggaaagaggagaggattatctttaggcaaatttggtttcaaaacataagtctactttgtggctttggattgtctttgaattttcatttattttcaac

SEQ ID NO: 111144 - DNA, 1061 bp, Homo sapiens
ggctaactgttctgccatgtttggaaaactgatgaccatagcaagtgagtatgtttatttactcactaaacatgtagtaaacgtaaatgcagacaaagtatttacccagtgggactactgatttaatgttaagtaaaagaaaataatctttatcttaattttgtttctaagaaccagctaggctgattttcttttagtggctccgcaatattttgatggcacctgtttttagcttagtagaatagttttttttttttccttctctaatattgattctcttttaattttatagagaatttgcctgaccccgggaaagcacaagattttgtgaagaaatttaaccaggttctcggcgatgatgagaaacttcggtctcagttggagttattaattagcccaacctgttcttgcaaacaagcagatatttgtgtggttagtaaatcatacttcacactttttctctagctttacttacagaaatatgtattttattaaagcctgttttacatacagtgatttgtgtaaatgtaacaatattgtgagctctgaattactttggagtatatctattgtcaagttaattctctatttaccattcactctcagccacattccaggaaaataactaaagaactaagccagggagattggtcttaggaattttacaagataaagtactttgaacttagtagacattcattgagtaatgataagtattttctgaatgcttgtgtacatgtgcattttcttctttcatgtattagaatggaaataatcgtcaataaattagtagtagtaacattgccatatatctggtttcatttacagataaagtaaattcctatctagacttttgtcttcattcttctcttgaactcatttaaaaccaatattcttaaagctatcaggagggaaaacttatgcattcatttattcagctttttttttttttttcctgagatagtcttgcttttgtcacccaggctggagttcagtggcacaatcatagttcactacagcgttaaagtcctgtgctcatgtgatcctataccccagccttc

SEQ ID NO: 111145 - DNA, 1064 bp, Homo sapiens
tcttgaatctgcatcatttttgatacttcatttttcaaaatagtctatagtgcttcatgtatatgccttagcctttttaataaggccttcatgatttgatctgtgtctgtggaatgctccagcttccttatgctccacacacatgccttgtgctccaagcgtatacatgtttttcagtttgttttatgtcccttgcactttgagattttctttccttgtaccaaaactttctagctacctgtatttagtacatctttcaatccctgtattacttattaatctttctaaacctctcaaatattttctctcataagaaggcttatatttaccatttgtactaaattgttttaaatcctaataaatatatttcccggtatttaaacttttaggtagatgtagaagaatggtgtatatacagcatgcaacaagaaaggttgtaaagctgaataatttccagtattgttatgtaatgtgtgttttcatattcataactttacagagctctcaacgaaatgtggaagtgtcagaacatgcttcggagccatgtacgcgaactattggatttgcacaagcagcctacagtaggttcatgatttgtttaaattcatagtttattatagtcactgttcagattttctgtagttctacgtaatgaagcagggaaaaagtatctcagttgttttattttccaaatgtcagttaaatataatttctgtagttgtccaagctaaatttccatttaaaataaatataacaaactcttattttctagtgtgagcaaagaaatggtgttttctagtttatataaagttttcagacactaagagtttatagttaatcaattttcaaataattagaattaaattttgagataaaattacattaaacatcatatttctttttcactgcatgattcatggtctctcagtgtagagtgaatatcagatatcaatcctataaatatgccaatggcaaactaaaaaagaaatgccattaaatttttgcaaggttggggaaaaaaactttacatttttacgtgtgttcactagaataggtgttcttaa

SEQ ID NO: 111146 - DNA, 1050 bp, Homo sapiens
gggccgaggcgggcggatcatgaggtcaggagatcgagaccatcctggctaacagggtgaaaccccgtctctactaaaaataaaaaattagccgggcgtgcgggcgcctgtagtcccagctacttgggaggctgaggcaggagaatggtgtgaacctgggaggcggagcttgcagtgagccaagatcctgccactgcactccagcctaggcgacagagtgagactccgtctcaaaaaaaaaataaaattgtttgtaaagcctcttttgaagagaaatagtgtgccagtttataaaggcacacataagactgtacaacctaatgaagccaaggcagtctttggagattagtacagagttttgttatcttgctcatctaataaattttatgctttttagtggcgagtaagaaaagaagctatgatgggtctggctcagctttataagaaatactgtcttcatggtgaagcaggaaaggaagctgcagagaaagtcagctggataaaggacaaacttctgcatatttattatcagaacagcattgacgacaagtgagtttaatatgttggtagaatggttgagtgtaaaactactttttacttaaaaaatgtctatttaatattttagtaatttcttatttttatgtatttacttcataaataaaattaagtttattcaacttgattaatcatttatttctaagtttagagatagctttttacatatttttatgtactgtgtttaaacaagactgtccacgattataaggtagccttataatatgaaataggcatgaactttggagttagagaccaaatgttcactctgccctttattagatgtgtattcttacataggttcattaaggtcttgtgcgcttcagttttatataaaaaggaaaaataatagtgcctttcccacaggattatcatgtagattaaataaaataatgaatataaagcatcctagcccaatgtgtggcaagagagcactattgagttaactgctagttactttcctttttacaccactaccaatagaggaattactaa

SEQ ID NO: 111147 - DNA, 1035 bp, Homo sapiens
cccaagtagctggcactgcaggggcgggccactacacttctggctaatgagtttttttatttggtaattttcgtagagacggggttttgccatgttgcctaagctggtatgaactcttgagcttgtgcgacctgcctgcctgcctcagcctcccaaagtgctggtattacagttgtgggccatcacacctggccaacttgggagtttaaagtgcagttttgtgattacagtagagtactgctgctgtaaaaataacatgatttaatttcatgccatattttacaaacattgctttagtatggacaaaaacttaacatatttctgttcttgccattctaaatcatgacaaattacatagctaacatttagcctaagttttttttctcttattacagaatatttaaaggttagatcacatgatccagaagaagctattcgtcatgatgtcattgttactataataacagctgccaagagggacctggccttagtaaatgatcagctgcttggctttgtaagggaaagaacactggataaacgggtaaaatctgaggcattttattcttctgtaatttactgtttaaattgctaaatacaattgggtatcattttctgttacatttaatgtctttctgtgtgaaaatcaaattaataacaatgataaagagctcctaatttgtatgtttcctgcatatcttttaattatccttatgaataaatacaatggattctataccttttgagatcttaagcatgggtttcttttctatcataccttcataagagaaccactaagttaatcaaaattttacctttttatttacatgatgagtttcaaaagaatagtgattgatcgtctattcttatagttaacattttcacatatgactttcttgaataacttagctgggtctgccattcattgaactttacttcctaagaaagtgacgtttacatattgatgtgccaagctaaggacaataatgatggttatatgtttagttatttttcctgtgattttctccatttgatgca

SEQ ID NO: 111148 - DNA, 1112 bp, Homo sapiens
actcctggccacaagcaatccacctgtctccgcctcccaaagtgcagtgattacaggtgtcagccaccgtgcctggaatctcctataaacttattcttcaaactgattttgtgtgttttgaatattttttactttgtagcataatattaagctctcagattttaactccataaagtgtatagtttgggttgaaggatgtgtttgtttatactgttttttgttagttagttttagcatggtaaagaaattctgtttgtgaatatgtttttgtgaaattgtatcctttcaccttatagtgtactttatattcttccttcagaataccttagctcataacaaattttctaatcagtaactattgttgcgtataagtattttcatgttagatatacctgatttgagagtgattattttgccttacaattaatgtttagcaatctttttctgtgtagatttaatgatattcatgttcctgtgagattagaaagtgtgaaatttgccagtcattgtttaatgaatcacccagatttagcgaaggatctcacaggtaagctagctggtttattacacatattagcataaccatacaactatattgtagatatgacttgtgacctaacttcactttccaagtaggttttaactctggtatggtctcgtgttttcatttgttgtgcactaagaaatgatttcatgttcatgtaataaaattacatttaaaatctctttatttgtttgtttgtttattttaagagaaaggctttcactcctgggctcaagtgacctctcactttgagatcccgagtattacaggcgggtgctacaatgcccagcttaaaatcttcatattttaatcctttgaaattttttgaaaatcataatttaaggaagtagtgtatttcttaagacattggatttgggtagaaatcattatgtctatttaattaaatatagtggcatttaataataagtgggaacatgattatcttctgcactagactagaatttttcattcttttgaatctagagcatttaaatctacctttttggtagcagcacataagtggtttttatcagcaggctgttatttaccaaaaagaacaggggaaaca

SEQ ID NO: 111149 - DNA, 1599 bp, Homo sapiens
gattcttgcattgctattaaaatgagtttccatgaatcatgaaattctgtagtgtcgtattctccagtcgtaggggatccttcattaaaactttgtgtatcagccaggtgcggtggttcatgcccataatcccagcactttgggaggccgaggtggttgggtcacgagatcaggagttcgagaccagcctggccaagatggtgaaaccccatctctactaaaaatgtgaaaattagcctggtgcggtggtgggcgcctgtaatcccagctactcgagaggctgaggcaggagaatctcttgaacccgggaggcagaggttgcagtgagctgagatcgtgccactgcactctagcttgggaaaacagtgcaagactcctcaaaaaaaaaaaaaaaaaaacaaatttgtatatcaaaactttaattgatgtgtgtttatgttggaacgtaaattgcagatttcctataaagtaagcttattagggtggtaactgtaactttgtccttcatagatgtttttatagggttcttaatgttagaagtgaattgtatgtctcatatttgtacagtgtccataaccaatgtatagaatgcaattaatcagtgaagtagacataaattagcagttgggagggtgtgaaataagagcaaaaacccagatgatctaacatgaaattaaatcaatttctgcatagtaagtgaggacatatgatattttaaacttctcacagttataagcagaaatatgaaatagtatcttcttgagaatgtttcaagatattttctgtaatctggtgaataaagcttaggcttcactttctgttttcccttcttagagcaatgatggagaagagcgattagctgttgttcgacttctagctaaattgtttggctccaaagattctgatttggcaacacagaatcgtcctctttggcaatgttttcttggacggtaagagaacatataattctgatgtttatattttagaaaatagtcagtagggtgcagtccacttgattaaaactatacatatcaaaactttcattaatagatgttggtttcattgtcatctgtgtttccatccttcttatggaataaattgtatgaaaaattttttatgaagaaagcttagtattttatctgtgtaactctttttaacttctttgtgttaaaataatgtcatggccagccgtggtggctcatgcctgtaatcccagcactttgggaggctgaggtgggcggatcacttgaggtcaggagttcaggagaccagcctgaccaacatggtgtctctactaaaaatacaaaaattaaccaggggtggtgaccggcacctggaaccgcaactacgcaagaggctgaggcgggagaatccttgaacccgggaggcagagtttgtactgagttgagttcaagccactgcattccagccggagtgacagagtgagactctgtctaaaaaaaaaaaaaaagaaagtcattagaataaataaacagcattgcagtatattctaagtcttaagatctttaaatcatgaaactgaatacatactgatccaaatttaagaacctgtgccatttgtcagcctaccaacttttt

SEQ ID NO: 111150 - DNA, 1015 bp, Homo sapiens
tctcataaaaagaaaaaaaaaatcaaagattgagactttgtaatttttctctgctacaaggaaatttttctaaaatcctttgtaatgaactacacagactgtctaaattgttttaatgaaaacaaagattcctagaaatgtccttatttgaaatacacccaacaaaccaatttttttttgcttttctccttgtaacattcatgatttgatattattaggaaattatttcttctgctgtttagatgactgtcctattatatattagtaatcacacacctgtttgtatcacctccttcaattgtatatgtaatacctaattaaattatttataaaaaatgtttattaaaaatgtatccatgtttttaaatgaactggatgttttctttttgtttttaatatctcttacagtttttcaatcaagtcctggtgctgggaagatcatcagtaagtgatttgtcagaacatgtatttgatctgattcaggaactttttgctatagatcctcatttattattatccgtcatgccacagcttgaattcaaactaaaggtaagattgaccagttttctttttttttttttaatttttttgtttctagagcaggcacaatgtaaaattgaccaattttcatgccctttaaactttccaggaaaaatgtataccgcataatttttctgtaactgtagaagaataaagtgtgacttcaatttatctttttttttctttttttgagacggagttttgctgttattgctcaggctggagtgcaatggcgcagtctcggctcactgcaacctttgccccccaggttcaagcgattcttctgcctcagcctcccgagtagctgggactacaggtgcaaaccaccatgcccatataatttttctatttttagtagagatggggattctccatgttggccaggctggtctcaatctcttgaccttgtgatctgcccacctcggctgcccaaagtgctgggattacaagcgtgagccaccacgcctggccacaa

SEQ ID NO: 111151 - DNA, 1344 bp, Homo sapiens
agcatttcaaaaatacaattgatcaagaacgctttttatttgaaacgcttaccaggtctactcttctccagagcacgcattgattaaacaatgaaataattgagcatgttgtgttagatcagggagtgtatgtgtttaagatacgtgggtgtagttgtcagtttacattggttaacagataaaaccaaaaagcattaggtctgttttgagtttaataaaacaatatagtgttgtgcttttgctaactaacccattttagtttttgattaataaattagttcgatttgcaacgtctgcatttaagatcacttgactagaggatatttggcaaaaccttgaagagaactcagttatttttatttttgcttcatattttagtgaagcaaaattcatattttattacagatttgaagactacagtattctaatgttactatctcataaattaacatttatttgtaactttccatgtttttattatttttcagaacttaaataaacagtcctttgaccttgcaaaagtgctattgaaaagaacagtccagactattgaggcatgcattgctaatgtatgtatttctttctatgtttattctatattttgtaattcttaatccattgtattaatttattagaacctcttacataaaagtttatttagcttataaatataaaataacttatgtccagatgtgaccagggttagagaaatgcagcataagtttcatgacgtttttaaagggtggatattactataagaaaagtcgtctgcaactcccatccccttatctgcatttgtatttatgtttatttcattgtctcccagatatgctgatctctttcatattttccttgggtctctgtgtctctctctatatatttttttctttgtttcttttgggtcattcttctgaagtcctgtaatgtttcttccttttttttttattttatttttttaagattacagagatttatttagaaaatggtttggttgttttgcctgttgtttttggcaaagatttaaatacttttcagtaatgaaagattgtgatagttgctacatagtaatagttaaaaaaaggtttactgaggaatttgttctgggtttgtttttcctaaaaaaatcaataatttggaaaaaaaagtttgcaatctcactaccttatagcaactaattccattgttcatttgctcatatttataactattttcccacatactttatgaaaaaaaaattttttttgagacggagtctcactctgtctctgaagctggagtgcagtggtgcattctcggctcattgcaagctccgcctcccgggttgacgccattctgctgcctcag

SEQ ID NO: 111152 - DNA, 1037 bp, Homo sapiens
gaattccaggtgcccgccaccacgcttcactaatttttgtatttttgtaaagacggggtttcaccatgttggccaggctggtcttgaactcctgatgtcaggtgatccacctgcctcagcctcccaaagtgctgggattacaggtccgagccactgtgcccggcctttttcttttctttttaaaaaaaagtgaatggaagaaaatgtagtttattagaaattaggtttgtctttgtttttataaaatacaacagtaccttacaactgttgtaatagtcaacaaaaggagaaagaaaatagagcagccaaaatttctctgccattattggcactgtccctcaagtgaaaatcctttacatgtgagattgttgttttaaactaggacgtttaatttcctattagaagcttgaattctcttcttttcctcctcctactacttattcttttttttttttttttatagcaatagccacaataagaaggtacaaatgcacatgctagatttgatgagttctatcatcatggaaggtgatggagttactcaagaattattggactccattcttattaacctcattcctgcacataaggtctgtaaagtatgaagatattcaaggttaatgtttaacagtcacgccacacataagaatgaacagttgttttatggccatttgcaatcccatgtaattgttctcatgaccgttctccacctcaaataaaataacatgcattagtcttgtggctattatttttacaaaatatattgattaacatatcatgtaggagtttcattcatttaagtgctgttttctggaaactgaaaatgttttgtattcacacaaataatctgagaattgtaaggggttaggggtgttgccttttggttaactttgtttggaaaagaaatgtatttcctcctttttaacatagatgtgaaacataggagtttggatttcttttcagaatccgtatcgtacctttttcttaggtactctcagaaaaagatttgggcagaagctatatggttaatgttaaga

SEQ ID NO: 111153 - DNA, 1260 bp, Homo sapiens
tattctgatggaaaaactgtagattatttgaaactatatcttttgtttgtatctatttctttctttttttttttttgagacgtagtttcactcttgttgccaagactggagtgcaatggcgtgatctcagctcaccacaacctccgcctcccaggttcaagcaattcttctgcctcagcctcccgagtagctgagattacaggcatacaccaccacgcacggctaattttgtatttttagtagagacggggtttctccatgttgaggctggtctcaaactcctgacctcaggtgatccgcccaccttggcctcccaaagtgctgggattacaggcgtgagccaccgggcccggcctctatctttttatttttatttttttctattctaaaaacagatttttactgcttcttaaattttgtatggaaatatatctaccaacttaaaaatattgagtatttttcagtttgagaaaattgatgccatcaggtatatatctttttcaaggtcagaatatgtgattaacacttaaaattttatatgttgagtctttatagactttaatatgtttctaactctaaaaattaattttttactgagttttttattatataactattctgtatatatgtataattcaataattatttttatttatttaagaatttagcttgggttaaatcatataacatctgctttgaattggaagattgcaatgaaatttttattcagctttttagaactctcttctcagtgatcaagtaagttattttttaagcatttctgtttgtctctttttcttgattatgtattcagatgttgtatactctacatgtacactaagatatttcagagttataaggaattgttttccttagaaaacttaacataaaggggaaagtaaaaattctgttgtccgaacactgcctttgaccttatactacgaattttaaattatggtaccaatttactggttggctcttcagtcgcccaggctgtcctggaggccatggaccagtagagaagtataaagtggtgctcttgttttgaagggacttactatctaatagaggcaaccacatatggttgtaaagcaaatcgtctgaaaccttacgttaatacaatgaagtattaaattatgaggtagaaattatgcatattgtatgtaccattagttctgggagacgtaatagctcagtctttaagctcactaactttgacaacttcttattctagacctagaaaaaaatcttaaacattgc

SEQ ID NO: 111154 - DNA, 1092 bp, Homo sapiens
gtagtgaaaacctttatggatatggatcaggactcagaagatgaaaaacagcagtatctcccactagccttgcatcttgcatctgaattcttcctcaggaaccccaataaagatgtgcgtctccttgtagcatgttgtttggctgatatctttcgtatctatgccccagaagctccatatacttcccatgataaacttaaggtaaatacagcctttttcactttattgtatttttcattcaccactgttcagaaggtatacttttatttttatattttacctttatgaacataggtttcatattagtctcttcatcttaagaatatattgtaagttgcaaaattattcattcagttagtatttccacaaatgactgggttgcttggttgtttgatttgaagcatagaaaggtatagttcaaaactagtccctgtatgctcaaatccaattttctggctaattcatcacaaaagcccagatagctatgttccagggataaatagcagattaatgatactttttaaaataatagcataccagaatttacatattcatatgactattttcccctataagttattcagcatgcaaaactatatgctcatcttggttgttctgcctttgttcaagtgtttgtggaactcttaacattgatctcttggggagattttgtattttgaataatttcattcttggcaaattttaatcctgtagactgctttctttaaaaatagtcctaaaatcattttgtattatattgatactactgtgagttaaaatttctaaagaaagcttattaagaaatgaaagactaccatcatgaatcatagaaccattggactagtctgttgccttttttcacacacaacttcgtaatcatacatcaacttcaaaacattggctaaaaattactatttacttgtaggtaatagtaatggaaatactcatatccaactccttaaaatgaagatagtttttgccccgatgcaaggtggagatagtgagtaaagtgaaagcacgatagtagaagaaattataatgagatatagagcctgtggtccgctctgaaagagaaagcctaaagatttatag

SEQ ID NO: 111155 - DNA, 1031 bp, Homo sapiens
ttgacagaaggtacagacttttcataattcaggcttaaagtaagatgatttaagtctatacgttcaaaggagtttaagagtattatggccctttttatgaggtgtcagctaattttgtttaagcatggcagtcctaaggttaaggttttaaatttcaacctcatgtttgttagtttttttggtttctgttccactgacatagattgtggccagaatcttaacaaataagtaatattcttcttgtaggaacagcttgaagcagtggttctgagtcagggcaactttgacctccaggagatgtttggcaatgctggagacattttggttgtcacaattggtgctagattggagtaggggaagaccagaggcagtgagtccggctaggaaactgtaaacagtagtctaggtgaaagacgttgaaatcttcaggtagggctatggcattggtaatagtgactaggaaatgatttaacaacttttcagagttagaatcaatcagaattggtgggaggtgagggaagcaacattgttgacaatgtttccaccttgggccacttggccaaatgtattttagggaatgagcttggcctcttgctcttggagcccagtaaatgtacctaatgttgcattttaatgagtacagtatttaaaatattcctgtggtttagttttcagactcttaatttggttctgcaatttgttgcctttttggaaggaataagacaacagttcctttcattaaaacaaatctgtgtgcggcggcgggatctcagctcactgcaacctccacttcccaggttcaagctattctgcctcagcctcccaagtagctgggactaccagcgtgtgccaccacacccggctaaattttttttttttttttttttttgagacggagtcttgctctgtcacctaggctggagtgcagtggcgcgtctcggcccactgcaacctccacctcccgggttcaagcaattctgcctcagcctctctagtagctgggattacaggtgcctgccaccacgcccagc

SEQ ID NO: 111156 - DNA, 1034 bp, Homo sapiens
gactaccccgggtccgaggctcggctgggcaagggcgttttgttcccggcagccgccgctgcgcgtgggtccgctgggtccctagttttgcggcctaagccgagccctataggcctcgggtctggtttcccggaggggactggccgggcgggactgggtgcttccccaccgccgagcgggggccttggggtccttgccggcctcccggggccgccaaacttcggaccctggtgctcgggggtggatttcattgtgaaaggcggaatgggaaactcctggcgctgttcggcggccacggcggctggtgcggaggagccccgtgagcctggggctggcagggccgggttggcggggccggcggggttcgatccctgggaaagagcgggtggcgaggccgctgccgggtccccggcctctggggagacagggccttttccagattagagagatttgaaatgaaaaaagaggttacaaagtcgcccctttcccgctgaactttggttttctgaccgatagaggccggtagaggactgtgaaccaaaagttgtcccccaggatggacttcaccgcgcagcccaagcctgccactgccctctgtggcgtcgtgagtgccgacgggaagatcgcttaccctccgggggtaaaagagatcaccgacaagatcaccacggacgagatgatcaaacgcctgaaggtaagtgtctggacggattttgatgtctttggtagaaggcgctttctcctgtgatactgctaccctgctcagtctggcctttaaagttccaagttttttagatctcttaccccctctgaaaggtactgttgtatctcagataacatctttgagtgagttttgtagggatataaccattgtgggaaatttaaaaggagtgtgatttttcaaaaacttactggttttcaagcataagaatttgtgtttttagagttttttctggaggtatttaatgagaatactgttcagagtggcttgcaaacttaggtgtaggcagtaatttgcctaagaagtttactat

SEQ ID NO: 111157 - DNA, 1112 bp, Homo sapiens
tctttatcgttttattgatttatttatttttaattaaattaattaattaattaatttttttgagacggagttttgctcttgttgcccaggctggagtgcaatggtgtgatctcggcttactacaacctccacctcccgtgttcaagcgattctcctgtctcagcctcccgagtagctgggattacaggtgtgcatcaccacacctagctaattttttgtctttttagtagagacagggtttcaccatgttggccaggttggtcttgaactcctgacctcagatgatcctcctgcatcagcctcccaaagtgctgggattacaggtgtgagccaccgtgctggccaattttatttatttatttagagagattggtggggcggcaggggggggtctcactatgttgcctaggctggtctcgaactcctgagctcaagtgatcctcctgcttcagcctcccaaggtgctgggaccacatgtgaaccactatgcctggcctcatccactgtaattcttaaccacctttctgattatgaatttattttcattggtactttatttgtggtaaagagatgccctgtactatggacctgtgtattccaggtacgaaaatggtaagtccaacattttaaagaagttggccttttggcttatgctagcttataacaagtacttatttattgattgatttatttgagacagagtctcgctctgttgtccaggctggagtgcaatggtgtgatcttgactcactgcaacctctgcctcttgggttcaagtgattctcctgcctcagcctcctgagtagctgggactgtaagcgcgcaccaccacgcctggctaatttttgtatttttagtagagacggggttttgccatgttggtcaggctggtctcaaactcccgaccttgtgatccgcctgcctcggcctcccaaagtgctggggttacaggcgtgagccaccgcgcccggcaataacaagtatttattgagctcttgtttgctaaataaaacacttatctgcaagatgcttacagactagtagtctcaacaagtaaatacaaaggtgctaagatagatgtctagggtgcattgggagctgtggctaaatca

SEQ ID NO: 111158 - DNA, 1005 bp, Homo sapiens
cctaatgattttagcattcattgatgattcttgattagctatttaattattggttaaaaaatggtaattagttttgggttctgttgttccttatacatttagtagctagccaccttctataaagataaggtttctctcatcaactaaggctattttgttacctggaattagtgttctacttaaaggcagaatagatgcttagttactttcttttatacagactttttcagagtgcaatagtcacctccagtggcaataagtgcagtctttcttgtcttttctcttttgtcactttctttttggaatatcatatatattataaatattatagacatttttgactttgatttcttttgtgattatagtttgatgtgaatttgactttaatatataactttcctttcatagtaagaagacatgttggataacaagaagaggtgtagagtttgcatatatcaactgtggccttaatgagcatgttgacagcatcgatgctagacagacagtaagtgttattaaagttgtagagtatgaatattttacacataagatttttttttttttttaaattgagtcttgctgtatcacctaagctgaagtacagtggcgcaatcttgactcacttcagcctcaaactgctaggctcaagcgattctctcacctcagcctcccgagtagctgggactacaggtgcatgccaccacacccagctaatttttgtattttttggtagagatggtttttgtttttgttttgtttttttgaggtggagtttcattcttgttgcccaggctgtagtgcaatggcatgatctcagctcactgcaacctctgcttcccaggtttaagcgattctcctgcctcagcctcccaagtagctgggattacaggcgcatgccaccacatccagctaattttttatttttagtagagacaagttttctccatgttggtcaggctggtctcaaactcccaacctcaggtgatccgcccgcctcagcctccc

SEQ ID NO: 111159 - DNA, 1033 bp, Homo sapiens
tgagatcatgccactgcagctcagcctgggtgacagagggagactgtctcaaaaacaaaaacaaaaatctagagttgataagacctctgcttaccatgttggaatattatgatgataatcagtgagcaagtattgattagattttacatcaggttaaaattatataatagaggtagaagaatttgaaaaatgcatatattcatggtattgttaataattatttgttttgaggatgggagggggggatatatttgtttttacattgttcatttgagccagtccattcacatttctccataatatatcaaactttacttatgcattcttattttctatatccttttcaaatacaatctctgtttaggtcaggtatgtatatgaagatgctatacaaggttgtttaaactaatgtattaataaggaggctctcatgaaaaaaggaagatacgtaagattagatgataaaatagttaaacctgagcatcacttacagtagaatatgtgggattgagataaactggattataagtagaacaggtgattgggagatagtgtgagctgtatatatatatatatacacacacacatatatatgtatatatataattttttttttttgaggtggagtcttgctctgttgccaggctggagtgcagtggcaccatctcggtcactgcaaccactgtcttctaggttcaagcaattcccctgcctctgtctgggactacaggtacgtgccaccacgcccagctaattttttgtattttagtaaagacagggtttcaccatgttggccaggctggtctcgatctcctgatctagtgacctgcccgcctcggcctcccaaagtgctgggattacaggcgtgaaccaccgtgcctggcctatatatgtttttatacatcagaattttcttatttatttatttatttgttgagatggaatctcgcccggctggagtgcagtggcgtgatcttggctcactgcaagctccgcctcctgggttcacgccattctgctgcctcagcctccc

SEQ ID NO: 111160 - DNA, 1050 bp, Homo sapiens
tccacccacctcggcctcccaaagtgctgcaattacaggtgtgagccaccgcgcccagctaatttttgtacttttagtagagatggggttttaccatattgcccaggatggtcttgatctcctgagctcagagtggtctgcccacctcagcctcccagggtgctgggattacaatccaggtaggcgtgagccaccacacctggcctacaaattttgatatggtatattttcattggcattcaatttattatattttaaaaattttttcgagacttcatcattgacccatggattatttagatgtatattgcttggaaatttttatgttactgatttctagtttgattccattgtggttggaaaacatacctgtgtgatatcaattgttttaaatttgttgtggtttggttttagcttaggatatgatctatcttggtatgtgttctgttaatacttgaaaagagtgtgtattttgctgttgttgggtggagtgttctgtaagtgttgattagatccttaattattggtgttgttgagttctatatatttgctgatttactgtctagtttattctgtctgttgttgatagagtggtgttgaagtctccacctataattgtgaatttgtctatttctcctttcagttttagcttcacttattttgtagctctttttagtgcatatacatttagggttgctatatcttttttatttttatttatttatttatttttgagatggagtttcgctcttgttgcccaggctggagtgcaatggtgtgatctcagctcaatgcaacctctgcctcatgggttcaagcaattctgccttagcctctcgagtagctgggattacaggcatgcaccatcttgcctggctaattttgtatttttagtggagatggggtttctccatgttggtcaggctggtctcaaactcctgactttaggtgatctgcccacctcgacctcccaaaacgctgggattacaggtgtgagccaccgcgagtgcagtggcgtgatcttggctcactgcacctctgtctcctggg

SEQ ID NO: 111161 - DNA, 1661 bp, Homo sapiens
ttgtccaacgtgctgggattacagtcgcgagcccctgagtctggccagggttactatatctttttttttttgagatggagttttgctcttgttgcccaggctggagtgtaatggcgctatcttggctcactgcaacctctgcctcccaggttcaagcaattctgcttcagcctcctgagtagctgggattacaggcccatgccaccacgcctggctaatttttgtattttagtagagacagaatttcaccattgttggccaggcccgtctcaaactcctgacctcaggtgatccacccaccttggcctcccaaagtgctgggattacaggcgtgagccataacgcccagcccgctatatctttttgatggcctgatcctttatcattacacagtgcctttctttgtctgtgataattttctttgctctgaattctgcttatgtctgatattaatatataaatgtacttttatttaattgtaattaatttaaatttaaataggaacatatggctggtggctgccatattgacaatgcagttctggaaggtggagagagctatgatacaaatttaattaaaaggtaaattttataacacaatagaagatgataagggcaatggatagttagcaggaaaggggagattggggcagagggagcagggtatatgattttcagttggataatcaatagagaaatcattgaatgtgacacttgaacaaaaatttgaaggagtacaggagttagccgtgcagatatcttgaggaagagtatatcaagggctagcagagagatacgtcattgtaagaactttagttttttctctgagtgatatggagaacatataggggtttagatcagaccctttttacatcgtataaagctcagtctggctggtatattgaaaatagactatagggggacaaagttgcaaacagggagaacaggtaggaggttggaatatggttgaaagatgacaggtgtcagacccaatgattagagcagattttgggaaatatattagacatttagttttggatatgttaagtttgaaatgtttattagatatattcaagcagagaaaacaagtagactgcctgtagttctattccaggtatgagtccctgcccttgtggagcttacactttattggaatatgggtggtaaatacaatacgtatgtaaaacatatgctatgtaagaaaacaataagtcctatggagaaaattcaagtaggaaagtgggataaatggtgttggggctctgaggtcctgagaaggtaacatttgaataatgataagaaggtgataaggagatacttggagaaaagtggttcagtagagggaaccaaggtgtaaaggttcccaggggagaacattgctggtgtgtttgaagaagagtgaggagacttaagtgtggctaagggaaaggacagtacagaggtaaccagtgtccaggttatgggccattttaagggctctggcttttgtcctgagttagggagctagtggatagtttagtagaagaaaggcatgatccaccatgtggtttaattgagtcacgctggctttggtgctaaatagactgaagcggcaagggtggaaaccaagagataggagacttatagtaattcaggcaagaggctgtggtagctaagtctagg

SEQ ID NO: 111162 - DNA, 1136 bp, Homo sapiens
tttaaaaatgaaaaaatgtattgaaatagtgtattcattgttctgaaatacatattgttaacatcttaatttttaacatgttcaatcctggcaaaacctgcatattttgaagagagagaaattgactactttttagctctgctgttagagttggtggtactttcttagagctaaataaagatgtcattccgattttagaaatggaaatatatatagtctgagtgtttttaattgctttctattttaggtctttttactgctggattgtgcaagatatttaaccctattttgtttgaattatgacttaaatgtcaaacatcttaactaagaaaagggaaacattttagttttggaagtcagaatgccaaggagaaggaaaaatcttgggggaaatccttttcggaagactgcaaaccctaaggaagttgtcgtatccagtgttgctagtcgtgaggagccaaccactactctaccttccatgggtgagacaaaagttgatcaggaagaactcttcaccagtatctcagagatattttctgatctggatcctgatgtagtgtatttgatgctttctgaatgtgatttcaaaggtgagaaaaagtttagtttgaaccctgtccatcttataagaagactttgtgtactatgccatgattaatagtaatatagaaaaatgtcttgtttctattttattcataatttattaatcatctgctgttggcaagttactaaggttggtatttgagttggtatttgggatatgaagaataaaacatattttctgctcttgagaaatgtgcagttctaggtgtaaggtatttgtatagatagcatattctgtctctttcatcttcactctagaacagactggcactgttgacacttcaggctacataatcctttattttgagtggctctcctatgcattgtaggtttagcagcgtccctggcctgtacacgctagatgccaatagctccttaccacccagttgtgacaataaaaaatgtctccatgtattgtcatttgtcccctgggaggcaaaattgtacctcgttgagaaccactctcctagaatgtaagctccataaagacagagtttttaaaaactttgttttactcctgtatcttcagcccg

SEQ ID NO: 111163 - DNA, 1343 bp, Homo sapiens
gctggtctcgaactcctgacctcaggtgatccacacgcctcagcctcccaaaatgctaggattacaggcgtgagccactgcacccggcccatgttttaagattttaataggaataaaattgcatttttcctaatttgtgtttttttaataaagaggaatgttgaacatttttgtacatgtttgtttattcttgtattcttgtgtaaattgttcattcattgaaaaaaaatttttttataccatggttttaatttttcccagcaatctgtataaggactttttttaatgtgataagtacctatccattttgatctttaatttacttagtgtaatttttcattgtatagacattaagtttttagttgatcttttctggttttactgtcatgtagatttttttcatagaaatactccttacgtttgctttcttttttttcccccgtccctgcccacccccgccacctttttttttcttccatttttaggttttctgtcctttgtagtattgctatgatctcctaattggtctctgccaggcttgccccctccaatccctctttgtttttcttcttaagggaacttaattgggtgcttactaggtgccagttcttgtgcacagcactttttcatggattatctcatttaatcctcacagcaacctatgaggtaggtgcttttattatccccatattacaaatgagaaaatcgaggtttaggaaagttaacttgttgaaagtgtcatagccagcagtagagatttaaatgttggtgttctgactccagaccagagctgttacctactctgctgtgctgtttccagacttatctttcttaaaacagcaagacaaaacacaaaataaacaacccctccctccaaacttcagatgcttaaaaattcttattttgtttttttttttggtttccttttttttttgagatagggcctcactcagtcgcccaggctggagcgcagtaatcactttcactagaggctcactgtagcctcgacctcatgggctgaagtgattctcctacctcagcctcctatgtggctggtactatacgcacatgctaccacactggttaatttttgtagagacagggtttttccatgttgcccaggctggtctcgaactcctgggctcaagcgatctacctgcctcagcctcccaaaatgttaggattataggcatgagctgccacacctggccttaaaatttctaatggctccctatttgtgttataacagaacgagctcagcattggagtcagatataccagtcctggctctgtcactgactatctgtgtgacttgggtcaagttaatgtactttttaacttca

SEQ ID NO: 111164 - DNA, 1009 bp, Homo sapiens
tcactaccacctctgcctcccgggttcaagagattctcccacctcaggctcctgagtagctgggattacaggcatgcgccgccactatgcccagctaatttttatatttttagtagagatggggtttcgccacgttggctaggctggtctctaactcctgacctcaggtgatccacccgcctcagcctcccaaagtgctgggattacaggcatgagcaaccacgccaaaaagtgtgcattatttaatctgtattatattacagtgtaattgtctctaatataattgttttaaatctctattagattgcaaagttctttgagcatattaaagatttttttttacaaaatatttctgatatgcagtacatgctcaaatattctttgtagtaagtgaaattcatagcgtggatcatgtaaataagttagatttactaagagaatacataaaatacttaatatttaaaagtttgcatgcaataggtaagtatttgttaaacaacaggctttaggacttttataaataagcctaatatgtccaattacagatatttatgtatttactcaattcagcaaataatatttatttgatgatagtttattagcttggtttattactgttttcctgaaagaataggattgcatgtctccatcattcagactttttgctactacagactttggtatgttaataaaatattaattttttaaaaataacatgaatattgtacatttatattctgttcaatgcaaaatccaatataattttagctggattttaataaaattattaaatctgttttctctgtctatatttttgttgttgttattattcttgttgttgtacagttgaaaatgctatggattgtctattagaattatctgccactgataccaagatagaagaatcatcttcacaaagtttcgttgcttctgagaaccaagtaggtgcagcagaaagtaaaataatggaaaaacgtcctgaagaagagagtgaagattcaaaaatgga

SEQ ID NO: 111165 - DNA, 1025 bp, Homo sapiens
aaatctactcgggtctctgatgtgtttctaccttccgaagggttcaacttcaagccacacaaacatcctgaactgccaactaaggggaaggatgtgagttactgcccggtacttgctcctctcccattgctgttgcctcctccgccacctccaccgatgtggaatccaatgattcctgcttttgacctcttccaaggaaaccatggctttgtagctcctgttgtaaccacagctgcacactggagatctgtcaactacacatttccaccctcagttatttctcacacttccccaacaaaagtatggagaaataaagatggaacaagtgcttatcaagtacaagaaaccccagtttctcaggttgtaagaaagaagacatcttacgttggactagttcttgttcttctcagaggtcttccgggatctggaaaatcttttttggcaaggtatgaggtttgattgggtttttaaaaaatagtataatgtctgaatttgaacacaagtatgaataaataggcaaaatgctttgcttagtagagatctttagtaacccctaaaatgttttctttttactaaggtttcctaactttgtgtagctaataacactgttttctgtggaagtttattgaaaccgttcatcttggaatatctctttgaaagacagaagaaaaaattaaagacaatttcaaaattgtgagctattgatgtagtagtagaagagagctaatttgagtgggagaaagatgagttcagctttgatcacagagttaaagagatataattgatcttgatttcatggaatggaagacttaaatacattaattttactggtagttggaaattcaggattatagagtgttgttaaataatgcttttagaaatgtgtgatttgaaggaagagagtataggatgacaactggtagtcagagaacttcaagttttcagggacttttctgttccaaaatagagtaccatcagttatttgatctcatatatacacctttatcccttctgtagttaaggta

SEQ ID NO: 111166 - DNA, 1040 bp, Homo sapiens
aatatgttcttttatttatctctttgtgtttaattttttttcttttttgagagagggtcttattctgactccagtgcagtggtgcaaccttggctcactgtaacctaaaccccctgggttcaagtgatcctctcaacttagcttcccaagcagctgggactataggtgcacactaccacacctgcctaatttttgtcttttttgtatagttgggttcttgctatgttgccgaggctgatttttactcttttattttatttatttatttttttgagatacagtcttgctctgtctcccaggctggagtacggtggcgcaatctcagctcactgcaacctctgcctcctgggttctagcaattctcatgcctcagcctccctagtagctgggactataggcgcatgccaccgtacctggctaatttttgtatgtttagtagagatgggatttcaccatgttggccaggctggccttgaactcctggcctcaagtgatccacaaaatgatagtacttgaataatttattttgtttatgactttggaaaaattaggagagaaaatttagaagaaaaggtaatgaaaattatttcatttatctttcacaggactttgcaagaggataatccaagtggagtcattcttagtactgatgattatttttatataaatggacagtaccagtttgatgtaaagtacttaggagaagcacatgaatggaaccagaatcgtggtaagaacagataatcagattctgggtaacgttatgagtaatacaaagaaaaaattcacttagtatttgtttgtgtgtttgtttttgttttttgagacagggtctcgctgtgttgcacaggctagagtgcagtggcatgatcttggctcactgcagccttgacttctgggttcaggtgatcctcccaccttagcctcccaagtagctgggaccacagatgtgccaccatgcctggctaatttttgtattttttgttgtccagcctggtcttgaactcctgggctcaagcaatctgcctctcttagcctcc

SEQ ID NO: 111167 - DNA, 1229 bp, Homo sapiens
agcttttataattttaatgtaatttatttataaaattttcagaataactgttaagtgccctgtcaattaatgcttctttaaatcatagtattgatggcagcattaagagactttctcatgatactctttaaaataatcttacagcccaagagacgatgaagatattatctctgaaaaagaagaaaatattttatctttatctttgaagcatctagagttcactgaagagaagaatcttgatgtaaccaaagaaacaatgttacctgagaatgttgcatatctctctaatgcagatttaaacaaaagaagaaaagaaataagtgatatgaatcctagcattcaaagtgctttaattctggaaactccacacatgtatttttctgactctgaaagcaaactacaggcaacagacaaaagtgaaaacgagcaaatagaaatggtggctgtaaaagggtatagtaaaactgacacagatagttctatggagagagtatcacctagtacttgctgtagtgaaaataatcaagaagactgtgatcttgcaaatagtggaccacttcaaaatgaaaaatcctcacctggtgaaatagtggaagaaagagcaacagtaacgaaaaaagcctttgggaaacaaaaaagcaaatcgactttggaaaagttcccaagacatgagctatcaaattttgttggtgactggccagttgataagactattggtcagaggacaaaaaggaacagaaaaactgaaaaaacttcatccgtacaaagcgacaaaaagtataattaccctcagtcacacaaattagttaacagtgtatctgtgaatacagattgtgtccagcaacgaggatctccacatgaaagtgtagaggatggcagaaagtcacagtgtgatgatgcttcagagccactcaatagctataaatatgatgcttataaaaatattgacaaaaactcattcaacattatgggtgactggccttcatctgattctttagctcagagggaacacagatcaagaatgccaaagactggtttaagtgagcccaacctagaaattggaacaaatgacaaaatgaatgaaatatccttatctacagcacatgaggcctgttggggcacaagctctcaaaaactaaagacattgggtagctccaatctaggaagttctgaaatgctgctcagtgaaatgacctgtgagagtcagacttgtctaagtaaaaagagtc

SEQ ID NO: 111168 - DNA, 1148 bp, Homo sapiens
ttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccagcgatggccaaatctctgaccatagactgtctggaattggcattaccccctgaactggcttttcaacttaatgaattatttggtcctgttggtattgattcaggtaaggaaaaagtaaatgaccatgtgtgtgtctttgtgtgactagactacagagggttctattttgtattttttttttttctgagatggagtctcgctctgttgcccaggctggagtgcagtgcctcaatcttggctcactgcaacctctgcctcccaggttcaagtgattctcctgcctcagcctccagagtagctgggattataggcatgtgccaccgtacctggctagagagttctattttgattgtaaaattatattctatgttaactgaaatgcaaaagtaattttatgttgcctaacttcacatagtgccttatttttgacacatttctggaggactttaaaaaatacaataggaagaaataga

SEQ ID NO: 111169 - DNA, 1050 bp, Homo sapiens
tgtggaacacctagggtatgctctcaaagcatttcctgttgaggttttgctctgcatgaaagaaaacttttggtttgagagcaacagagtgttcatgtgtttgatcaagaacatcattgaaatattacttggttattcaaagtttttattgatgtcagtattgttagaccacaaaacccagcctgctttttggtacatcctgccaacttgaaaatatttgattccagatgacttctcttagatagtgttgtcttcagtgactgttgcagggtggcagacctgttattaagcatcctccttttgtgcctgagttcctccacatgcctctgttgtccagtccacactgggaccaaggcaaggagtttcaccttgaagattcttaggatccactttggtccagacctgtgctcatgtcatagcctcaagagctacagctgatgtagggatagaggtgcccaaaggatggtgtgcaaatgccagtgtctattgtttcttcactctctaggacagcagaggaatgtatcagaatgtgttgatactcctctgagaagttgaaatgttacacattaaattctgttgttgtgaacttcctagaatgttcagttccttattttgaatatcatttgcccactctttattgtgtgccttcactgagttacaggtttgccaaagtaatcgatcttcttggtccttagaatgggtggccagagcagactgtagctgttatggttgctcacttccagctggctacaacttcctctatttaccagtgtcctgtatacatgtcactatgttttgggttgatatgatatgaaaaagagtgggaagcattgagtcagtttaaaattatacacagcctggccgggtgcggtggctcacgcctgtaatcccagcacgttgggaggccaaggcgggcggatcacctgaggtcaggagttcaagaccagcctggccaacatggtgaaacccccgtctctactaaaaatacaaaaactagccaggcatggtggcgggcgcctgtaatcccagctacttcggaggctgaggcag

SEQ ID NO: 111170 - DNA, 3795 bp, Homo sapiens
ttcaattatgaaacaaaaaaattatgatgtttttcaaaatgcaagtgaggtttgattttttactgaatcaaatgcaaatgttacctgttaaagatattacagagaaattttattgattacaaaatatgtaagaaaattatcagctacagttttaaagtttaaaatgctctgattgtttctcagaaaaggttacctttgtattaattgttgtatgacatttagtaatgtcctaaaagtcttttgtgagaggtatttaaagtgctttgagacctgattcatgccccccaaagggtggtattaaaagaggaaaaaggacatagtagtggtagtaaagaaaaaaaggagatctaacaaaaacacttgaatattttttattttcaaaactaaacacataaaatgcttttattttgccatatcctacaggaaggaagacatgcttttgccctttcttctgctttgtatatgaccttgatcttttaccttttgttctgttcttctgtgtgcattttatggaaagaaagttgggtctgagattatattgtaattttatactttctatagacagaaaggttttcagagaaaaagaaatggttaaatatcttccagatgttgctgccttatcgaaatgcttctagaactgtctgtataagtcgtatttcagacagtactaaatacttatattttatttttgaggcatgtaattttaaaactgcagtaggttaaaattctattaaacaaatatagaaaatattttgtttataattggcctggtgtggtggcccacgcctgtaatcccagcactttgggaggccgaggtaggtggatcgcctgaggtcagaagttcaagaccagcctggccaacatggtgaatccccgtctctattaaaaatacaaaaattagctgggtgtggtggcgtgtgcctgtaatcccagctacttgggaggctgaggcaggagaaccgcttaaacctgggaggtggaggttgcagtgacccgagatcgagatcacaccactgcactcagcctgggtgacagagcaagactccgtctccaaaaaaaaaaaagaaaaaaaagagaaaatattttggttataatcataagaagaatccttacaatttaaaatattttcacttttattttgaaaaagagccaactttctcaaaggaagctgtcattaacttctgttgtttggttagctaataaattctgttagtatgcaagttaaacctgtgtaaaggaggttataatgtggtaaggtataattttccaatatgagacaatggcttaaatttgcctttggagatggagaatattttcaacatacataattttaacaaatagttttgttgctttttgttaagcttaaaaaaaaatttggatcagaaattataggattgagctggtaccaaaagaatcctaaagtacagaatggttttccaaaagagcagacatttcaatgaaaataaaaccccaaaacattttttttatatatcatgattgcatgcttttaaaataaggaggcttatcattgaattttagttccataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatattataattatgattaatgaaggagcagtcagaagtagaggtgtggtattccgtgggcagaagtcaaatgaaaaaagctatattgtttacttgtttactatatcaatgttaatattatgccttattttgataaatcaaatagtatatcttaatcattgttgataaatatacaggcaaagtttgagcatcatatgtatttttatgaagctgcttaattccaaattgcctcccaccccactatctagcatagtttaagcaacacataattttgaaagaaaagtttgtaatccctcctttcttttttttgcccatttctaaatcctgtatgcccgcagtaaagatagtttggggattttaaaagttttctctattacccatttctaaatcctgtatgtcaaagatagtttggagattataaaaattttcatgtattggtgtaggttgagtatccctaatgagaaaattcaaaatctgaaatgcttcaaaatctgaaatttttcgagcacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaattcaagtttacagtattacttaatgcttctttacagaatttaatagagaaacaaggctagaacacatctacatcctgaagagccgtttataacttcatattatatgatgacaaagttcattattttccttaaagttgagcaattgacttttatggtccaatgatgaacttattattaataaatgattgagttaactgtgaggcttctcattaaaatacaatattgcagctatcagttggagaatatattataaaattttcagacagtatatcagaaaaatgtttttatttgtactgtatagaaaatgtaattttg

SEQ ID NO: 111171 - DNA, 1136 bp, Homo sapiens
ctaatttattgctttttttgtagagacacagtctcactatgttgcccaggctggtcatgaactcctggcctcagggatcctcctgcctcagcctcccaaagtgttgggattacaggtgtgagccaccgcgtccggctgccaagacatttttatcctcgtcaacccactgtccctgttgtttaattatacctaatagcttttgcaaatgagttagccatataaataattcacatgatacatattcatgtttttaaacacatgtaagccaggtgaccttggccaaattacttaacctctctgaaccttggttttctcataaaaatgaaaataagaaaaggactttcctcatgtgatcactgtaaggattcagaatgtggagagtctgatttagcacaaaacctggcatctgggaattataggaagccatcgagttatccatttcactactatctgaaatgccaaatcctgaatgtccatagcggagggaccactttgccaaatgtttacctggactctttctccagactcacaccaggttactgtcacacaccgtggtcatggaccccatttgagactagacctttgaggaaggactccttgagggctccataggcttccgttaaactttagatccttagaccaagaggcaacttaaatatatgcatttgtgacttagtccagagccaagacctcttaagacatttctatgttttatttttttaatttaatttaattatcttattttttataaatagagtgggggtctcattatattgttcaggctggtctcaaactcctgagctcaagcagtcctcccacctcagcctcccaaagtgctgggattacaggcatgagctactgcacctggccttaagttttatttgaccccagtgtagcagggccagaattaggaaaaatgtacatgcttcggacatttatttatttatttattttaattttatttttttgaaatggagttttgctctgttgcccaggctggagtgcagtggctcgatctcggctcactgcaacctctgcctcctgggtttaagcaattctcatgcctcagcctcccgagcagctgggactacaggcatgcactatcatacccagctaatttttgtatttttagtaca

SEQ ID NO: 111172 - DNA, 1037 bp, Homo sapiens
ctggtctggaaatcctgacctcaggtgatctgctcgcttcagcctcccaaaacgctgggattacaggcatgagccaccacacccagcagcctttaaacttccatcacagaaacctgaaacgaataggcagagtccaaagctccatgttagaggctggaagttctgaggcctgcaggaacaagtgagagcccttgggagccaaagcctggccctcaagtcccgacttgcccaaagccatctgtgtgtcttgggcaaagaggagagtcagtttcttcatctgtaagatgataggattgggctaaatcctccctgaggtccccttcaactccaaaaaatgggagtccagtaaataacagagaagccggggaaaatgttctgccatgttgatttaggtttgagctcaatgaaaggatctacactaacaagagattaaaaaaaaattgtatgggtttgcatgcagtatccagagaagtaaggtaaatacagtttgaggcctggatttatggattatttccttctttctgacttttccatttgttaaacagagatagcatcaatatctgtttactcaatgaatgcctagcagacaaccacacagtaagtgggttcagttaaaaaaatatgctctgacaataagggtgaaaatagtgacagccaaggcttggatggaagacctcacttctggtcagtgagtgcatgtgtgtggcctggatgagccatgtcaccctcctggacctcatctcttacactaacacctcacagggtcatccagagcatcagatgaaagcatcatcgaatggaaaaaagggagtttggagcaagagatctaagtacaaatcctgattctgccaagcattagttacatggtcacagatgagtcatttagcattcctgaaccttagcttccttgcctgcaaaatgagtcaagtaataataacccacagcattgctgtgatgtcataggagacagtgtacacaaagtactttataacctctagagtgctgaccaaatgctggcaattgttataataagacaa

SEQ ID NO: 111173 - DNA, 1158 bp, Homo sapiens
gtcccctcctccccagattcccaatcccaccgcaatgtttggcaagcctaggactgataagtagctctgatagaggagctggtggcttttatacttcttcctgggtttttgttggggtttgttgtttcgttgttttttgtttttttttttgtttggttggggaagtattgtcttctacgtgtgctattttcagtagcagagtaagcacaaggttttaatcgagttgcataagacacctttgcatagctatttaattgcccaatgtaaaactttaatgccatttctaatgcttttattcatttttgaagtatgagtttgtagggacaaagaatgtatgttatcgtagacaagacccccagagactcttttcagcagaaagttatgcttctagttgccttaccatgtttcttgcaaaactgtccatggtcctcaagggtgttggaaacattatgtttattaaatgggcctctcttcctttgctgtgcacttgatgggtgaactggattggggtgtgcacatccaggaggaggaggagagacctgtagaagtttaaagatagtttgtaaatatcttctaatgcttgtttttagtccttttatgttggagaagttcatggtatgtagtttaatgcaaaatgaaaccattttatttcaatgttattaaaaaggtttgttttattaggaagttaatgtattgttgcagtgttttgtgcctgtttaaaggcttttgtttagcagagtgaatgtaaaatacagtaaaatgttaagattgtcatctactttttaaaaaaaaatatcaacttggaattgttttttaaaggctcaatcaaggaagtgaggtgtgcaataaggtagcaagtaaaacgcagttgcgtttttatgtcatgttagagatccatacaattttccactcacgggatttttgttgatggctgaattcttgtggattcataagaggatcatgcccttagcaagtacttttgttttgttttaaattaagagattcccaaatgcctttttccccctcatcttgaaatgagatgagtttttatgtgtaagcaatatttatttaactattctataaaattattgagtgcctactgaggcctttaagcaccgctaacattcctttccatcattcttttaaatgacataaaat

SEQ ID NO: 111174 - DNA, 1034 bp, Homo sapiens
agcctggatatgggagtcgtcgcttctacttgttgagaagggaactccctttggcaagttacggtagcttaaggtttaacaagagaaaagaactgttaaataatctttaactatgtaaagttgtgtcctggagcctgaggtagaaattcctgtgggctgatagccagaacaattcatttacttcatacaaccccttgtagcttaaactcacaaccctctctgggccccatcgattggcgtctatttctgatcatccagaaaatgagaacattgtattttaggagaggcaccagggtggtggtgaagtatctgggcacaagaccagtggaagatatggttggaaaggcaggtaaaagatttgattaaggttttaggtatattttatcgaatggctgtaccattgtttagcttacaatcatttgtctctttacctttgattgagtctgtcctatttagaataaatgtacctacagttggagaaaaccagaaatagaaagattctttgtgtacacatttcatatttttgtttgtcctttcaacacacacacacacacacacacacacacacacacacacccccgccccacacacacacactcacacaaaagggctgatatcttttccttttgatctcttcttactgtaccttgacattcaatagctgctgtttgaatctctggttgaaatcataattttggactttacttgcagaaattctttgaattgggaggtcccactaaaagccaatcactccacatcttcactactttgcgtgggcatgaggaaactggggaatgtgctatttttttttaccatgtgtttttccttgaatcggtaatgttgaaatctgaaatacagggtggggaggatgtacacaggtctgagttctcagaatgaaaccctcaacagcacctgtttcttaaatagtggtgaaagtgaaaaaaaggcagtgcggctggtaatgagtgaggtgagtaggaaggaacaggcaggcccaactctcacaggcagtaggcttcaagcctctgatctca

SEQ ID NO: 111175 - DNA, 1095 bp, Homo sapiens
aatgaggaaggtggaccagcaaatccccttccaaagctaactttaaaaaaaattatttaatagtatatatatatgtattatatatatatatatgtattttatatatatatatgtattttatatatatatatatgtattttatatatatatatatatatattttttttttttttttttgagacagggtctcaccatgctccccaggctggtcttgaacccctgggctcaagccatcctctcgcctcagcctcccaaagtgctgggattacaggcataagacaccacacctggccacagttttttttttggcgggggggagggggtggtgggtagtctatgaatgtttttctttactgaaattgcagatacaatcctagaaactcaccctgcaagtttgcctcttgtactaagaagacatgcttaggatgcaaatctaggctgaaatagaatgttggaagcatctttaccagcctattaaagagcaaaggtgtagccacctgcaattaagactggggcagttaaatgccgagaaccgagggctgaggtctgcctccagcaccgtcactgttggttgctgatcatcttttgtgttgttattacaagcaggcagcataagaggccgagggcgaggtgcagctggcaacagagccccagggcctaggggttcctacctcgggggatattctgctggtcgtggtatatatagccgatatcatgaagggaaaggaaagcagcaagaaaaaggatatgaactggtgccgaatttggaaatccctaccgtcaacccagttgccattaaacctggtacaggtcagtatgaagcagattgagaatgctcccattcagcataaaccccagcccttctgtttgaagtgaatccaagcgtttttcaggctctcacatctgcacaggggttcctcttctcctaggcagctagagacaaggcaaaaataaagtgaccccctggacctccttatctagaacttcaggggatggtgtagctttgactatgttcaaatcaaacttgcctgagtaaggtttttttttgtttgtttgtttgtttgtttttttttttttttgagacagagtctcgct

SEQ ID NO: 111176 - DNA, 1068 bp, Homo sapiens
gacatcatggcatccacaggtgcatgcctgagctttgttccttggaaacaatgatcggaacaggagaggtgtcatgggagcctttgaaatgtgcccttctgaagtggagggtaataagtggcagcatctgccatacttctcccactctcgcaaagtgtgacttcattatttttttcttttctttacttttttttggacacagggtctcgctctgtcacccaggctggagtgcagtggcacaatcactgcagcctcaacctcgggggctcaagtgattctcccacctcagcctccgaagtagctgggactacaggcgcatacccccaggcctggctatgtttttgtatttttcatagagatgaggtttcgccatgttgcccaggctggtctcgaactcctgagctcaagtgatctgcctatctctgcctcccaaagtgctgggattacaggcgtgagccaccgtgcctagccttttttcagttcaggttttaaaccagaacctttatggcatgactaatcactgaaattcgtgagataagctggatgttgcaatagctgccttcttgggtttatgtgttgttctttcacagaatccatgcctgaatctgcagtgtgcaatttttaggcgccccatatgatcagtcctggtggtgtttcaacttttagccttgatacttcagttacactttctcttgcacttggcaatgtagccacatttgccacaggttgacttctgaaggtggtaggcttcagagccacagcggtggcacatcgtgtgcatcttattgcgatgctttccagacgatgacgttctctttgtcatttggcttctgcagctgagaccaaagagtgtgtgtagctttagagaaatgtctgttcagactctttacctatctttaagttgggttatttgtcttattcattattgagttgtaggagttctttatatattctagatacaaggctattatcaaatatacatctgcaaatattttctctcattttgtaagttgtctttcctttcttaatggtgtcctttgagaaataaagcttcccattttgacaaag

SEQ ID NO: 111177 - DNA, 1021 bp, Homo sapiens
tccttaccagagagatgggaaaaacactgtcttagctggggaagcatttctcagcagcattcagggagttcagtccacttcctccttcatgcttgacttcccttcaattcagaccaggctatattcatcaaatgacgttctggactccattttttgaacagaataacaaggacacatcaaacaaatttgctgtgggaaatgtgtcaacatgaaaacaatataacaggtgatttgtccaatgtgacgtacccacccttctcatccaagaagtgaggcagtccaacctgctttagacatatgtcagaaacagttacaaaatgctcaagcttggcctctgtaaattcattctattgagctgactggcttgtatggaggttctagaccatgttagtgttcaagtctacatggatggaaaccttcaagcaggccaagcaggagacaggtggaagaagatgtgtgcatttgagggcctcgctgtggggcttgtggtggtgttgagtgggtaattaatgtcagcatcagaaagggaattctgcctctggagaagaagaactaaaagactgaaaatagggccactattttctgagtttctgagctttatttcactcttatctgagcatctgttgactcttgagaaaagttgatcacacatttctaatagtgtattaaagtgtattggaagcttctgctcaccattgcaatggaaaaggcattagttagattagcttctccaccagagtgggtgcagcatttctaagacttactgatctaactctgccccaaatctctcattcttctgtccaggagctaccctgtgaacacagacatgtgttgtccaatatggtagcccatagctgcatgcagtgcagttatttaaatttgtttaaaattaaatgaaataattccttgtttgcactacacacatgccaaggactttgtggcacatgcgtatcagtggcttttgtattagacggtgcagacgcagagtgtttccatcattacagaaagctctgttggatgg

SEQ ID NO: 111178 - DNA, 1064 bp, Homo sapiens
caacctcagcttcccagattcaagcaattctcctgcttcagcctcccaagtagctgggctacaggcacgcgccaccacacctggctaatttttgtatttttagtagagacagggtttcaccatgttggccaggctggtctcgaactcctgacctcaggtgatccgcccaccttggcctaccaaagtgctgggattacaggcgtgagccactgcgcctggccgaaaacatattattttaaatattcattgaagtgtataacataaaggcagtaaactgcacgactgttaggtacacagcttgatgaatttttatatgtgtatgtacctgtggaaccaccacccagattaaggcacaaaatattttcagcatctcagtatcgtcgtgcctctcctcccattatcccctcaacccaaggtaaccaccattctgacttgtatcaccatagattacctttggctattcttacttcattaagatggaatcagacagtatgtactcttttgtatctggcctctcactcaaccctttatcggtgacgctcatccacatagtttcatgtagttataatttatcctgttgttgctgcatagtattcctttgtaagaacagaccacaacgcagagcattttcaggaattaaaaacatgactatatgagctgaaaatcattccctatctgtgccagctctttaaagttaagtgatatcttaaggtgggatggaaatattatgacctgaaagggtggaaggaaagaggtctgtttctgggagtgtatttgctaagtgctctatgttggctgtttaactgcagtaattaccctagaaggtgactgctgctgttttgtacatgaggaaactaagcatcagaaaagttttatgactttacagtgaggctgaacaaaacgtgaaaattgttagttacaccagagggcagtcccgtcctggcaaagacaatgccagaacgctgttgaggctccgccacctccgatttctgaggctcaggttttacgtactgcagacttttcttttctttttgagatgggatttcgctcttgttgcccaggct

SEQ ID NO: 111179 - DNA, 1072 bp, Homo sapiens
actctgtgatctgcaaccctgcctcctgggttcaagcgattctcgtgcctcagcttcccaagtagctgggactacaggtgtgctaatagtcgtattttgtactaataaaatagctggctaattttcgtatttttagtagagacagggtttcgccatgttggccaggctggtttcaaactcctggcctcaagcaatctgcgcaccttggcctcccaaagtgctgggattacagacctgagccatcatgcctggccatgtttatcactttctacatttcattatagcaagcggtaactaggggaggtcccctagttgggtgcaagcagattcatttttgtatttgcaaatcatgtaacacagtgaaattcatagccttacccccatactggatcataaaaatattttactttccctattttgtttactatcaagcctgagctcattaaatatatccagtggcctggatcaggatcatgtgaaaaacaggaccttggcttgcttacaacgtttgcatttgttttggttggtacagattcatttggataaattcccagcttattctcaaagaagattctagcgcagtaccgggctcccagtggcttttcattcatagtaatgagcattagccgagcgtggtgacgtgcgcctgtagtcctagctactcaggaggctgaagcaggaggattgcttgagcccaggaggtcaaggctgcagtgagctgagcggtgtctgtgcaccattgctgcattctagaattcccagcccagaactatgctgttgtcatgcctaggaaagcatccatgagaaaatccttttctgagtccgaatgccaattccagttctggttagaattccttgacacacacggcacttccagccttggttttcacggttgctgtgatagcagaacacacagctgtgaaacagagagaagatgagcaacagaaatggatgtgctaaaatgtgagatgaaaatatgcagaaaagccaaccatctttagaaatctcatttattcagggttcagtgtaagcctaataggtacaagctgagattttggagtctggtgggttc

SEQ ID NO: 111180 - DNA, 1077 bp, Homo sapiens
gatcacttgagctcaggagttcaagaccaacctgggcaacataatgagacctgtctctacaaaaatttaaaaattgtcatcccattctctactggaaaataaaaaattagctgggtatgctggcacgcacccatagtcccagctacttgggaggctgcagtgagagaattgcttaggcctgggaggttgaggctacagtgagccaagattgcatcactgcagtctagccagggcaacagagcaagaccctatctcgaaaaaataaataaataaaaacaagaggacctaacataatctgagtcaggaggtgactattgggaaggttgcttggagtttgaatggcattctaactgagacctggaggataggcagagggggattggagacaggcggcagtggctacattaaacagcctttgcaggggcccagtatggagagagtgttggggtcaaggaatagcatgagctatggggggaaagggaaagggagagggagaggcttcagagaacaggtgtctcttgtaaaatgaaaacttagtcaaatttctggaagaatctttaaaacctcttaaagagattgatttcagactgatgatcagatttttttgtttttgtggttcagacagaaatcttaccttgtgtatcagcattattccctagagttagagcccaagtattgctcccctgctaatcctttgaattctccccaaatctatgttcttaatttacctcacctacctccccaaggaaggtaatcagcttctagtaagaggtggttttcacagacaatgtgtccacatttctttgtctctgcatccttgatggcatccaggaaaggtgatcatcgacatagtcaatgtatgtgtacgattctcccaccaagggcaggatttaaaaaataatgctttaaatagaatgaacagaggcagctacttgaaccagctacttgactctacttgtgctttgaacgtgtgagattctcaggtttcaaaccttagtgctctgtgttgacattttctttttctttttctttttttttttgagacagagttttgctcttgttgcccaagttggagtg

SEQ ID NO: 111181 - DNA, 1082 bp, Homo sapiens
gtccctttgatcttggtaccatattcatgtttcttaagcagctaacatttagtcagaatgccaggtagaacttaggtgcttttcagtttggaaatccataccctttttcattctatcactccaaaaactgatgtgtgggctgcagactttatttgccaagggttaggtggacaggagaggtaaaagctgtataatgacatggcaccacctccatttgctgtaagcaaacagccaggtcctttattacccttgaaacaggcactcgtgacacaggttggactcaccgaagcaagtcaaatgccaggtttctgtgggtcaaagttccttccagcactgtatgttaatcagaagctcaaccttagttaatttggccattgcattgggaagaactttggaacaaatgattactgagctggactgcaggagttagcatagcccagtattttcttatccaagaggtacgttgtagtctttcttggaggggatcgcaggaatgagacatttgtcacagctttatttattcttggtggaacagtagtataataaaatcttctacactgaacctagctaatcaaaagtatttacttgctgtaatcccagcactttgggaggctgaggcgggtggatcacatgaggtcaggagttcaagaccagcctgaccaacatggtgaaaccccatctctactacaaatacaaaattagcccggagtggtggtgcatgcctgtaatcccagctacttgggaggctaaggtgggagaatcacttgaacccgggaggcggaggttgcagtgagctgagatcatgccactgcactccagcctgggtgacaagagggaaactccatctggaaaaaaaaaaagtatttacttaaaaatatgaaactgaattgttagagaatattatttgtgtataggcagaaaagccagctgtagagggcttccaaggtgaaggaacatttaaaactaacacaactcatagtgatttaaatgattttgaatttaatgtgcctctgcagaaagaattttaaatgaacataataatcatagccgcccttcattgaacattttctctgtgtgctagg

SEQ ID NO: 111182 - DNA, 1049 bp, Homo sapiens
tgatagggtgatttccatttcttttgcaaaaacaaatcataacttttccctgtttcttttcttttctatccttttctctttttttgagatagtcttgctctgtcgcccaggctggaatgcagtggtgcaatctcggctcactgcaacctccacctcccgggttcaagcagttgtcttgcctcagcctcccgagtagctggaattacaggcacctgccaccaagcctggctaatttttgtatttttggtagagatgggtttcaccttgttggtcaggctggtctcgaactcatgacctcaagtgatctgctgcctcagcctcccaaagtgctgggaatacaggcatgagccaccatgcccagcccttccttgtttctttaatgatggctattcccccttcccaggccagaattatggagataattgtctcaactgattatttcctcctccaagaaaagctgaagaatgcatagtgttaagcacacggggtgcttgatagcatagtggtaaggttcaagagctttgaagccaagcagtccatctgttagctacgagaccttggagctctcttagcaaagaagagaggaatgtctattgcgtggcaatctgtggtgcctgccaaaaaagatagaatacaaagattaatcatacagtaatactcagtcttcaacctcgaggtgctcttaaaggagcccatgaaataaaataataaaccatagaaaatgataagtactactaggtaaaaaatcaaggtagagagtgatagtacttacaaaagagatacagaaagaaattggagtggaaaggagggagacagtcaggagggcttcttgaaggaggtggccgggagaaacaaggatttgggtccatggaattcagagcaagaatattctgggctatgaggatagcatgagcaaaggcattgagactgatatatcaggttgcatatagggaacagagacaagagagtggctcggtttgaccacgaatgaagtgaaatagagggagagaagagaatatagggttgaggtccggttaggcgaggccttg

SEQ ID NO: 111183 - DNA, 1049 bp, Homo sapiens
ccaaagtgctggggttacaggcgtgagccaccacgcccgacccagagagatttcttaatttcccctaaattgaagggctagtaagtggctgaactgaaacaatttcctttaaggcctgttcttttcaccacaacttggggccacctggggttggcagttggactcgtagtttccaggaacagagagcagaggaaggaggccagtgcgggaagagtggcaaacagtatacatgataaatccacaatggaagccttgtaactaattacgtcaagccaacaaacaagcaagcgaagcttttttggcatgccagtttaaatccattgttcttttgctgcttttctgcttaaataattaaggctcttaagtacaaattaacctcaagctaacaaaaagagaatgccattgacttgattgagatgtcattgaaatcttttccgttgcgttcaggtagttttctgcacacatgaactttccatgagtggtcatggaatgatccagcatgtttttatctggacagggccagcggggctttctggtttgacacaccatccaatgtagaaatgcctctccaacattagcgatagtcatgatctgacaagcatgtgcaccaagaacttcccttgggccaggcactcatttatagttctctgagattgctgttaccagtgtctctattttacagttgagcaagtagactcagaaaggctaagcaacttgccctaaaacacacagctaattatagcaaagcagatccagattcaggtcttcctgatttggtatttggagggttcagttgctatgcttcttcattgcttccgtcctggccttgaattcttacggtgatggttacatcatcatttccgtgaggcacttgaggctgtgactggaaaggcttactaggaagatcttttttatgttcttctttctttttttttttttttttgagacggagtttcactcttgttgcctaggctagagtgcagtggcgcgatcttggcttaccgcaaactccgcctcccgggttcaagcgattctcctccctcagcctc

SEQ ID NO: 111184 - DNA, 1044 bp, Homo sapiens
caaagcctcctctttggcaatctttttgtgatttacatctaaatgtgtagccctctgtttgaaccattttgtgaatcgcatgccctacagataattacacttgactgacttatgttactatattgtttatcaccttttctactgtcatttaattataattaatgattttctgaaagtaactgtcaagacaaattttcttaactatctcttttcacctttgaggtttccacaagtgccaattgctgctacaggattccatttagattgttctcagctgcagagctcaattaggtatttttgtcttgacctggcatgaaacggaagtgctagagtcattgtttgagtctttaatttttccccagaacctttgtacaaatacttgatcttgcctttacaaagtggcaaaacaattctctgatctgtcatgtttgtttgctagccctggcttcgttctctcctttggacaattacctaggtttggcaaaattgcttttcgtggcctttggaggcacagttccctctctgcgttcatttgccttgtttagatccataattcactgaaaaaggcttcctcagttgctgttagaatcctgtggctactaggcttggggaccctaaaaccatcttgaaggtagtacagactccaggaaggttctttgcagtaaaaaaaaggcaatagtacataaagtctgctgagggtagatgaagagcctggatttagttatttctgactattgtcagtcatggtttgtggctgatttagaattatttggattttgggttttttttttttgtttgtttccttctaaattgatttggaagacatcatcacaatttgttgaggagttcaaaaaatacacagacaaattatgcctaataaacaaagagctaatgttcatagttctttctgcaaatcatcttatttcttatcatatgcactgaatgggacattagaaatgaataggggggccgggtgcagtggctcacgcctgtaatcccagcactttgggagactgaggtgggtggattgcttgagcccaggag

SEQ ID NO: 111185 - DNA, 1299 bp, Homo sapiens
tatattggaaatctctaccagaactccctcttcattttttaaggcatacatttgcttgttttcaagatcaagaattctgagctagctttaagtagcaaactgatttatatgtgcaattataggatgcattaagatgaatgatagcctttacatattgaaaactttgcagacgttttgttttgaaaatggcattgtatagtaaatgcaaattaattttgtaaaattatgttaaagagtatgttcagacactttctgccatggccaaaaagtatgtatgaaagtatgtgtgtatttgtttgtaaaaggatgccaatgttttacctgatatcttagtgacacttcagttatctatgcattctttagatctgtgattcggtaaacaggcagccatgttcacgatgccttctatgtcttaccatatttttaattaacctgttaaatacagcttaaaatatttttattttatttattctatttttactgaaatatactgcattattgtgttaatgtattatctttcctggatattatctcccagtgtatccagatctaagtaatctcagtgaactatacattgcctaaaaagtggttttgtaatgatttgtagtcacatttctattgggatatgtagaagaaaaggcaaaatgcttaaagttccttttattttttaaaagcagctagatagacacagacttgccacctcatacatctgctccttggcaacatcaaggggaacgactagccaacatgcctatggctaaaaactttcctttgcagactaaagcactgcttggtgcttcgtttttctacccttcacaacatgtgtgatttcatctaagagatatatacatgtacacatgccctttgtttccacctggatacaagatcactcatagctaattaggaccattgttttttgttcatctgtcttgttgcatgaagggacattagacccatttccattaaaataagttcttggtgataaactgtggcactgctacttctttttaaatccactttatgatttcaagatggacacttgtaagatgactcgacacaaggccattgcctggaagccccagagctttcctctgtttgtatggcccgttcatgtcccaggcattgcaacacaaactcctcaagatttcaccacaacatgacaagcattttcctaactgatattagcacaatttaactaataagccccttcgctctctagttggccaggcttaacctaatacacatctaacgtgtgtgccacacggccagtagaaagtttaacttcagcttcagggcaaa

SEQ ID NO: 111186 - DNA, 1058 bp, Homo sapiens
tattttatcacaaaagtcaaatgtgcttattgtataattttcaaagagataaagtaaaatcctccataatcctctttccatattacagttgacagttcgggtattatattccaagttttttactgtgtatatattaaaatacacatgcaaacattttgttgtttttataagaccatgcttgttttataaaaacagcttggctttgtttttgctccacttactagtgtgccatggtcattgttccgcctcagggtgagcagctcttcctttccacttaatgactttgtggttcactgtctggtgcacttggcgtttcatgccatgattttagctccatccctgcagggccctgctggccgctccatgaccctggccatagagtgcccgagagaacgggtttctgtaaacattgggtttcttcctttcctcctcgttatctatccagtgctccatgctcttcggtctagttgctctgtgtacggtgcatgcaaatcggctgtgacaatgccagaaaggaatggtgtgagcaccatgggtcaggggattaagtgacttcattagggtcccaggcagctcaggacagctctgggtagctcagggagggaactccaagagtgtggccccaaccagacttgcactgtgttcctctctccgttccattcctctctttcctgggacgtctctgatctctcccccattgagctgtcatctcctgtctctcccacttcccacccgcccttgacctgtgctgcctccctccctccctgttgccctgtaaggatgcatctcaggaaaagtgcctggattccagtgatgtggctctgttaatagagtgtcaggaatgtcggtaaaacaggtaaggctatgtccatgccgttgtttctgtatgttttttattgggagcaggtggaactggaaaatgaagacacgtcctctgccagtgtttactgcaaacagtttcctgtatttgactgtgatattttaagcttgattacctcccccagttgatatgttgcctctgtaaattcagctggcatctcttggcttcatcataatgt

SEQ ID NO: 111187 - DNA, 1063 bp, Homo sapiens
tacacttctaagtgctggaagtctaactttcccatcatggcgctgctgggcaggacagtgaggtgggaggggagcttgctttggaaaggaaggcacacttggtcagagacggttgttcatgtcaccggttgatcctgggaaggatagaacctttccctgagatgaattctctaaatatcagccagaaatcagatggtaaatttgcataaattcagtattcatttcagttcagaggcctttcacctgcggcatgtagattctaaagggacctgggattgagtttcaagaatcactgaactgttccagctctgcccccttccaaaattgtgtataaaattgtgagtctgtgcacttttttttttttttttttttttggagtgttttcatccgagggccttgatccaaaacaggtcaggaacctttcctttctcctcgtggagctccccttccctctctcacatagtgattggcctggcctgcactgtaaggccatactcaagccgccatcctgtaggagctttatatggattaaataatggaattttatggcactctcaggacctgaaggcctctatgattcccatttcacagatgaagaaactgaaaaacaaagaggctaagggccctgaccaagggcagacagctgataaatgacacacacacacacacacacacacacacacaccccactcacacccacccacccacccacccacacccacctacccacccctgaagctggagggaaaaaataaactgtcagactcaggagctggtgcaagaattttcatgatgtaaagttttgcagtgtttacttcattgtcctgtggataatggtgtgatgtgtgctcaaaaggctagagagatggccagtgatgaaagacaaacatcaaaaagaagcatgcaacagagacttctgcaaaaatggagtgagaagtctactggcaagtccttgcctcgcgtgctcagtttgtgaaaagtggacagttgtgcgcagcatgagaagtaggtggctgtgccagggaacaggagatggcgtcctcttccaaaaagctggaataga

SEQ ID NO: 111188 - DNA, 1045 bp, Homo sapiens
ttacaggcgcccgccaccacacatggctaatttttttgtatttttagtagagacagggtttcgccatgttggccaggctggtcttaaactcctggcattagcttatctgtccatctcggcctcccaaagtgctgggattacaggcgtgagccaccgcgccaggcctaggaaatgaatttcattctgtaccactggctgagcaaagctttacatctgtccaggctcccgagtgttaagagatgacttaactgtgtccctatttactctccatatacgtttcatgggtttttgggagtaaactgatggcatataacctcttatctaggttttcacaaatctctaggatcacagaaaaacatactaagtagtagtgtaacttgtctttttaaagagcttgtgttgaacacagaatatgacatatttgaggagttcttagacttttggattcctcgggccctaacatagtacctagtataggatgccctccataaataacccagttgatgaatgggcagatgaatgaatgtagatgaaaatacttcattgtctacttttagggtttaattttgaccatccatgtgcttaatatttatagtctaatggttaatatgctgttcggcagataaggagcatccatgtgtcaggcaccttgtgaggcagcatgaaggactgagacagatgaggtccctgtttgaagaggcaggagataagccggaaaaacaattcaggaagcaagatgatacaggttatgccgagtgtcttgaagaccatcaacagcgtgatgcaacagagtagctcagaggggaaaggggccatcaggaggcagcctgtcctaggaggcaacatttgagctgggcttgaaggctgagaagaagccagccatgtagggagtgaatagaaagcactgaggaacagctgggtgtggtggctcatatctgtaatcccagcactttgggaggtcgaggcaggtggatcacctgaggttaggagttcaaaaccagcctgaccaacatggtgaaaccctgtctctactaaaaatacaaaa

SEQ ID NO: 111189 - DNA, 1024 bp, Homo sapiens
tctcgcccaggctggagtgcagtggcacaatctcggctcactgcaacttctgccgcacaggttcaagtgattctcctgcctcagcctcccaagtagctgggattgtaggtgcctgccaccacgcctggctaatttttgtagttttagtagacacagggtttcaccatcttgaccaggctggtcttgaactgctgacctcgtaatccacccggcttggcctcccgaagttctgggattacaggcgtgagccgcggtgcccggctaggacccgcccggcaccatcattttaactgttatgatgcacgttatagtttgagaccactaacctgggtgctgctttgaaatcctctgattatgcaagtgtcatacaaatggatgttaaaatagtctcaaatatttaaggaatccttcagggattcccttatcctcaattcaggagattttgaagtggcttccacattcagagctgcttttatctttggctgaggcaatataaggatctttgtggatggtatttaaggatagttcaaattcatatctatgtattttagtagcatgttctctaggagcaaattataatgctttgttctataatgagttaatagcgtgaacattgtcctaacagtcctgtgactttcttgtttaatgtttatactcatgtaatcaaacaaattgaaattggattatggctgttgcacgttatatcagttattatccagtttaaatgcaggtctgaaggaagtaaaattgatttttctatgctacttggggacatcataggttattggtatcctggttgaattttcagttaggtttctatgaaagaaagatgagtggttaggtttgttgaattttttttctttcacagtattttgtaaataaactgggatatttcattctaattaggaagtcagatgccttttaaaagttgggtgatcagtttccatatttttatttaaagcatgtctggctttttaaagtgtatcataatcctgagtaacatttttatttttagaaagaaaaa

SEQ ID NO: 111190 - DNA, 1095 bp, Homo sapiens
atcgaggtaacacatgtataagaaataaatattattgatcttttagtagttcgtaagcatggtgattggcttttcatgtgcatgtgtgaaatgtgccttccacaaaccttgttacaaagttggcacactaccattgatgtgaaagaaaaaagttattaaaataagaggtccttgatggcaaaaataataaaatggctctttggtggttaaaaggaccaatttggtccaatctcaactctttaaataaaaaggaattttgcttgaggtaagtaatttagttcctttgtggaaagttctttgacttctaagatgattcagagtttggaattactgatttagtcttctgactgtatcaggagtctttaaatatacattttcaattcaattaataagtcatgagttcagttaatttatcatcagtgcaatcagaaaccatcaaagtagactgagttgccagcctttacttctggctaatcctgacacatttcacatgtcatggattcctgaaattctgaagctgagattgctaatggttcagattggttactggatcattgtgttcctaaagaaaaattatacagctcgcttcaatgatgcagtttcccctcttttcctcaaaaaattttctatatgagagaagaaagcagaatctatggtccagtaaagcagtgatgctcaaatccaagtgcatgtcagaatccactgtgggtctttttcaaacaaagctggctttgccccagcctcagtggttctgattaattcagtaggtctggggtggagcctgagaatttgcatttctactaagttcccaagtgacactaattctgtctgtggaccatactttaaaaaccagctgggtgtggtggctcaccctgtaatgccaacacttggggaggctgacatgggaggattgcttgaggccagaatttcaagaccagcctgggcagcatagcaagaccccatctctaaaaaaaaaaaatagccaggcacggtatacctgtagacctaactactcaggaggctgaaaatttagagcccctttcaagaccctaggaggagggctagcaattagatcacatggtttatataaaatga

SEQ ID NO: 111191 - DNA, 1054 bp, Homo sapiens
gatgacatctagtaggggattctctgagccagtcagtaatgaaagactgatggaattccaagatctgctgatgaaagtttaatctatggtatgtgctgtcttgcctcagggagaaaagtcttcaggaaggaacaataattctctccctacactatagtattgtcttgacctctggagttaatttctctttaatgcagctccatgataagcagaggcatcacgatttacttgaccgttttgctgacttacactgtggttctattttatctctttaaaagtggcttctctgccttccattaatcatgatgggatgcttgcaatactttcagcacagaataacctttaaggaaagacatcgtaagtgattgtccaagaacagtttcccttagaggaaagtgggagggcattttcagacagatcgttcatggcggtcctgtccctgttcatgaatctatgaaggcgacagtttctcctgagaaatacctcgtccattttggtaactctggctcaaagcatggttcaggatttcttgtgagcatgtttcagtagcagccagtgacgtgtgggggcttgaggctgttgtgtcaagagagagcagaaaagtctgatgatgatcttcgaacagcttccatctcgcacttcccctgagtcctgagccagacaaaggatgggcctttctggatgcagagcgagggagatctatcatgtttgattctctgtgtccatcctcaaagtgccgtgatcttctttgaatacttggagcatcccaggaaaagaagagtcatttgagtaaagaaatagcctaacaacccatgtaaacatggatgaatgtctttgagaacagaggaagtcataaccatgataacccagaacttatgcagatgttcagtgcatggtttggtgcttgaagaattgctaaaagcctcttgttgcaaaggaaggtgcagtcaccacttttcatacacgagttgtcacctggaacctttttactcaaatgtcatcatcctgagatttttggtttcctggggagtccagtgactatgaatttagtgca

SEQ ID NO: 111192 - DNA, 1055 bp, Homo sapiens
ctgtgctaacttccggcctcagcgttcttcttattcactcagaccctggcgagcaccttcctccttattcttttacagaagtaccaaagccaagcaaacataatttcttttgttttttttttctctttttgagatggagtttcactgttgttccccaggctggagtgcaatggtgcaatctcaattcactgcaacctttgccccccggtttcaagcggttcttctgcctcagcctcccaagtagctgggactacaggcgcccgccaccacgcccggccaattttttgtatttttagtagagacagggtttcaccatgttggccaggctggtcttgaactcctgacctcaggtgctctacatgcctcggcctcccaaagtgccgggattacaggcgtgggccactgcgcccagccaaaacataatttctgaacacagggaacttggaacagggactcccctcttgcctcgtggttgatggaggcttatcttctgggtaggggcacagagatccttgtgtacttcgccaatgagccctatagtctgctcatctcagccatttcccacaagaaaggaaaatggatattgtcagagggtttcagaccccgtaaatgggatgtttccaagaggcttccctatcagtgattaatccacggttttcccttgagaaaaaaaaaaagattctatagtcacttgggaaactgagttaaaccaagtacactgggccctctcagaggttttcctacgctgagatgcactaggactctgcaagaaagcgtttcccaggcttggctggaccgtttcctcggtggaaacacaatcacatggaacacacttcaggaaatattgctgtcattagtaaactcattcatttaaattcgtggcaacactaaactgctatttttgattattaagaaaaattggaattacttttaatgaatattataagtggagaccccattgggcctgctctaatgaagataaaatttcttcataatgaatggcaactatgagaaacacactcacccatccaaaccccaagaatggacttagaggc

SEQ ID NO: 111193 - DNA, 1047 bp, Homo sapiens
ttaaattcctgatcatttcctatgtagagccatttaaccggtttcctcatccactaaccaaaagaggattgtgatgctaactagaaagctttcgctagccctgattcacgtacacacatacaatacgtgttgatgtcttgacggtgagcactctgctgtctaacctccttggaactcttttaaagtacagtaaatccttacttaacattattagtgagttcttagaaactccagctttaagagaaatgatgtgtaaggaaaccagatttttttctcatcaacattatagcaaaacaacattgaaagaagttgaacaaaaccttattcgaggtaggtcattttgcttaaagtcacagttttcaagaacctatcaatgatgttaagtgaagatatactgtactttgtatttttacagcttttagaaaactggtgagagctttggaccatctttccatcacacacacacacacacacacacacacacacacataattttggatatattttcagggtgtttagaacttcctgaagctcatccatggatctcccaggtccgtggacccttaataaaatccctgaagtgtggccgagcgcggtggctcacgcctgtaatcccagcactttgggaggctgagctggggtaagcggatcacttgaggtcaggagttcgagaccagcctggccaacatggtgaaaccccatctctactaaaaatacaaaaattagctgggcatggtgatgggcgcctgtaatcccagctgctcaggaggctgaggcacaagaatcgcttgagcctgggaggcggaggttgcagtgagccgagatcgtgccagtgcactccagcctggcagacagcgagactcagtctcaaaaacaaaaaacaacaacaaaaaaaaccctgaagtcagctgatgagtcagcctgcccttctgaagaggacagagcaccccccacccccaccaggctctgcatctctccctgtcccccaccacctaggggtatctttattgatgctcagtcattaattgtaaaaacaaaactagattg

SEQ ID NO: 111194 - DNA, 1290 bp, Homo sapiens
cacttagctcaacctcagctaggaacatgtgcattgggcaactcaagtgttttgccaccctgtacatgtccacaaatgaccgcaaaagcaccaggagtatggactttggggttacaaataaactttagcaagtaggtgaacttgcagatatggaatctgcacatgatggggatggagtgtatttgcacttgagctattcggaggaaggactttattcaaggctcagtggcattattccgagtggactcatgtgcaaaggcacattttagggtagagagtaccaaactagttctgaattgcctcagattccgcctagggagcatgcttacggcaaacagttgttaaaaaccatacacttgtttatttatttgagaattacattttccatattgcaaatatacctgttactatttgagactgaactgtgtaacttcaccattggcccacagcgtcccagctctgaccccccagactggcgggtacagcctgactgctgactgcaggctgtctctgctcctttcttaggatcagcgtttcccctagagctcacgtggcctagagctcatttcccagcgaaatgcaatgttccacttcatgtgcacagtttggtgtgcattccgattttcctctgtgcttactctgcaaataacgtttctcagctttgcagcagcagaaacgtaatctgtagtgtaaatcagccatgcggacctcaggacttgctttccaatcttttccaagactcctgcaggggaaaactaaaataccactcacactttcagggagtaagaatggtttcccagtagcgcagacatctgctgcgtatcagcaggaatagaagcgggattctgccagccgagcttcttggcctcgacttccatgggcccttactcagactccgagaaggtgggatgtgaatctcatgtttactgccacacactcagatttgcttggcatttgagcatctccagcagcagatttgatgaagttcccttttgtgtaacgtgttcactgttcctccaggggaatttccacagtcactctcagagcattcttagagatacttttgcaataactgagctgtcctttttttttttttttatgagaaggaatcttgctctgtcagccaggctggagtgcagtggcacgatctcagctcactgcaacctgtgcctcccaggttcaagcagttctcctgctgcagcctcctgagtatctgggattacaggcgcctgccaccacacccagctgatttttgtatttttagtagagacggagttacaccatgttggc

SEQ ID NO: 111195 - DNA, 1191 bp, Homo sapiens
gatgaaaaatacttgaatattcactaggcctagtagaaagaaaagacattttctcattgtctgaggtggatggagcagttgtttagatttggaaatcagttattgcaagagctctcgcaacaaagccaggcttcatgccttgcactataattacgtttagaaaatcatttcatgatcaagtattaatttgtgaagaagcttttgaagcaaaaaaaaaaaagtagagcttttatgaattagagaaatttatgttagactgtttagagttgttttttgttaggttaaatttccgccaagtgttgatgtcagtctgtgttcttcactaaccctctctccccatcattctcctttttttcttttaagtgaaaatatcttgacccccaacttttggggccctcagccatgggcattccctagtttccaaacaaacacggtacccgtccctcattccacccccaccaccagaaaacagttctgtttggtttatagggaggaaaatgattattatggaattaggtatgctagttattgaatacttggaattatattgtttgcttttaaaattaccttaaggaaataacttcactgtctgcttctaataatgtttagtcatttatttggtaagtaattaaagcaccatcactctcctgccctcgtcttcaggtgataatctagacatagagggagtgagccaacaagttgctgttagagttaacttgttccctaacccatcttgtgaatatcaatgctaacaacagtgtcttgtgttttttttttttcttttcttttctttttctttaaatcaatgtgcttttttcctatgtgaataattatatgtctagaaacagccatggagtgattttgctgttctgaatgggggaaagattaatagtgacatttggaaggcaagtatattgtcagatcttagatcatttaatattttatcctttctgcatggctgtggctgtatatttttcttctttgtgaatatcatgcattctgcagggacacagtgatcgggcttcttgctaggggcattcagctcacactcctgttgcctttttttggtgtctcccattgtgaatgccctaggttccccgttgttttgtaagaacaggagtttgcaccagtcagcattcaacagtccttgcatgcctttctctgcctaagctcacgtacactctctgcctc

SEQ ID NO: 111196 - DNA, 1056 bp, Homo sapiens
ttcgtagagattttcttagcattgtagagaaagtcccctggtagggacatacccagcccctgagacttagtctttaagagcactctgttgatattgtcaaagaatcaactccattgttggcctttttccagctgaaagataatgcgtcatttttgtttgctatgtggaattgctttccaagaccccagaagagaaacatggaagaagaaaactctcagtagtcaaggttatatgatcggattccctccttactgggtccagcctcacacagcttccgtgtggtgctcaagggttttgaggagtgccataccccgggcattgggtcagtccccctagacacactgtctctgaggagctaaggctccaaggctctcccagaactgagcaggatcaagtaatcagagaaagggaggttgcagcctggacaaggtcaggacaagcaccaggagggtgtcccagctatgactgtggtaccagaatgtcactcagctgtgcaaggctttagctgcattgcctggagggttaccaggctcatggaagcttgttgctcatagaagatggtccctgttggtccgttaccacctctttccccatctttgtgtttgtcttacctgaggcatattgtccaacttgctttttccccttttaatgtttttctctttgtctctcctcttcctccttcatctctcccacccctacgggggtggatacagactttctgtagaaccaaagaatctctgttgggttgtgcttttttaaaaatttgttaactaaaaattattagcaaaacttattagccaaatatagaaaatattctctcttcttaattaaaaaagttagatgaatagaccatgtaattcttaaaatttaagacaaagtgactttgtctttcattgactttaattttttaaaaaagaaaaattatggtcacttatacattggagaaagtttgtcatatttgatgtaaatgaatagttgtaaatataggaggggaaaaaagatctttggcccagtcataacacatataatgccagtttccatttccttactgagttt

SEQ ID NO: 111197 - DNA, 1081 bp, Homo sapiens
agagaaatcaaatatttacagtccagcctaatgccttaactctttactccccataaaacccttatgtggtcaggtgctgcagctcacgcctgtaatcccagctctttgggaggcctaggcaggagaatcacttgagaccaggagttgaggagcagcctggacaacatagcaagaccccatctctacaaaaaaaaaaagattttaaattagccaggtgtggtggtatgtgcctgtagcccaagctacttaggaggctgaggcaggaagatcacttgaacccagaaatttgaggctgcaggtgagctatgatcacaccatagcactccagcctggataacagggtaaaaccctgtctcttaaaacaaacaaacaaacaaaaaacacaccaaaatccttatgtatctggtactatagttgtctttctcattttacatttgacactgagagacagagaggttgaggagtttgggcaagacacacagctaatacatggtagagtcaagcttgagttcaggtctcctggcccctatttccaccccgaacttcacaatatcatatgtctgggaggcttggagactcttgaatccctttaactcaccctaagggaggctatgtcacatatggagccttctagaaaatgacctttcttaatatcattgtctcaggtgctaatgacagttgaagagaaatgattatttttctaacaccatttctttggttcctaaatagaatctatttcaaccaatttcaaagcatgagaagagagcaaaatcttaagggacagaagaagcttgtaatatgttgtgttagaaatgcatattttattcagcttttttctgagctggcttcaaaaaaaaaaaaagaatcaaataactaagtgctaaatctgttgactaggcttcacaaaagtttagaactgaaggcttccttacagtttgaaaattttacatttcacattccaaagttcacttgggaggtgttaagcgcagtggataatgtttccgctgcatatgccagcagtatttttgaaagtttataaactggccaggaagcatttgctgctgaaatttagcacgtggtg

SEQ ID NO: 111198 - DNA, 1031 bp, Homo sapiens
atacagcactcatttacagaaagcattttaggaaaattaagagttatagctgggaatgacatgatgccaaccaataaatcttaataattgacaaaagcattcagtacactgtgtataactatgtgaattttgtttgggaaattgattctggtttggagctttagcttgttcatagggttcttagagctataggatgacttgatagtgaggattttgtgtccctgttctcaggtgttagccttcctttccaattcttatacttgtttccatattacctgttttaccaagtacagccacacacatcagtatggatggatttcacaaacataccaggaagaactaatcatttggactatggacacgtctgcctttggggttcacctgacgaatagtgctgacattcttttaataaaattctctctttctccccccgccccgccccccaatttttcagcagatatatggagtgatcactcatttcagactgatccagatttgccgcctggctggaaaagagtcagtgacattgccgggacctattattggcacatcccaacaggaacgactcagtgggaacggcccgtctccatcccagcagatctccagggttctaggaaagggtcacttagttctgtaacgccatctcccaccccagagaacgaggtaaaacggagtgtctttttaccagcttagtagaatagatgtaacttgtggtttctctttacactggttgcttctgccccaacaggtcatcaaggtaagctttttgattattgtgcatgttgcatttgaaatctcagtaatgcttcctcttagtaaatagtgttaatatccatctttcagggatgtttttattttttaatggcttttggtctcttgaaacagcattccaggtacagaaagcaagaggggctgattaatgagaagtggttaagattccctagggctcactgaggcagtactttactctgcaggtaccattgcatggtgctggctccataaaatatttacacacagaagaacatctcttg

SEQ ID NO: 111199 - DNA, 1029 bp, Homo sapiens
ttgaactcctgacttcaggtgatccaccctccttgacctcccaaagtgctggaattacaggcgtgaaccactgcacctggcctaaaatccatttttatatgaggacatagtttacctttttggctgtaaacccatctgctgtcctctctgagccctagaaatggggataaagatagtgcctccttcatagggcagctatgacaaaccacaagctcctgcaacgaaggacacagggcgcgtgatacagcacctagtggcgtcagtgtccttgcagttgttgctgttactgttactagcttttataacatcccagcgggaagatagcacttgcattcaagacctgaaggacctggattccacccttgacttctagctgggattgatgtgagcattaaatgcagcgatatgtatgaaaacatgctttgttttatggatggggaacttttttccaaataaaggcctcacacccagtcagggggaagctcagaatcatgtacaaatgcaaagcaagtttattcatttggggttggtttatgtttgagagaaacctagaagtttcacaagtctacttaaaaatggagaatgagggcatcaatctttattttaaaaattatgaaatatttaaattaaaaattatgaaatatttttgcttcctcattaattgagagagaagagagatatttggagaaagagaagatgtcttgtcacagtagaggcgtcaccagccaggggcatacacggtgtataataaggaagacagtcagcaaggcaggtggggtagaatctggacttgccggacctcctcagatcctggaagtccggccctgctgagggagcctaactgaccttcttctcctatgaaagtcaccataaaatgatcttttgtcctttttttttttttttttttttgagacagagtctcgctctgtcacccaggctggaatgcagtggtgcaatctcggctcactgcaacctccacctcctgggttcaagtgattctcctgcctcagcctccttagtagctgggat

SEQ ID NO: 111200 - DNA, 1048 bp, Homo sapiens
ttttgagaagcgttaaaaaaaatggcagtttctatacatgcatccctggcagatgggatccacaaatacccctgcctcctttctgtcaatagcccctgcatctttgaaaaactcagagctctgcatatcactttttcattgctgggaaagaaaaaccaagctattccacaggtgtgtggcagctaattggttttgccattttgttaaccctctagagaacgtttgctttcctctcttgacctagaattggagggtcttgaggaggagaatggcatagatcaaaaattgaaaaccttgagtcagattaatgactggatgttgcttgtggttggctgaatcctgcaggtatttcttgaagtttgtgaaaaaataagcccaatgcagtgtctgcatttggtctgcatttgtctgcatttttgacaatacttggaaatgaggttaagatgcttggattggtgggtggtggaaaatgaatgaatcataaccgatgaagttatattccaacaatatgatgtttcagaaggagtcttgggccagatgagaatcaggaaactggtttctttttttttttttttttttttttttttttttttacatcttttttttttctttcattattatactttaagttttagggtacatgtgcacattgtgcaggttagttacatatgcatacatgtgccacgctggtgcgctgcacccactaactcgacatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcttaacccaactctataatttagatgtctatatgtttgtgtttgaataggagattgcaaagctaatccattagaagctgtttctttcctagactaggcctggaatttagttttttgctgtgagatgaatgaaataggatgaat

SEQ ID NO: 111201 - DNA, 1062 bp, Homo sapiens
ctcactgcaacctccacctcccgagttcaagcaattttcttgcctcagcctcccaagtagctgggactacaggcacgtgccaccacgcccagctaattttttatatttttagtagagacggggtttcactgtgttagccaggatggtctcgatctcctgacctcgtgatctgcccgccttggcctcccaaagtgctaagattacaggtgtgagccaccactaccggctactattctaatgtgtttaatgggtaactttttgttcaaaactatacttgcaatgtgcattgttgtgtgtgtgtgtgtgtgtgtgtttattcaatgggtattttcccccgtgtactgtgttttggagatgtatccataggctatgtgtacatgggctgcattgtttccagtggctggatggtgctccattctgtgaatccaacacattttacctttcccctggtagagtgatagacttgcaggttgcccccattttcccagtaccacagggagcaccccgcacattcctctaattgaactgcatgagaaggcatgtggcatacactctcgatattgctgggccatagggtgtatgtcgtttacttcttttggggaaaaaaatgatttgtttatcttatttttattgatgaatgtatggatataattttacgtggttttgctcagtgaaaaacacagcattgcaattgttggttgaatcagatgacaggtaggtgaatcagttatggactgtttttttagggatagcttactagttcaatgcttgtaggtgtatttctcaaacagacccagtggccacaaaagagggtcaagcttttccagggtgaccagttgaaatctgggccaagtacaagtgtatgtagcctttagtcacagtaagaaaatcttcagttcttgttctatcagcagagcagaatttattttttttttaaatgagttagtcatggaagcagaaagttggtggggggttggagggataaaaaaaggtattacccttaacaaaaagaaagcccatggaaaattcatgatgaaactgcattcttgcttttaaaagtaa

SEQ ID NO: 111202 - DNA, 1144 bp, Homo sapiens
aaaattgagcagtaaaaatagtctataatttatctaagtgtggatttttatttgtgggaattttattttttgttgagagcacttttgttcgatgttagagattgaaaccaaatattatattttagttttctctggtcactcttcttatgaattaattgtcccgtaaggatacgcgctaaagttgaagctcaaatctgaacatgaaaggattcattatgcactataggcttttcatacctattaataagtcaatggtttgaatgtagatcaagaatttaagggattactttcactaattttaatgttaaagcaaaatatctgccacctggtgtcagattaagactcaaaaggtgtcaaaagaaggggatatatgataggttttctttctctacttttgaaacattttctagtactaaattagagatattaactccttcaggcctcttaagttctattgctaaatagagatcagtgctcctttgatgaccatataaggaaaacgtttctgggaaaaatattgcagaagccatgagcggttatgttatctaatagcctcagaatgggaaaatttaaagagaatggaaagcagctgacataaccattttcccagagaaagctcctcctgcttctgcataaagatgtataatgtaatccttagagatctcacttcaattattgtgtcctttattcgaatgaataagtagagaatttagtttttgcacttgtcagtactataacatgccttctcagcttaaaagtaatggaggaaattacttgtaaaaaaattaatgaaagagatgaaagataagagaattcaggtttaaaaagtcactggtttgtttctcagtatgtttaaattttaggattaattttttttcttcctcctagagttcgagtctcataagaaagaatcgtgttaatagcccccgttatgttttgctggagtttatcagtcggtagaaatctactgagcaataagaagatgtttcatagccttggtataggaatcattgcgagcttgaaggttcacccatactaggaacttctaaggttacaagtatgtatgaaggaaaatgcttcttctcttgagacataaactgtaaataaatggcacagtcagaaggggactgtttagttattggac

SEQ ID NO: 111203 - DNA, 1052 bp, Homo sapiens
gcatggccctgccaacaccttgattttagactttttgccttcaaaactatggaacgatagatttctgttgttttaaaccactcagtttgtgatactttggtacagcagccctaggaaataaatacaactgtaatacatttctgtgtgaatcagagacctggtgggaaataggtgatgactccagtgagacacaggggtgagagcacacttaagaaaaacttccaaggtatggggaaggcttctagggttggcagcggcaggttttcattagcacgtccaggcctgaagggctaagtcaagagaaagttcttggaacccaggtagagctagattgacacctgtgaatttgagaagatggcctgactagtccaggctaacttgtgccatggtagagaggaagctggggtgttaatatcctgaccttcttttcccaggctctctgatcacttgctgagcctcttattggtcgaacctgccaagagagctcattgatgtagtccatagagtttacctcaggatacacagcagggtggaaaagagggagggtcgatctggaagggaaattggagaatattctgcacatttgggataaaaggggtatgtatatgtcattcaaatatatgtttatgggaaggaaagaatctaatgtgtaagacagtgtttattgtacataccactggttctcaacaaatacttctgattaaggatataaaatatctagaaatgtttatgttgcagtctaagattcaaggctgtggaattcatttagcaaattcttattaagcactcactgtagtgccaaatcttagacaggccctggggataagtactgagcaaaattgactctatcctttgccttcattgagctaatagtctaatgtcaccaactgtattcactagggttaaaacttcatgggattcgttacttctctcatgacacacaatgtaactggaaattactaactggattccactcttcacctgtggactgcaagctttgtgaagtcagcagtgtggttgcctctgtttacttctaacacctagttcaatgc

SEQ ID NO: 111204 - DNA, 1054 bp, Homo sapiens
ataaaaatattaatttctagagatctcaaattaattgtacagattctattatacagcttttttgagacatgttgttaagcagaaaaaagtatatagccttccttccagattcttaaactagagagtgttagaaaaactcagagctcatcaagttacccgaactcattgtgcagatgagaaaccatctcagtggaagaaacttcccaaggtcatggagccaggaaaggctgagaatcctttggctccagtattagggccttttctatcattacttttcctgtgtatctcatagttttcttttaaaaaaaaaatcatgagttccaagtactcttattaatctgcagttcattgactttaatgagcaattttttttgtttcccgtaattgtattgaattagaacatttttcatctaatgtgtatacgaattagttactaactgaaatggaatcttggagaaaatgagcttttgcttgtttatttgtaagtataaaatcttcataattttcatgatgactcatatggtcaaggaactgtggaactgaggatagggataggaaggaaccacagaaagcttatatgatccagctaccttgcaaaaaacccttttcgtgattgacggttggattgacatttgttaagtaattttccacgcttttttttcccaaggaaaatattcaggaatgcttgatttaaaaaaaatactaatttaattataaatatgattgaatatttttctctttttttctagagtaaaatcttgttgataagacagtgtttttctctagtggtttgtattcaggcttcctcttcagtctcactaaatggcctcacaggtgggtagatgcatttgtcttgaaaggtgactgttaccaaatacaaatcttgtagatgcacatttatcttgaaaagtgactgttaccaaataaaaatttaagttatatctcagcatggagaccacggctctggtcaggtaggagccaaatgtccttagcctgaatgtgtgactagaagaatatgtgacttagtccagtttcatagctgcctgatttgggg

SEQ ID NO: 111205 - DNA, 2578 bp, Homo sapiens
ctgttagtgtttaaaataatcatgatcagtctaaattaaacattgtatgtttcacttgtaatgataaagttagtgtttattatgtatgttttatatagtatatacatgtgtatgtgtatatatataaaataaacacaaataccaacagttgaaagaaaagagaaaacgagagcaaatatcttgtgacatcttagtatgccatgccatagtacatgtataaaaagggtatagttgtctgttgacttgctgtgtgttaaatacatagtcatcacagtggtgtgtgttttatgactaaatcatgatgcaattatctttggatcgtagactgcactttggggagcctagaaaaatagactcatttctacctcaggggcatcctttccaagttagaatgctatttatacaataaaatgcaatggctaacctagagactgactactttctattttcctttactactgaatcgccccctccagctgtttagtaacttctttttgtacaatcaatcatgtatacaatatgtggctgcccttttcctcctctgtagtctgtcctttaagaaaacaagaggctatttgaaaaaggaaaagcatctgtgaaatgactattttcataggagtttagaaaagttaaagagtgccttggccctgattctaaaagaaaggttgtatcttgctactgcaaagtgagaactttgaatctagttagggtttttttcaaagatacagttccctcagtggccccaggtagtaagcatgatggctcagataaataaatacctgttggtcacactgtatatagtctctctgttaatcacttagtgtttcatgtttgctttatgaaaacgttgaaaagatgcatcattttgaaccttcctgggtacaggtttcagtggtacccacatgtaattttatgtttagtttgggatttaataaaattgaagacacagagtatgaaactagatggatcttgtgtagtaactgtttcaaaatcagattcattgctaaagtgtacaaaagcagaattatacacagagaaaaccaagtcccaagtctagatgggtgtggcaatgcgcctcatgatccattaacttatcattaagagcataggctctagagtgagcttcctgagttcaaatcccagctctgctatatctaggcagttctcatagcctctcatctataaaatggggataagagtgttttggcatagacctgctgtgaagattaagcgagagcatcttcaaagagcttttaggagcagtatctggcatatagcaagagctcaatgaatattcatgattattatattagagacagtatcagtacagtggtgtgttataaaagtttgcttttctcttaattatgaattacctatattttggactctgagttacgactttctggaccttaagagcaagggttggttcatcttcatctttgtattttcagtgcctggaatatggcaagtgagcttaataaataaataatgacacactgaatgaaaatgggagccatctgcatatcccaaaatgaactttatgtgttgaataagacactcgatgttatatcttaatcaatgcctggttttggcattggctacatattttataacttcattgatcctgttgcctcacagtaggtgaagctgaataacccgagttactggggaaggcacactgagattctgtgggtttacaatgtgccaaaccctgttggtggtactttctcactctcaggtggccatgctgagacttgaacctaggttttccgacacagctccagtgttttaccacagaggctaaatatatcagatttcatctggttcaactggaggcatatagtagtatcttgagaatccggaaagtggaaaattatattttaggggatctttccattcctctaagcaactgaggtttagatcaaatgccacttccactatgaaacctttctagaccctccgagctgtataaagtccttataaagtcctttctctgtattcccaaagaaatgtttctaagtttctgctatcatgtttatcttagtggctttcggcattactcaaaagtttccatttagacttagagctccatgaaagcagcagccacgtcttcattatgtgtgtatatgaacttcttcacacggtatgtggcacatagtaaaaggctccataaagttactcatttgctggttggatggatagattcacgatcattaatgcatgctctctgatgtttgctacatcaatatgcttgtagaaatagaaaaagtaataacaatttgtataaaatagttgtttagaacactcagatagggtgattcttatttatgttctaggctcctggaaagaatgaagaattggggccactaattcagtcttccacaaacattcttttattctattcgagtctataggtctatatgttgggagggccagtgccaaggaaaagggccattttggtttcagttgacctcacgctttgccttggattgagattgatccatggttgtcatagattgttttctgttgctataacgaaatacctgagactggataatttataatgaacagaaatata

SEQ ID NO: 111206 - DNA, 2105 bp, Homo sapiens
aggtgtctaatgactttttttttccccagctgactcaggtgttgacaccttggcagtgtttatggccagcagcggaactacagacgtcacaaatcggaacagcccagccacaccaccaaacacccttaacctccgatcctcccacaatgaactgttgaacgctgaaataaaacacacagaaaccaagaacagcacacctcccaaatgcaggaaaaaatatgcactaactaacatccaggcggccatgggcctctcggatccagctgcacagcccctgctgggaaatggctctgccaacatcaagctggtgaaaaatggggagaaccagctccgtaaggctgcagagcaagggcagcaggaccccaacaaaaacctgagccccactgcagtcatcaacataacttctgagaagttagagggtaaagagccccacccacaggattcctcgagctgtgagattttaccctcccagcccaggagaactaagagcttcctaaattactatgcagatctggaaacctcagccagagaactagagcagaaccgaggcaatcaccatgggactgcggaagagaaatcccagccagtccagggccaggcctccaccatcattgggaatggcgatttgctgctgcagaaaccaaacagaccccagtccagccctgaagacggccaagtagccacagtgtcatccagcccagaaaccaagaaggatcatccgaaaacaggggccaaaaccgactgtgcactgcaccggatccagaacctggcaccgagcgatgaggagtccagctggacaacgttgtcccaagacagtgcctcacccagctccccggatgaaacaggtacccctggggaaggcgtagcctcagctggcacttttttttttttatcttttcaactattggagtaaatctctagactgaccaaaaatgtccattatgcagagaggaacgtgagcctcttgcggtaaaattgggcaatttatttgcaaaatattactgcattcctcaaccatattttaggtcagtttcattttggatcgtgcataaagttgtttgttctgggaagcatttttgtaaaataaacagatccttggtgttaagtacagtaaaatatcatatatttagaaattacacttccagtgcataggtagatcatttctatatgctatctagaaatactgggttttggtaagcaaaataataaaagaaacaaagttgttgggggaaggatataacccaattaagagaactattttaaagtcctcaaaataacttatttatggtgaagcgcataaaaagttaaaacattagccatctgttcattaaaggcatttctctttttgacatttactgaggagtgttttattagccttaagtaatatttaaaagtgggaaaatcgtatttcttgaaaaatatattcagaagtttagacttttaactagtctaattgagaccagtctttctggacttttgtctatatttgtaatattttggatttgtcggaggtgttaaaatggtgacagaaatgaacaggatcctaaaagtcagctactttaaatatcattttcttatagctcccactatactgattctaagattgaaaaatgtggagaaccttattgtatctgaattcagcgtaaacaagcactcagaaaggctaattttttaaaagtagtccagcagttcccctagtgggtcccagggctgtgttaatatagatataacaaagaaaatagatagaaccaccagggaaggaaatcacatttttacaatcgataaggtagataaattacaaggactaaagataaggaaaagaggagttaagacattaacttgtttaagaagaaaaaaaaagtagcgtttttgaagtgccctttaaaaatcccagtactttcaatgatgcatactactgtggaatgtggcagtagggaggttgagatgaggccatttcatctcataactgtctggccctgcacattattggaatcataattatgttcagtaatgtccctgagttcacagctctctatcctttttacccatttagagaattcatatcctgaagctgatagacattgtcacctgctggagtttgaatc

SEQ ID NO: 111207 - DNA, 1086 bp, Homo sapiens
cttgaggtcaggagttcaagaccaacctggtcaacatggtgaaacgctgtttctactaaaaatacaaaaattagttgggcgtggtgatgcgcgcctgtaatcccaactactcgggaggctgaggcaggagaatagcttcaacccgggaggtggaggttgcagtgaaccgagattgcgctattgccctccagcctgggtgacagagccagactccgttgcaaaaaaacaaaaaaccaacaaccccttttatataggctcttgtagatccacttcatttttcctaagggcagcatggtacttcattgtatgggtgtattatcatctaatgaaccagctgtgcactgaagaacatctaggtggttactggtcttttgacttcagaagaatagaatccacgttagcttgtctgtgaaacaaattatcagaagtggaattgccgagcagtgggatccatgcattcaaaacttgctcagatatttgtaaatggctctccaaagaattttgccagcttttactctcaccagcaaggtttgaaacttcctgtttccagtgtcctgtccttagattgtggtattatctggcttattaatctttccagtctgatataggaaatccagttagacattgttatttaaattggtattttcttaagttttgagtgaagctagtgatttatgtttattcaacattggtgtttctcttgggacttgtttcttttcttattctcctacagacttgttcatatttttcttaatggttttaaggaactctttctatataaaggaaattagcccttttatgtcatctgtggtggtaattttttcttcagtctgttttttgcttttatcgtgtttatagtcactttttttctaaacagatggttttaatttttacgtggcaaaatgtaccaatttttttttttctgtagtggtgctgaattgtgtgtgtgtgtgtgtgtgtgtgtgtgtgtgtgtgtgatgagaaaaagcattggaaacttgagacagaaaggtaggtaaggcctaccatgaaaaaaatcctcaataaatgtttgtgggaaatgtgacaaagtaggaattcaagttt

SEQ ID NO: 111208 - DNA, 1025 bp, Homo sapiens
attgcattgagtttctagggaagtagctatttgaaggtaaagaggataaatgagagattctagaatcagttgggtcttagattgtcagtggttgaaagaacttaattctggagattttagataaggtggtgattgtgaccagagcagtgtttatctggcattgtagatctgcgatagatccgggacaatgtatggggaggaattagactggctgtcaggggaggagttatgggactgtgcaggactgttttaaaaatgggttggacaaagagctaggcacattgagaaggaggaattggtcagacttgtttggcagtatttggggaacataggtaaaatgtaattgtttgtctgatttttatttaaatctttcattcctctttagaattatttaaaggtacatagcatcttttactgaatcaaatgacaagagggcattttatttatttatctatttatttatttatttatttatctgtttgcttaatggtgcttttgtgatttggggttgcaagctctctctgtggtcctgttggatatttattgatccctagtagcattatcataaggcatatcagcattaagaattttcattaacgggacatgtggaaacactgctagaaggaaactattgttgctagactgtttcacctaggtagctttatgctttgccccaaaatcacaactgtattctcagtgtagaacttgtagtggcctgccattagtccccaacaactctaaactccgtatgtcatttttatggaaacaaggactctcctctcaatgctgacaaaatttctagcatgcagcacactggctaatttttgtattttttgtagagatggggtttcacatgttggccaggctggtcttgaactcttaacctcgtaatccacccgcctcagccacccaaagtgctggggttacaggtatgagccatcgcacccagcctagggtaaagttttgaatttgtctacattctctagatcaggacttcgccagtagaaatagaatgcaagccacat

SEQ ID NO: 111209 - DNA, 1015 bp, Homo sapiens
acccagtagatgaaaatgaaattaaataattggaatgtcactgttttccaacccctgtggatttagtggatttaggcattgaataacaatggctgctaacattagaaatgaatgaaaaccagataccatgtgcttcctgatgaaagatcataccaccacagactgaatttcaatctgttcaagcctctgaatctagctccaatttgcaggcaattcagaggttggagaaacgagttaaacatgcaccaccaaaattcatactgtggaaactccataactcagacagcccagactctttcaacaaataagttgtaaggaaaagaaaaggatagaggcgatgtagattaaataacttaaaagacatcaaaattttaaaaatagacagcactaatggtgactaggattatacactcgggtaacagaatcataaagaaatgccaggaactgattaccataaattcaagagtttgtttactttggaggaagggaagggcatggagggccttctagggtaacaagcaaaagctgtgttttgattaagatggtagttatgggtgttttctttgtagtaagctatttgttttgtgtggttttcttcatctgtgttttattttaccataaaaagattttaaaatatttttatgaaagaatgacactatacatactgcctttctcccaacttttattatgagaagtttcaaacagaaaaattgaaagcattgtgtaggcaatacctatatactcatcatactgttttacagttagtttttttcatttagtgttatttagtaaatatctttctgtgcaattaaatatagaagcagcctcacttttaagtgatgcatagtattccattgtaggatgtgatcctttatttaatcagtttcctaatgatggacatttaacttgtttttgatttttttctaatagaaataatactgcttatttgtccttatgataaatacctaaaatttgctttgtcacagcatattctaatatgcaaagtataaatgct

SEQ ID NO: 111210 - DNA, 1072 bp, Homo sapiens
taagagcctatcagtgaagtgagattttgttttggtatgtatgtatgtatgtatgtatgtatgtatgtatttttgtacagacaaggtcttgctatgttgcccaggctgatctccaactcctgtcctccagtgatcctccttcctcagcctctaaacgtgctgggattacaggcatgacctaccatgcctggcccaagtgagattttatttggtaaccagtgaaaagctttaagaatattcatgttggtgacagttaacacttacacagcaattactgtgtgccatcaccattctgagtgctttacacacactctcctatttaattcccacaacagacatttggtatagatattctcattatctccattttacagtggaggaaacggaggttagctgacttacctaaagagacactcaaaggaagcagtggagatggaattcaaaccggggtggcccagctccagggtcctggctgttgatagcttggagcgtgtatatgtggtggtgataaaggtggtagatgctcttaggaaggcagctctgcgggagagtacagttggattggcatgagggcagacaggtaatgagaatatcgactgtaggccttcgggacggttaataagagcctggcctagaggcgaccgtggaaatgaaaggatgagaattcacatgttactagcttcagaggatggattagtgccaggtttctgactggtcatggggcaaggaagggatggagtcagaaatgtctgggatattgcttgaatgtccacctaacccagttagggaagttgagagaagatttggtgggagagtgatgatttatttttacagagccctgttttcctactttgtgaccaactagtgcagtggttcttaacctgggactctggggaaaactgtctagaaaagagatccatgtaagtgtgtcctaacagatttctgtgagtttttggagtctgccaagctcacatgttgttttagcatggccttgggcccacagaaggtctccagtgttttgaggcagtttgtggctgaggcacttagaattctatggtggcttgtccccttc

SEQ ID NO: 111211 - DNA, 1102 bp, Homo sapiens
gtagagagggggtttcaccattttggccaggctggtcttgaactcctgacctgaggtgatctgcccgcctcagcctcccaaagtgctgggattacaggcttgagacaccgtgccctgcctgaatattttatagatgatgctttgttaaaggaatatctagactttttagtctgtcttttttgattttatggaaaatacttaagtccatgggattccatttgttttctcccctgaattcctccctaggagtgtccaatttttgggaaagttgatccccctctcccagagtacaagaaaattccacaaagagcttatgttacatattagttatttggaactcaataccaataaatccaacatgacttggctaactctggaaatcaggcatacctgctgccatcctatccttgtgtcttgggcttagttaggggtaaagaggattcctgttgtttttgaacaagagatagtagctttttgttttgaaatcactgatcctcacaccgcaggatccagtttaagcaagtaagcggggtgcagtttataaagacgcttcccttttttgagggaaaaggtacagttaagaggagatagggtgaccagtgccaattaataggtagagactgtgtttgctatactccgaatactgtgttgacttctctggggtattgagaagagttacatattgccctcaattcttatatctcatctgtggatgtgaccaaaggtggtaactgtgtcatttagaatcagtttatgtgatgaagcagtttagaggaggggaaggctggtaaagatgtgtgcagtcagtaaagcccaggagaacacaatttccagatcatcttcctccaacaggacacaatggtctggggaggaatgcaattcagatcaagttgttggcagatcaggcatgggaatgcaggtctcctgggtgggatttgaaggacacattaaatggtacattacggagggatctgatgaactgggatcaaatgagaagggcctaggggagtgcatatgccaataagaacaaagagtatattcttaataagaagttacatttattttacttattttattttttatatttatttatttatttatt

SEQ ID NO: 111212 - DNA, 1027 bp, Homo sapiens
tatttggatgccatacctctaggtgggagccgtttaaattttgatttcttgttggtgagatatgaccctttgttctccagggttcatcaggatctcagcccctacacactaagcctgtctcatgttctgatagccttttacatcttcagagctttaactttctctcatctgactttaagttctatctttggttctggcccagggatttatttcttgtgattttgatttttttcttagtattttcttagttgttaatgatctctccctcagtttttccacgtgtttgaaacaggcagagcccttccctgtcacctcagctcaccatgttgattggaaactttattaccaccatcctattaaagaattttaagatatttttgtcaccaaattgcaatccctgatttctgcagaactttagatgttaagtattaattcagtgaatgggtgctctgcacatccctctactgagatgccatgaacctgagtaaccacatttttgtagtgtagcatagtcttatccgtggctacctccttacttgtagataactttctgtgcatgtctcagagtccgtcagttagattctagatttttacatggcatgtgaacccaacctgtaaaattggtgatctgaggcctgttgaccgccattattttcagatactcataaatacagaccttgttttcacatacctagtacataatcttacatcttgatgttgagactagtaaagaaaggttacttctatgtatttatctttcactgaagaaagaaatgaaatttcaatagtccaaattaagtcccttctttgtaacttgctcttgctttttttttttttaaacctctcttgtaattcgctacttccagggtagagatttgcagtcttattttgttgtaataaaagagtgtcctttttgtttggatgctctggatctatcactttcccttttccagcaaatagagtgggactaagaagccctgtgacaagtcttcaccaggaggaatcggatgccctggaaagaagccta

SEQ ID NO: 111213 - DNA, 1037 bp, Homo sapiens
agagacgttgccaactattttctagaaacattgatgcaatttggtctattgcctccaaatcccaatactattcattatgaacttactatagccagatttatctttcctgtagcccccacttacccagtttcatttctgtgattgcagtttcccatagtacagtacactaagatagttatgagaaatagagaccacattcacttgctctattttattattgggtatcattgttaatctcttactgtgcctaatttagaaattaaactttatcatcggtacatatgtataggaaaaaacatagtataggtagatagggcttggttctatccatgatttcaggcatccactggggatcctggaatgcatcccccatggacaaaggggagctactgtactttccttctaatatccgaggattgtggactcccctcttcttcgaggtcagtcccttcatctgtactcctgaccctttggcccacctcttttgagatctcaggccatctttacctcttcccccttagactttcagcctctccccctgaactgagtccttcagcctgtagccatgcgctgtgagcacttagtctcttccagcagccacgcattccctttcctgggctcttccacttgctctgtttattctgttatctctgcctccaccacttcactaaaacagctctccatcaaggtggacagtgacttcttaaatgtcaaatccaaaggtatacttttcattttttatctttattcatctctttctatcccgtggtacctctctaccattcttcctgggtcttcttcaaaagatggttttcctctgcacattctgttatgtgtgttctccaggattctgcactgatcctgtaatgttctccttctgtctatgttcctgcagtgacgtcactcactgacacaatctctgctcctttctatgttgtaatcacttttatgcctttatgtttttctcaagctgcttctccaggctttacgctcaagaatatctcagtatctccccctgaatcttccacgcttcaatt

SEQ ID NO: 111214 - DNA, 1049 bp, Homo sapiens
tttcattgcacaccctgctaagcattgctgccagcactgtggggaccagctctttggggactctgctttcccattttcctttccatccctcatctggaaacatgtccttaattccctagagaagatagaagttgagtttatgacttaaaaataaaacaaaacctgctagttatggcaggcctagacccattcctcactgggccctctaccaggctgcctctctggtttagaccatccaatccctacttcagaagtgactgtcagcacagctagatatagaatctaagcatcaaagaggatgaggccctggaagagggagggtttcctccttccttctcccaagtctttccttgctagtttccatttcttatctcaggatctgcttcttcccaggataattgaaaatgggaaatccacctctcacagcgcagatcctaacccctttccacagggctgcgatggcaatagccacagctgtcaaaaagtctagtatcagtacagaagctccccatataatcctaggaagttcctttgctagggcaggggtgagttgataaaccatagtgggtgtatattgatgtggtcaagagtctttgagaaaccactttgtggtgaccttttcaccaacagactaaggtaatactcctgacctttagctcaggagttcgattagagaagatagaggaacacaggaagcctgagtttacaatcatggttgtaccacctccttatgtgaccttggagacatcaagtacctcttctgcagttctcattttcttatccattaaatggtttcacatgtaacatgatttttaaggtccttgtcaatcacgaattctatatatctataataactcctaaaagtacctcatacaagttttgaatagattcagcttgtctgtatctgaaggtgacggttaccattcttaacaccgacttggtttgtgactgcggctgttttgtggaggcccacgcatctattgctggaaaaggctatccccccattatttggtattataccgctgtcttggtatgcttttgaaatacaa

SEQ ID NO: 111215 - DNA, 1567 bp, Homo sapiens
caaaaacaaacaaaaaacaaaacaaccaaaaattagctgggcgtggtggcacgcccctgtagtaccagctacttgggaggctgaggcaggagaattgcttgaacccgggaggtggaagttgcagtgagccaagatggcgtcactgcactccagcctggcgacagagcaagactccgtctaaaaaaaaaagaaaattatagtgatttttttctttttttagtgtagagagatagggtcttgccctgtcgcctaggctggagtgcagtggcacaattgtagcccattgcagcctagaacttctggcctcaaaggatcccccacctcagcctcttagagtgtcgggattacagcgagaaccatggtgcgggacctgtagtgctttttaaagtgaaataacatagcaaagcactggcttgcagtggatgtggaatcaatgctgtgtggcaaagatatttaaaaagtgccaagtgagcaccatagatggaaaattgaggaataacagagaaaaagagagagtattttgacttggagtgtgcgaggccatgtggcctgtgtggccttgaggatgctgatgaggcagagaaggtatgaagaatgggccagtgggaagagaagcaaaagaggaagctgcagttttgagactggatagaccaagaaaagagataggagaaacaaggggttgggtttgttggggtgatgtctgtcttagacatgtcaggtttcagggactgctgaaggctgtaggcctgggtgcgtgtgtcagacactgcccttgatgcaggctcagccaggggtgggtgaggaatgaggtccttggccctccctgggcagggtgtttggtcagtgtaaatctggaaaagggaatctttctgacttgttggaaatgtccgcacctgcacagcgtttctcaccaggatgggaaacacaggctgaatgttttaaaccttgaagacctacctcttcttcagacttgggtagaggagaactgaacttttctgtgtaatttttacccactgtcatcctcttccacgggtctctttttttttcttctcaacgttcttcctcccaactgagaaccattaattgcttcagaaaagaaatagaattggatttcttttttttttaagaaatggactaaatgctctaacactgaagaactatattcctatgtgcgtcagtttcttttcaaccattagctcctttatgatctctttatacagggtgggtatagcccacaagtaactatggttactagtttttataggttgtgaccagtctgctgtataaggtgttaacattttgcccaatctgccttatctccatctcttctgtttttttgtgtctgtgtctctttacacgcacacacttaaaacatgtttgctgaaccatctgagttagttgtagagattatgaccttttcaacatgtatttctcaagcacaaggatattttcccacatagcctataataagatgatcaccaataaatattatctgatatataaataatacttgaatacatgttcagatttcacctgttaccctaatactgtcttttatacccgcctc

SEQ ID NO: 111216 - DNA, 1016 bp, Homo sapiens
gaatttcatacagaatttcacagtttttctttaaggaaaaacatcaggtaggactgtgggcagaactatagtatgaaaacccatatcctgcagtgagaaactcttacctggaagcgggaaaggagtagaacgcagagtgtgcagggcgctgccaggcctgctataaccaggagtgccctgcataggccatgggatggttgggtgccttctttttggccctgcctgtatcccagatacttgtggccaagcaagtccctggaattgttgcaggcattgcagtgggagtgaaatgcccaccagctgggctacatcttccacgactgagggaatataacttggtattcattggaactccactgaagagaggtcgggtgctttgggagtgttttcttgcaaatatgtgccctctaattgccttttcctaatgatctctcctcattctgctttggaggtggggtttctccaaggatcatttcttttccacctcacctgcaggtgcacagtgaatgatgctttaatttatttcatttcaccttgctgtggaactcagcccatcccacctctgctgtgagaaaagcatttccatctgtttcaactttcctgtggttctgttgacccacttggaagagctccagtgtagtgcctgctggtttttttctatctgcccttaatttggtttgccttttattgtattccaactgaacggattctttctctttcttttaagggaaaggacctgagaaaaacaatacttgtaatggcgactgcttgttaagggtaattgctgtttcatgttaatttgcatgttaaaatgagaatatagggaattgctaaattcaccaacctgttctatcccaaggctagtccttttaagtatatttgttgcttaaataaagatggagctatgcagaatggaaatgtccaaatatgcagttttttttgtgcatgtatatatagagagagcatttaaaatttttatttccatcagcaagagtcattatacaatacatggaaat

SEQ ID NO: 111217 - DNA, 1062 bp, Homo sapiens
gtaatagccaagctcctcccactcctaggcctgaggggtgagggaggaagcagtttccaggggaccctatatagagagccacctgacaggacccagggaatatggtgggaaaggatttggctgaaccaaaatgggagccagtgggcaagacagcctgttgttaaatgggtcagcttcccagaacacacaacacggtggcagagtagagggcaggtggaggatttccatcctaggggacacctcaggagtcttagctgcatcccaactctgtcgctttccctcactcccaccaccagccacaccacagatgcgcacgcatgagcgtgtacacacgcacgctcccaagtaccctctggtattcttccattgcttttctgaccaggacagaggaactatttattaattgtgaaatttgaggacatttctcattatttttgtggtatttgatgctataatatttgcaagacaaggaacatgtgggtagctctacgcattccattttccattcctgataaaaattcaaagcacgtatgttactgatgctagagttaaacattttattttttaaaagtatcatttctaattggctgcagaaggaaaaatacagtaagcaggacattaaaaatcttggggaactatattcagttttggctattctggttacaaacaaagcaagcattgaattttagccacttcaaacagttttcgttttccaccgttgagcatgttaaaactgtgaagacacagaagtaccattcagtaaactgcttctttcagcagcttctgtgatatcccagtactttggaagccttccattttctttcaggtacaagaagttaacaccctgaattagtcactatctgtgtatataaagccaggagctttatattttgtactgaggcagagctgaagtttttagataatttgatcttttaaaaatatttgacttttcacttgatttaggttctgagaatcaaaggttctactaacaaaatggtcaacttggcaaagagaaatatgcagaagtcaattttaggctgtattttgcaagagcgcggtgcc

SEQ ID NO: 111218 - DNA, 1060 bp, Homo sapiens
attcatttattcaacaaatatttagtgagtgccggctgtctgcttgccactgttcagccagtgacgatgaatggtgagcctaacaaaagcccctccttggggaccctacattctcataggaggagatggatcgtaagcactggggggaagaagcaccaggaagaaaagacaaagggggagagagagagagagagagctggggcaagagagggctgctggagatgtggtgctgggccaaggcttttggccacaagaatcaggtgagtaggaatttgtgacatgaagactcaggaggtggcattccaggtggagggaactgcaggggcataggcccccaggtggagccagtgcggcgtgtttgaagaatgggaatgctgttctggaggccagggcagaggtgaggacagaaaaatattggtggggcgagggacaggtttcggagggcatggcacggcagggcagaataaggacttaaaacatttttaattctgggagagacgaaaaggctttgagcaaagaactaacttgatctggtaatgttttttaaaaaaatcactgaaattacaagatatatcctctgccttgtggtttattgcagataatggcattttgtggattaaaagaaagaaaaaccctttcagttcaccagccacaacagttagctttaagagtgttataaaagtaggatcaaaacaataggaattacaggccaggatcttcttaggggagtgttcaaagcttcaggtatccatatcagtccaggtcccataagaaaacaggtggcatatggtaggtaatgggaagacaatggactctagtgtggagggaatgccactcctaccttggtgcttcaggacaattaatctgctagtgttgtttagaatggattgaagaacagaggggaagaaggtagggagaccaaattgtttcattaaattatataaaaaattttcaaaaaaagtcagcttctattgtggaggaaaactattgtacagaccccagtcagaacagtgaagatacttgtactgtcctcaagtgtcattgtacttgttgattaaca

SEQ ID NO: 111219 - DNA, 1056 bp, Homo sapiens
gaagtactctcattctctattttgtatctagggccacatagatgtgtttgatgtgaatcacacctcttcattatgtgtggccgactcttctgagtaataccatgaaaagtgcttcttcaaattccatatcttcacatattgctgttatgtaagaggaatgagactattataattgagtgaaatttaaaatcttgtgctttaagttatgaaataacatgcttttggctatgccatcctgcaacctggccttttcagcaaattttgtagcttgtggggacagatgaccctgaattccagcagcacctgcaatcaaaatagttctcattccagggcccacacaacagggtgtgtttgaaagtacttaaaaggaaagtgtaggcaacgcattgtacccttagtcataaaacattatcctggaatttgccttgccccaaagcttgggaagccacccttttctccctatcccaaagtttcattgtaattcccatttctgaaaagaaagaaagagtacgatggaatttcttcactaggatggcagattgaaggtacttaggtgaggaaagagacgctaacagagcttgtgtgacaagatgaccaaaatctgggtggaaggatagtcttagaagagtgattaagtgatgtttatttacccaaataaactatttttccagccaattataacaaatgcatttattccatgtttaatcagttgtagaatatccagcagattcatggggtagaatgtattttatcaagacaaaaatagccagcttgagaaatgatttaaaccagagatcagcaaactacagcttggaggccaaatccagcttgccacctgttttttttatatggcccatgagcctagaatggtttttacatttttaaatgcttgaagaggccaggcgcggtggctcacgcctgtaatcccagcactttgggatttggggaggcgggcggatcacgacgtcaagagatcgagaccatcctggctaacacggtctctactaaaaatacaaaaaattagccgggcatggtggtgggcgcctacagtcccag

SEQ ID NO: 111220 - DNA, 1061 bp, Homo sapiens
agtggggtggcagggatggtttcaggatgatctaagcacgttacatttattgtacactttatttctattattattactacattgtggtctataatgaaataattttgcaactcattgtaatgtagaatcagtgggagccctgagcttgtgttcctgcaactaggtggtcccatctggggatgatgggagacagtggcagatcatgaggcattacattctcataggaagcatgcaacctagatccctggcacgtgcagttcacaatagcatttgcgttcctatgagaatctaatgctgccactgatctgtcagggggcagagcccaggaggtaacgtgagcgatggagaccggctgtaaatacaaatgaagctgtgctcattagcccactgctcacctcctgctatgcagcctggttcctaacaggccacagactggtaccaggggcccctggtgtaggggataggccagataagtattcacatgactgacatgcagtgtgacaatgtatctctagaggtaagaacaaagttttgtgggaacagagatggaattaggaattctgttgggtggtagactagcagggagggcgattatttaacaaggtagaagaggattaagtcttaggaacattaaaaaacattaaaaagatttaaaaaatagatttaattcaattacttgctttttgagtctaaaagaagggaaggctttccagagcatatagttaaagtaaattgcagataatgaagataatttcagaggttagtaatggtagaatcttgtttatttactctgaatacaattgtttaaggcctagccaaatgagaggctatcagaaagctgtctggagttagttttaacacgacaaggtaacagctgctgttctcaccagaacctcagtcagctttctgttttaaggagaattaaatgaatttaaagacttatttcctctttttaatgatagagttttcattaatattatattttgtaattacactgttttttgggggaaattttgcagcaagtacagaaagtttccatgtgacttctactgccagtttcc

SEQ ID NO: 111221 - DNA, 1051 bp, Homo sapiens
tgccaaggccccagtgtaaagattccaccattgtgtcttgtgtttttcaggatgccaagagcatcagaaatgagtgtgccaggagtcattaagggccctgctcctgtgagtaggtaacaccaggaggcattcttttatttatttaatttatttgtgtatttgaaacaaggtctcactctgtctcccagactggagtatagtgacgtgaacatggctcactgcagccccgacttcccaggctgtagtgaccttcccacctcagcctcctaaatagctgggcccacaggcatgtcccaacatgcccggctaattttttaaatttttgtagagacaaggcctctctttgttgcccaggctggtcttgaacgtctgggctcaagtgatcctctggccttagcctcccaaattgctgggattacaggccataagccaccatgcccagcccgttcttttaacttagtgacagttttatggcatggccagtgatagagaaatttggatgcgataggtgagggagggaaacaactatggttctctgtctgtggcaagtttgcagagtaaaaaagaattttttatttctaggaaagtgttgttcatcactggaagtgttactggacacttgggttttgaacgtgtaaattaagaacttctgtgatcagataaatacttcttcatttgttagctctgttcagataagaggcagaccgaagatcaggctaatatagcatagataccccatttctgatttgtattcctgcagtcttaaaccccttatttaaaaattctcttaaaatacatgttaattgtagaaaatttggaaaatactagaaagaaaatacaaatagctttccattccataacccaaaagtgctgttgttcatacttaggtgtctttagattatatgcactcagtttgtagaacaaaattgggatcataccatacatatataacttgatattttgctttttttctgctgttcctttcgagatgatttttgggactgaggtttcaactgaaggtagagattaatgtaatgttatgcttagcaca

SEQ ID NO: 111222 - DNA, 1046 bp, Homo sapiens
tgatctcccttttggttctgattgagttggaccttgtgggaggagaaacatagatgttgatacatgagcacatatgttggagagagaaagttttatcttggcataggacttttaaaacacaaggtaatttttaatcagttttgggaccaaaaaacactcaatatgggaaaaatccaaattctgccaaaatgtctaaagaggtttattctgaaccagtataagtgactgtggtctaggttacacaatttcaagagatcctgataaagcgtgcatgagagagttgggctacagcttggttttacacatttcagggagacaggaattgtagggtaaaattatggcacaggacttttaaaatgaagctgtgaaagtttacagtccatagagaataaaaatctagaagtttaaaagaaatgattggtagtttctttactcgttcagaaaaacaatgccatatttcccaaaattcctggttatggaaacgcaaccaggaaatggacttccttaaggcaaggacgaccatcctttgttggagacatttgattggttgtactattgccaggtgcatttgtgttattttacaaattctagtagaagcgggtataatggtaggagctgggcagagaagtgtttccagtcatttttcctattagaagccatctctattggaggaaaaaaacaaggcctgctgcctccaaaggttaatcagtaatgacataattcaaacagctggagaactggggagaaattggagtttagcaaatgatttcttgcatgtgcgattgtgttccatttctctccattcatttatggagagaatgataaatgtatcaagggtggtgaagtatataaagagcattgttttttaaatctcagtaatttatggacctctatttagaggaaacatttctcacaaatcctcagtaataaatatttttattatgaaggagcttcaatataaactaggtataaactccttacgcgtctagctcttacttaactgtaaagcagtgatagatttatagagcaaattcaaacaaaactac

SEQ ID NO: 111223 - DNA, 1067 bp, Homo sapiens
aactatagggataatttttcttttccttaagaaagtaatcttctttctctgaaagctgaaaatcagcttatattatcttttactcctcctgcctcctggccccaggtattcagttgataaaccatgtcacttccttctttctttggtcattcttgttgacctagtgcagggacccatcaggtggattattgaaatccaaactggaatcctcacttctaatacactcactaatgctttagaatacagatccagggctattcccctattcaaaaatgcgtgatgattctcaaatctctcagcagatatgtggtctatcattaccatactctttccccccagatcttttacccacctgtgctgctgctgttttaaaatctgccggaatcatccctgccttgtggcattacccaagctgtcctctatgtcacattgcatgttgctccatctgggcccaaactgccattttcaaagtctagcctaggtcttaccttatcctggaaattcttctagagtcctcttaagtagttctcacttatcttccttgaattaacattatagagcttatcacctttcttggattgtgtcttcccagagataaagaccatatcttattcaccttgttattccacacaccttgcccttattgatactcagtggatatttgctgaattgaatcaacaattaaataaaatttattatttattttaacagagtcttactctgttgcccaggctagagtgaagtggtgtgatcagagctcattgtagcctcaaactcctgggatccagcaagccgtcctcccacctcagcctcctgagtgctgggaccgcaggtgtatgccaccttgcccggctaattttgtttatttttttgtagagacatggtcttgccatgttgcccaggctggtctcaaactccagggctcaagcagtcttcccaccacagcctcccaaagtactaggattacaggcaggagccactgtgccttgcctgttctcttaaattattttatgatgagcatgtatgtgtgtctatgtagagggtgagatagagagagaaagaatgca

SEQ ID NO: 111224 - DNA, 1038 bp, Homo sapiens
ggtacttctctgaagtatagttttctgcctaagaactaacacactcttgaattctccagtttctcccctggccgataggaatctgtctagttatctctgaagaaatctccgtatttggttccttcatcctttgcctgagaatattgcctgggtccaggagaatttagctgctgttacagtgtaacacaccctgaaaaaatcagtttgggtatttcaggcccccatttttatgttaactaacttatgattttaaatggtaatccttctgtgaacagggactacttaggatagctgcgatttagcttgcttttattagttcatacctgagataaaagcgagtttttcatgttttttaagcaaatgaaattttagctacagttgaactttgttcccatggaagttattagtagagtctttggtgttggagaaagagtctgaatttccttgtagtggtaataaccagaattttgaaagagaagatgacagcgaggctgcagagggaagtgaaaatgtactaatgatgagtatagatttatttcagagtaaaaaaagtgtagtgtgttaattttagaagcatttcctttcttgatgttttaccttgcaacttgaagtttttcaatatcctaaaatgagctgatttgacagtcaaaaagtatccttgaaaaaaatgacagcttggcatcttttgcctggctgacttttcccccttccatcaggtggaaagaaaaagcagtggtaaatttcaggcatagtcagagggaagccatttttacataattttagtagctcttacttgagtgcttactgtgtccatactatttcaagcatatggatttcatttcaagctgaggatgtgggcagagcccactcccattgcgtgaagtgcaaagtactgtaccaggcattggcgtatgagagtttgtaaaccacacttagttcctgccctctggatgctcctaatctagtgggggagaccaagagcctaacaaatcatcatttgaaatggtggtagtttctatgaagagtaattatagagtg

SEQ ID NO: 111225 - DNA, 1825 bp, Homo sapiens
taagctgtcttgtgttattttccctcattgcattagcttttcatttgttttgcttctttttcttaaaactttgatcctaaactatgggccagtgtagataagctacaaaatgtctgagttcagaattgaactaaacccatggttttggattactttggtttacggccagaattactgacattttttgtagtgatagtaagagaaaatgttttgcagtgtctcataagggactttttatatattactttttgattctgcttttgttttttgacctttgggctggtaggtgggggccaagcaggattgggagggggaagaagctggaagtatgctttctgtctaatgtaacccagcttgtcctctgagggctctggtttaatttggttaatgctgtaaactgctaaaaaaaaatacattctttatgggaattgggtgtagatataatgttactaggaaagagacaataagcttgcagttttacagatggtctcattttctttatttggttagaatctctttttggactctttatgctttctgtgattggtgtgagtctttctgtttttattttgtccgtgttttattaccaactggttatatttcagtaacagagccagggggaccagaatctcttaaatattctgtacagaattttgtgtttagagtgtagaccctcttatctgggaatatcatgaccagcagctggttagttatttaaggtggagaaatgtgaaaaatgttacattcatgtcttaaacattttatttcaaacatgtttgctaatttctgatatggggccaagtcctgataagtggcttccatgttggttttgtacataaacttcacctatgatgcatgatctacacagttttcagtttaggttgctttaaagtaagaactttaaaatacttgtgaatatcttgagtgtagaatcctagatttttatgatttgccttccagtcttttgctgttttcttcctcacatctaatatcatggcatttattttagtgtttaacttttattgaattattccaaatcattcaaacattcaacttcattttcgttgaaacattaatttatctgaataaaaaaattaaaaaacattcatttctctgaatattgtgtttatatacaatttactatgtgtttatatatttaaattgtaagaacaactggtgtaaataggaataaacatatctgaccatagggaatgatacagcttgattggtgggagcagatcactactttttaatctgtatgtgatgaaaatctagtcttttttatttccaatcttttgtggacctgtacttttacttaaaaaacaaacaaacaaaatacaagccttattttttaaatttatttttaaaaacgacagaaataaagttacattttaataaatgtagttggaaaaaacagaatatagggaagaatttctaaatgtgtactttgaaagtgtacatgtcttggcaattcacaaagaattactgttactcttgttaatttttattccatttataactaagcaaaaagttatgagtgaaataatgattcttcatattaaattcctctgtatatactttgaccaaactctatgtatatcaatatttagagtttttaatgtcacaaatgaattcccatcttgcttgttaacctatctaactaggctgggttggtgacaagcttgtcttgaggctaatgtctatccaaactatttctagttttccttaaataatactcatggtagaggaactgatcttatagagggatgtggatgataatgaatgaaaaaagacattttaaaggaattctggaacgctcaggata

SEQ ID NO: 111226 - DNA, 1166 bp, Homo sapiens
atcaagtagttgggactacacgcatgtaccaccactatgactggctaattcaatttaatttaatttttgtttgtttgtttgtttttttgcagaaacaaggtctagctaagttttacaggctggtcttgaacttctagactcaggcagtcctcccgtctccccctcccatggggctgggattactgacgtgagccactgtgtccagccaagtttactcttaaggaccctgaatcaagcacacataaccccaccttcatgcaggtttactttgatttattcgggattcacaggaccatggtgtttaaaagcatttgtgtccttgtaagagatagcgaggagggggtcaggcatgctgccttacactgatggaagctcttcactaacccaaacctttgcccacagagacaaatgatttctcaggtttgtgtccattctgagagctgttttgttcctgtactttccctttttgtcttatctgatgttggtctcttaaattcagcattgaaatttaagtatgaaagaaagagaaggattagttggatgttgtttgtattaaattctctaatgagttaacacgttatcaagtaccattttgtttgctttccctgaggttttaaaatattatttccaagataagattcccaggcagctgtcttccttacttctgaatttatatataatctagtgttattaaccctttgtagttcttttttatgccagtatgtgtctgttttgggaatttttaaataaagccagctgtgttaaatattcacagaatcgattttcacttgcttaaagtctttagtgatttatcttcagggagtattaatacggcagtaattctgcattacatttcttgtaccagcatttaattgatgctatatttcatgaggattattgcaggtttattgctgttatatttagagttgtggttctgggctggtaatctagaagcgtgagattcccaaatctgttgttccattttaattgtgtgttcttttgagctgacaagtttgagaagggctgttaactatttaacagacctgatagataaaaactattttagtagagtagacctggggatactttacctgtgtatgttgtgtgaatctatttttttacatgacggtagatgaattgaatctatacatatttttaaattgata

SEQ ID NO: 111227 - DNA, 1091 bp, Homo sapiens
gacagggttgctccatgttggtcaggctggtctcgaactcctgacctcaggtgatccactctcctcggcctcccaaagtgctggaattataggcgtgagccactgtgcccggccatgctagtccctttcgagcaagttctagctcctttcttcctaacaggatagtatattaatactgagttcttaaggagtaagagtgtgttaggcttacatagaattagtcatgaagtcataagggaagaaatatttgacctaaaaggatgtttactgcgattcacttgcatgaataaagaaaatgaagaaattatacataattagctcttgggataatttacatccaaaaacaattttaagcacgtttcaatttcttctttcacgtgtcttaaaatcaagagttataagcaaagtataattaacccacttgagtttcatcgtctcccattatccaaggtaagggagcggaagacccaaaaaggcaaccgaaagagtagcgtgaaacaaaagggcccttgagttgtagccttgcccctggcaacttccccaactccccacaatggcttggtgaaacagtttaggaaaaactctgtgcctgcttggaattgaatgtgggtgaaggtgtgaacttaagctttcagaaaacctgtgcaatttcataatcaaaggagatattaaatgtttagtttctacaaggccatattagctcttaaaaagattttttaaatgtaattgatgggattaaatttgatcactgacgttcctgctcttttgaagagagcacctattctgttaacccataggattcatttgatcaaatgtgatttttttttagatgaaagggacttctttcaggggttcattcttctccactgagttcacagagggaaaaaaggaaggaagtagaattaaactatacaatgaaaacagctttggatttaatacaggagaagcttttcttaatgaggcctcttgaggatggtcatagtgtaggatttgtaaatcattcccttgtagacaatcaaggtaaagtgatcaggagtccttgaaggtgggaggtcattctggtccactggaagacacaagaaaacatgtgc

SEQ ID NO: 111228 - DNA, 1021 bp, Homo sapiens
tgtaagggttgacacattgtatttttgaacttcttggaatctgcttaatggcaaacaggttgctgagaaccgaaggtcttagctgcaaagtgagcatacatacacagccctgcaaagctaggtgcataccagacaagtgaataacatactaattattatcctaccttggtagtaatagaattgtagcttcaggcactatgtaagacctagctttttgagctggcaaaatagtgattactatttttagttcaatttctgctctttaaaaaaacatagtatactacttgctactcctggatggttttatgtattttaattaatgttatcttattgcatttgtaccctgaggctgctttagtgaaagatataatttcagaaggctgatgaaattagataggtctgactaggaagactctgttattcatatttatggttataaaatatttcgggtacatctgtgtaagacattcttgtgctataaacatacagacactgttgtgaatcaatttgccttagagtgtggtagagtagttacagaccagtatagtagctctagtgtgggggtgatttgttgtttttgttgggggtgtttttggtattaaacatgactttacatttttcacttgaaatctcatcgtgcagtgctgtgtaaagaaatgaaagtgattctaaaccaaacacacacaacactcctcagctctattactttatagtcaggcttaacacattctgatggaattggcatgaagtacgtgaccaggtagaaatcagctttatttggtctaaatgactagccggttatagggcatggaaaatctattttaaatcactttccagagccaaatgcaattaagatgttgcaataaagtgaaggccaattctctgagaaagaaagaaatactattttgaatgaaaaaaatactattttatttgacatagtcaataaagaagaaaagctataataaactatttataatgataatgtgcagagcagagttttctttgaaatgggagttaagaa

SEQ ID NO: 111229 - DNA, 1717 bp, Homo sapiens
atcattactatagtgaaccaaattaacatatccatcatctcacagttccccattttttttgttttgtttttgtgccaagagcagctaaaatctgttcatttatcaggaatcccaaatatagtacagttcgttagattcctagtcttgttcatcctacatatctgctactttgtatcctctgaacctatatttccccacctcccccattccattccactgttttattctctatctctgtatgtttgatattaaatttttttttaagattccacatataagtgagatcatgtggtgtttttctttccgtgtctggtataataccacttagcataatatcttctaggttcgtccatgttgtggccaatggcaagatccccttttttaaggcagaataatattctgttgcatgaatatatcacagtttctttatctgttcctttgtagatggacacttaggttgtttccgtatcttggctattgtaagtaatcctacaatgaacatggcactgcagatatcttaatgagatggtgatttcatttcctttgggtatatgcccagaagagggattgctggctcctatagtagttctgttttgagtttctttggtaacctccatactgttttccataatgactacaccagtctatattcccaccaacagtgtacaaacgttcccttttctccacaccttcaacaacatttgttatctcttgacttttttgacaacagcattcctaatgggtgtgaggtggtacctcatagtgcttttaatttcaatttgcatttccttgatgattaattgatgttgagtttcttttcatatatctgttggccatttttatgtcttctttaggaaaaatgtctatccaggtgacttattcattttttatcaggttatttatttttctactattgagttgtatgagttctttataaattttggatcgtgaccgccatattaggtatatggtttgcaaatgctttttcccagtctcataggttgccatttcattttgttgattgttttctttgctgtgcagaaaaggttttgatgtagtttgatgtagtcccatttattaatttttgcttttatgacccaggcttttggcgtcatatccaaaaaatcattgccaaggccagtgttaaggaacttttcccttatgttctcttctgggagtctttatggtttcgggtattatgtttaggtcttttatccattttgagttgatttttatgtatggtataagataagggtccagttttgtccttttgtgtgtggaaatccagttttcctagtactgtttattgaggagactatcctttccccattgtgtcttcttagtgtgcttgtgaaatattagttgactctatagaaccatcttctttcacacttggatttttaaaggagggttgggggagaaataaaaataaatgaatgcgtagaaataaactttaaaaagatttgatagctgttgatgttgtcagtggacaccaggttgggcaggggaattagattgttgcagattgttcataacctagccacgtggttcgattatgttaagcacataggcattaataagggggagagaaggctgtttattggttaaagtggacaaaggaggaaaatacatgtggtagaagttgtccaccctcctcatcctccccactccagtcctctggtcccatgagtgaaatattttatcagtctgagcgttc

SEQ ID NO: 111230 - DNA, 1038 bp, Homo sapiens
cctcatggtgccacagttgactcatctgtaaaataggactaaaaagaacaccatcttcctatagttgttttgaggataaaacaatatatgtatagcactttgaacagtgcttgctgctattatatttcaaaaaccaattgtttcaaagctaaaaggaaatgatttttgataattctacaaatatctcctgaacttcctctttaatgacaggccatatgctagccagtaagtgtacatgttggcccaggcagacaggatccctgctttcctagatccatcaggcgcttattcctccattaacatgaagaagaaggacatgttccttgtggtagcattatgggcaagagctgggtgtagcctttcctgtggacctcagagacatgtattagggaggtggtgaatatggagccagactgcttgggtttaaattctagttcttatcagctctggccttggggagtgatagaatttttgaattatttctctacctccacatctgcaaaatggagacaataatagcgcctttctcagtagggttattgtaaggattaaatgagttaaaatacttaaagtacctagaatagtcagcacgtaatgaatattgttatattatcaaatgaaaccagaaaggcctcaaatttgtaaattcattcttttgcattttattaagtgtagggagttaatgcataaatcagatggagctcttttccacatagagctcatagtcaaatgggggagacttattcgtctacatgttagtgaaatagcatatgaacaaagaatatgggggtagaaagaagagtgtgattaaatctcctaggagtatcaggaaaagttgttttaagacgggttttgaaggttaagtaggagtttgccaggcaacaaaggcagaatagagcttagaggatgtgggaggaagcatctctaaagacgttggcaggtacagcagacacccagcagtcacagtgctacaagagtatagactctggagccaggattgaaattctgccagttactgttgtatgaccttgagtcact

SEQ ID NO: 111231 - DNA, 1518 bp, Homo sapiens
gcttgagtttagagtatccagggcagttgagcttgtagccctacctgtaagtatgctttggtgtaggaaatggccatagtttttgtgtttttctagttcctttttgtccgttggctttatttcccattgtctcatctcttgagatttttaatagctttgcctttcatcccttttttcccagggacccaaatttatgcccttaatgagcttttccctagagggctgagaattatatttatgattttccttagctctgtctattttgggaatggtgagaaaatgggaagcgggtcaggggagatgttgcattacttcctgattgccatagctcccttctctgtaaaatcccgtgaaggattgagaggcaggtggtagtgcttgcttagtaactcttccctttacacccaccagctccactcccaagttgggtgcctactacttccaaaataccccgtaattgggtcacaacattatctgcctgcttggaatcatatttaaaaatcaaagcaaagatgcagactatgtcagcaggatttgaaatgtttccatcctctgctttgaggctttgcagaattattctgaaaacaaaagaaggtaaacttgttatcccaatgaggtggcagtttctatgtggcctagaattatgcctaatttttgcttgtaaaagggctcaaaccatgatcctttctgactttccacagggatgtgagcttttgtggacatcactcaacagatcagatttactgttgaattttcataacataattgacttggaaagcatttcattcagtgttttgaatggtgactagagagaaattaagaagctcagttgttatatctttcgaattcctttcccatgacacagtcatctctcccctgaatgagagcagtggcctcctggcttatccagctctgttcactcagtttggcttcccaagtgctgggcactgttccagatgccacacgtggacactgaccaggatggccactgcctctacctgctcggagctctgggtctatagagaaaggctgacagctaaggaatgaatgacggtactatgtgatacgtattactgggagaaatactcagtgcttcccagacgagcacttatcctgcttgggtgtggggagtgtgtggggcaaagcttccaggagaagggatgctaagtctattccacagtgcacctggacctctatcttatggttccttaaggcaccctgactctagctcccgcatggagcctgctgtttctgaatgcgtgcctccaccttccctcccacctcggttgcttctcaccttggaggctgcacttgcctttttcctggtctctttctgtttctactgtacactgcctccaaggtgatcttctgaaatcttctgcagatctgggcatatcatcccaactcttcaggggctccttgctgccctcaggatgaagtctaagctttttgatgaggcaccgaacatatttcatgatctgctttccatctcgttcttacgacatgccagattttctc

SEQ ID NO: 111232 - DNA, 1975 bp, Homo sapiens
tctgcggggagactttctgctcttgagcacacagatagtctgagaaagaaacctctacctaggctgcaggggagggggtcctgtgctttgcttcccaggcccacccttgtgaaattttggcaagcctttcctgtgtcccagcctttgtctcctcgcctcgatgagaaatgcagcccttggtctctggaatacgactttcactctcatttgacgttagccctgtcactgtgttggacagatgcctgtgattggctgctgcagtagcaggagtggtggctggtgaaatgtgtctactcagtgtcattagcaggatcatgagcttttttttcttttttcttggcaagctgcgatggggcagagagcaaaggaaaccaatcccatttggtgtttttagtgcattttgctttcaagaggctcacaaaactcagcctcattaacctttaagtgagtcagtgaggagttgttatcccattgaaataatttttaataaagggagagtgactctagttcctctaataaccaggctccagggttcctggacccctgttaggagtgggtcattaactccagacattagatgagagctgggagagaggaagggcatagagggtggaaggtcaagtcacacaactgggcaggaagtaagaagcttgatcagtttaaaggtattagagctctttgtgtgtagagttacaggagatattccctttctatataatttatttccatggtgtttgaatcttatcttgttttctgtaatggacgtatatttattttataatcagagaaaaatcccaatatataatttattgatatataaaatgtacagattcacatggacaaatacgagaagagaacatggaaagaaatgaatggtatagaaaaggatggattaaagcttttctttgttgttggttaatgacttgacagtggttataaacaaagtttaccagttctaccctctcttttcctcttgtggaaatcttgcaaactttgtttgctaggtaataactgaagttcccgaagtgtaactcattggcaagtatgcttcaggaatgcttagagtgggaggaagagtgtcgttttttttaagttgatgaaaaagaatgcagaaaccgggagcagtggctcatgcctgtaatcctagcactttcggaggccaaggcaggtggctcacttgaggtcgggagtttgagaccagcctggccaacatggtgaaaccccgtctctgctaaaaatacaaaaattagccgggcatggtggcacacgcctgtaatttcagctactcaggaggctgaggcaggagaatcgcttgaacccaggaggtggaggttgctgtgagctgagaccgcgccactgcactccagcctgggtgaaagggcgagactctgtctcaaaaaaaagaatgcagaatattggaatcgaggtagaaggaaaaacgtgtgtttaagagggtgagatagattggagagactttgcggaattccagagggtaaagggaaatgccattgttgaagaaggaaggcctggcattactggaggtatgggatgtgtccctgtcgtgtaagtcagagctcagtttccacacaatataaaagtaaatgagtatctcctatatgcagagcataatgttagccccacaggtcatttattgttggttagtggttttcactgttcttatcacaatgatgataatgatgtagtgaatatgtcataattgttcaaataagaagatatgtccttttctctgatactatgcctttctcatttttgggtaagattcttttatgatttgataggaatatttttatctagccgctgaatggtccatgaaattggtaagtctgggaatctgggcctgagatgcagggaggcctgcccttgggattgagttgagtcatggaggccaggccaacatgtggagtttgtgggtcagctgatggggcccctgggctttccaggaatatagagtcac

SEQ ID NO: 111233 - DNA, 1382 bp, Homo sapiens
ctggagtgtagtggcgcgatcttggctcactgtaacctccacctcccaggttcaagtaattctcctgcctcagcctcctgagtagctgggattccaggtgcccgccaccacgcctggctaatttttgtaattttagtagaaatggggtttcaccatgttggccaggctggtctccaagtcctgacctcaggaggtccaccagtctcggtctcccaaagtgctgggattacaggcgtgagccatcacgcctggtctgttcagtgctttttatgtgtcctattatcctattaaggttttgtatatatcatcttatgctgtaagcatctatgcataaatgtcagctgtctaagaaaacccctctgaaaaggtagatgctcgtgatttcacagcaatagagctttaaacttttatcttatatgaaaatatctttaattgattccattattattcagtaagcattctcttttaaagcatctttgatttgttatttagaattaaatttgattggaactgcatatcttcagaatgatttgaatgttttcaagaaggttctatccagattttaaaactgttttgtgttcatttattttcaataatgttgcactaccaacaaatgaaattagatgtcagaagataaacccagattagccattttgattttaatgtgttattagtgcatattctgcatgctgatatgtgttgacggcatttctctcagccgaaatggtttgtcagaggcagagtaacagactctccataataaagggtctggggggatttggaggaaagactactaaccagggaccccaaagacttgcctttggggctggcttgtcccttacttcaattcactgtgttacctggaaaaagtcagttatgtctctgggcctgttttcccatctgtaaaatgagagagctgcagtcaccctctggttgtctatcgggtccttcttgtcccagtctagagatctgtgatgcagccattcgaggagagaggtcttcgtttaagagcaggggtccccagccccctgcttcggacctgaactggtcagtggcctattaggaaccgggccatagagcaggaggtgagcggcgggcaagtgacctttaccacctgagctccacctctgtcagatcagtggtggcatttgattctcacaggactgtgaaccctgttgtgaactgcacatgtgtgggatcttggttgtgcactccctatgagaatctactgcttgttgatctgagttggaacagtttcatcccaatccccaaccccatccgtggaaaaattgtcttccatgaacgctgtctggagaccactggtttagagcattatttggaggtgattttgtgtttccctgtctggtttgtcactgctttgt

SEQ ID NO: 111234 - DNA, 1064 bp, Homo sapiens
tgatcatagggcggaaggtggtggggtacaagtacaagatttcaattgctgttctttcgttgtccatgtactgtatgaccccgaagtcaccgacagtcttcgtaaactggatgtaaccacgtctctagatatttgctgagagcctttgagagacgactctaaagttgagatcctttccacagaaggtttttaggtcctatgcttttattccctcttctaatggatacttttaactgaataaattcaccttcaaggagccaatgtgaactggctttctgaaatttttataaagtggtaattgaaaagctggatggtgaggtgggaggattgcttgagcctaggagtttgaggctgtagtgagctatgatcacgccactgcactccagcctgggcaacagagtgagatcctgtttctgaaaaaaagaaagcttgatgagctaaagtgcaaaatactggtgtttacacttagctggagtaatgtgaatactgactccaaaattacttgggaaaaaactattgcatatattgtaagaatccacatgtacaaacataaaatatttttaaactggtactttttgtcatgtttcaaccttttgatgactgttttcttttcctgccaccagaaaaacagcatatgaacattgaattcttttatttttctgttaccacaggaatgaatactgaaagccttgtcataatattagaataatgatgtgtgtggactatcctgagtactggatatctaaatttatcttttaagaaaaatggaagggagagcatcaggaagaatagctaatagatactgggcttaatacctaggtgatgggttgatctgtgcatcaaaccaccatagcacatgtttacctgtgtaacaaatctgcacatcctgcacacgtacctggaacttaaaagttgaaggaaaaaataagaaaaatggtatgtcgtgtctctgtacctttttcaatttcattttaaaaatagacaatacctggccgggtacggtggctaacacctataatcacagcactttgggaagctgaggcgggcagatcacttgaggtcag

SEQ ID NO: 111235 - DNA, 1147 bp, Homo sapiens
ggcctggggcgggggagaccgggttggaggcggtgcgcccgggtggggactgcagaggggaaaagtgagggtgggcgcctgcgggaagagcgcacacccccttgtcctggcaccggcctccgctgtgccgctcggctgtctctcctgggcggcagcgcgctcctgccggggagttggagccggggttggcttctccacgaggggttcagaggccagcccatgagacatgaaaggggggaaaagttccttttccccctcggtggcagagagagcgtttaactagaaaatggctgtgcataggggaccgactccaggaaactggccactgggacccgaaagcccctgcgctgcccaccgggcggaatggagggtggtacgctagaaatgacatttgtgcggcgagaacagagctggacggagggaaggatgctgagacccatagaaacaatgaaaggtggtcttcacgtcggtgaagtggtgtagactacgggttcggggcaaacagccgagggagcatgggactagaattcaaaaaaataaattaatttggataaatcatatgtggagttgtcaccgaccgttctgtagtcaagttctgcgcggttttagagccacgactgtcacagacgtttttggatggattgagtggttgaggagggttaaaattgagaggagaataaggtcagtgtcggaagctccaactgggctctcggaggggacagtttgtttaagtccctcagtcactggctttacattgtgtctaattacttacgtgaaatacccaaaggattatcataaaatgatgccatcggtggtgtttgaattccaaggaatgaggaaactttgtgaggttggcatgggtttatcatttgttttaatatttcactgatttaaaaaaaacaaacacaatggcagtttgatctgttgtttctggagtttactctcttaaatcttgctttttttttttttcttgtcatggtttcagatttaaaatcttgtccccaaatggccataataatgcagagtattagaatttgtgtggctggccttttaggaacagatggaatccttgaaaggggatttcttcatgaacttaggtagcaaccttctcgttttcaacttgtagcttgtaagcaatatttgttca

SEQ ID NO: 111236 - DNA, 2702 bp, Homo sapiens
cggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgtaggtgatgcggggcgcgcctacaaggaagggaggagcctgcattttcgtggtacctactccctgggctcctgttccagcggtgcctgtcgccttcttgcccatccgtccacaattgccttaaatttggaagagaggcagtatctcagttccatctatcccgttatccagggaaatcattcatcctactcatgagttccctcgaacttgggctttttcgagcctccggttccggggaatggctgctggtttccctttaagggctataacctgtcaactcattgtttgcttctcagactcccacctagctgtagaatggagggggaagggctgacctaaatcgcagggaaacaattaggttcgctaattctccgcctccattacttgggtttctgatggtcttaaggggttcttctctcttctccactcccaccacttgcacacttggtttttagcctcttgaatgtatttcttaaagcttaatcattttgtgtatggtttctgtgtgggaacctccttcctcttcacttatccttgttcatctctgaccttgtagctaactgaaatagggggttattagctcagttttgaaagcacctttgcatttcccttgaaatgattttcctcctacaagtgtgcatggatagatgtatctgaaagacagcgtcagatttttttttttaaaggatagctaggatatttgcagtcttgtgatgtatggaatcccagtcattagcgcatggcattgtcttatctcctattgctgtcacttgaccgctgatgtgggagtgactgaaattagctttagcaaaacttggggcatcactctaaagagtgaggttaactgaagcaccgtcctaaggctaggtgttctggaagcatctgtagccaaaatcaagagtatgggaagttccaagccttcctcctagtaagtaagctaagtattgtgggtaaaaacacttatttacagctaataagatgatctcactgacatgtttttattgctaaagtcttttacttgggctaaaaggaagatgccaaattgttggaagtcgaattagcttcctggttgaccaaatcagtctcctgtctccagttgagcatcacacagaggttttttattagagcaaccatgatgactcggaggttttgagcagcattcagaggcaaggcctctgggaggcagtggtgcagcatgtttgcctttaaaagctgactgttctccttttgctgaatcttgtttagagaacattctagtttgtgttatgtttgaaagagctcgatactttgtcctttagtttcaattcaacctatcagatttatcgagcgcctattctgctacacagaatgcctactggacaaaacactgaagccgattgaaagaaaagttgaggttttataggttgactccaaagatgctaatgttaatttggaaggcatttaatttttgactaagggaatgttatgaccccctacatggaccacttctgaaacattaagtgctagtagactatttacagaatgatttccatggaagagctcaagcagccctaaaggatggtgctatcccattttaacatttcatctaattagcctagaaaatgaaaaacacttactggtcaatgaatactaagttgaggatccagttagatagaagcgaaaaagttc

SEQ ID NO: 111237 - DNA, 1496 bp, Homo sapiens
gtacacaccaccacacctactaatttttatattttttgtagagatggggtttcaccatgttgttcaggctggtcttgaactcttgtgagctcaagtgatctgcctgcctcagcctcccaaagtgctagtattgcaggtgtgagccaccgtgcctagccagatctcagtgtctttataactacaactggctgccactttctagcattgaccttggttgagatagttagcctctctaagcctcaattttctcctcagtaaaaatcctgtagtaatagcatcctcatagagttgttctgacagttaacagtatatttaccttagtgggcttagaatagggcttaatgtaagacatacattaaatattagctataatttctaaaaatcaagtcagttcaagcacatttcacttgaattgcaagataatttttaaaatacagcttacactcattttcaaaaatttcttgactttctttaggtagatgacaaggtgaatttccattttattctgtttaacaacgtggatggccacctctatgaacttggtatgttttactccatttttggaacccagtgtagtttcatgtgttctttcagactgaatttctcttgatatattgtgtgactttatggcacttggcatatcattgtttataaagccacaataacaaagtattctcatgagggcacttaaccccttatcatccccagagcaacttcctcaggcaactgactagcatcccctagtatcatcctttctgggcaaagagtacgtctgaaaaaggatcagtgcctgaatatgaccttacttgtctaaaaagaatctgaacatgttggaataacttctattaactagtttatggcatcaagaaagacgacccaccttgtaagattcattccttttgtattaatggagaaagacttgtaactcttgtctcaagccaagatacgacctacaggcttacaaaggcaaaggaatagtgaaggcaatctacagtcattggagggcagataaaatctcaggcgtctcctcctctcgcctccatcttccctatccccagagactgcatctgacttttgttctgtggccctttccaagggttggggcacaggcccctctattagggtagctgacttgagcttgtgcgatcttgtcaattgtagactagaattgcctgggatggatgcctagggacacttgaacctcatttgcagcctcttgcttcataaccaggcttccttctgtgggtttggcagtggtttttggaagaatctaaaacttccatctaggctaggtaagcacggtagccagaaaacatgcagagaaaattgacatgcctggcttctttgttacagatggacgaatgccttttccggtgaaccatggcgccagttcagaggacaccctgctgaaggtcatctttggaatgcatctcttcttaatgtgcctcacaattctttggctaaattttctattctaaagtgctaacactcttcca

SEQ ID NO: 111238 - DNA, 1213 bp, Homo sapiens
actcacaaaacagcagcctttcataatccctctaagacaacgggatttgggtcagtcttggaggtagtgtactatagattctagttaggtggttaaatttaggagtttttccttcccacatggtctactgttacaagaacaaaataagcagatttaaaatccacctgacaaaaactgttaatatccaggatcactttgtaaccatcctggacagaaaagtgattctgggcaaaggttggtagacgaccctaggcctcttcactaaaaaatgagcctctagagttgaatcaatttgctattataaaggaaaattgcttaattatgatacacaaaatactgtttttagcttgctgtgctgaagaaaaatatacaaactgctattaagatataactatacttaatttgagtagtaatagtataaaatctttgcagaacttactgtgtgcagaccaggactcagcaagcattttctataaagagccaaacaaaatattttaggctttgtatggcatatggctctgttgcaagtattcagttctgctgttacaactcagcagcccatagacactctctaaatgaatgtatgtagctgttttccaccagcacaggctgggttgggcccacatgctgcagtttactgacccctcttcttaggtgctgttctaggtgatctacgtcttttatagaaatcctttaatgacacagtgaggtaggtattatccccatctcagagctgacaaaactcaagagtttaaggcctgaggtcaaggacttacatggcaaactgtgattcaaacctagatagtctggcaaggtgcagtggctcatgcctataatcccagcacttgggaggctgacgcgggaggattgcttgagctcaggagttcaagaccagcctgggcaaaatggtgaaaccccatctctactaaaaatataaaaattagccagacctggtggtgcattcctgtagtcccagctgcttgggaggctgaggcacaagaatcacttgttacctgggaggtggaggttgcagtgagccgagattgcaccactgtactccagtctgggcaacagagcaagactctgtctcagaagaaaaaaaagaaaagttagtccgcatctagagtctgtgttcttagccattgtacaataccaatatgacctttctttagaaaagacctctctttggaacttcacagacctgatagcccta

SEQ ID NO: 111239 - DNA, 1386 bp, Homo sapiens
cagcctcccaaagtgctgggattacaggcgtgagccactgcgcccggccacgttaaggctgttttttaaaatgtttatttgaaagacaattttctttattccaggaatttctgagttacaacttttcacttatgccaccttatggaagaaagatcaatttccaatctttagatttgaggaaaataacgttcatagttgtgtttttgttgttgggtttttttgtttttgttttttttaacttttccaaaaccaggtacaaagtgagagaagcacaaaaccatttggtggaagtgataagtcaaatccatgatgtaaccttgtctttcccatcacctgattttttgctttaagccctggttttcaaattaatgatggaattaaagttgatgagggtgaactttgagcattaatagaccttggagcctttccctatgtgactttcattttgagctcttgctgtttggattttaatgacatttctcctttccaggacgctgccaaggtctgcagagaattcaccgagcgtgagcaaggagaagtccgcttctctgccgtggctctctgcaaggcagcctaatgctctgtgggagggactttgctgatttcccctcttcccttcaacatgaaaatatatacccccccatgcagtctaaaatgcttcagtacttgtgaaacacagctgttcttctgttctgcagacacgccttcccctcagccacacccaggcacttaagcacaagcagagtgcacagctgtccactgggccattgtggtgtgagcttcagatggtgaagcattctccccagtgtatgtcttgtatccgatatctaacgctttaaatggctactttggtttctgtctgtaagttaagaccttggatgtggtttaattgtttgtcctcaaaaggaataaaacttttctgctgataagatagccacagctgattctcattttcttttaccctctcctcaatatgtcaggttattttggtagtaatatatgaatgtcttccacataagtaactcatacagtgctgccaagaattaccataaaagcattggtttgatgtgtctttggatttttttttgcatttgtattccctatgtatacctgtagaaactaatttttaaagatttttaaataggcaaattttgtagcacaattttagacttataaaaatattgaagacaaaaagaaaatactggacattgtagaagtcccataaacccaccacccagtttcctctattgtattaagcggggttttctagaggacagaactaataggatatatgtatgtataaaggggagtttattaaggagtgttgacccacacgatcacaaggtaaagtcccatggtaggccctctgcaagctgaggagcaagg

SEQ ID NO: 111240 - DNA, 1051 bp, Homo sapiens
gtttagaagagacaggactataacagataagtgcttactatatcttaactgccttacatgttctacttagtcatcacatgatgttggtattattcccattttgcagatagaaaactaaggcatggcgaagcttaagcaacttgcctaaggtcgttaggttaataactgatgttcctgagattctaacccaagccaattggctctaagagtccatagtatttaataattcttccgggggcagggacagacctaacttaaaaggaatgaagtttaacctttatagctccacactttaatggccccttctaatagtctggcttgtgtgtccttgtaaaatttgcaacaataggatattattgtatttttattctcaaaaacatggttctacacctgtgtctgggtgttaagattatgggtgatttaactttatattctaattttataagctttctaaaattacattattttttataataaaaaagcttaagtttttcccctaagacagaattctgccataaactcctgctggttaattctagcttacttccatgtttctttaatttataactgaagtcagtgcaacttacagatttagttgcctgtcttctaagacgtttttcaacaggctctgtattagtccgttctcatcctgctaataaagatatacctgagactgggtaattaataaaggaaagaggtttaattgaatcacagttccacatggctgtggaggcctcacaatcatggcagaaggcaaaggagaagccaagtcacatcttacgtggatggcagcaggcaagaggacatgtgcagcggaactcccctttacaaaaccatcagatctcgtgagacttattcactgtcacaagaacagcacaggaaagatccacccccatgattcaattacctcccactgggtccctcccatgacatgtgagaattacgggagctacaattcaagatgagatttgggtggggacacagccaacacttatcaggctccattatagggctactttatttgtttttaaaaattttttaattttcagag

SEQ ID NO: 111241 - DNA, 1079 bp, Homo sapiens
tgaaaaattttttttacaatgagcatgtattattttatatttaatgaaataaagcaataaatgatcattcactttggaactatccattttcttaaaaagaagtagccaagaaatgaaatgttaacataactgaaatgttaatgtaattatttgtcattttggcaatgaaagttgtttaattcgagctaaaatagtgcatttgaaacaaaagagagctgcccctacccactacttttcttgttttctgggtctcagcaattcacttgcatttgactttcatttatcatatttgtgaggataggtgaagttttagcgaataagtcatgtagtattaaatctcagtgactgtaaaaaagactacagctttccagccagaaatgcctctttccataagggaacaaattctctgactttcaaaaatttaatataacaaaagactctattctagattgtatggaagttgtaaattttaattacatctgcgtttttctccattcacctggtgtgaagagggagggactcaacctgggtgagcagctatttaagcatctggcacaggaatcttggtcagccacatgcatgtacaggactataaaaaagtccaggtttgcgttgggagtccatcactaagtgtttatgtgccagtgaagtcaccaggccttcaacacccacagccaagagctgtgccgagagaagcaggctgccgctcctgcagtctggttgacaagcctccgtgcccggcacctgcgccttgttgcctgtgggattccaactctgattgttgcctcagaaactgttgttaccacagaactttctcacactcactggcccagacgtttgcagaattccagggctagtgtgtggttaggcagccaaattccaattttagaatgctgcttgtgaccatgaaactctgttaactcaggcttttaaagggctgacacggtgagagatagagagagagagagagagaaactgtgttggggaggaaacagtatgaagatgaacaaacaagcaattgtttattgttctcaactagagaacaaacatatattttgatctccataggatatgagtgt

SEQ ID NO: 111242 - DNA, 1028 bp, Homo sapiens
tcttgtaagattccaggtgattcttagttcttttcatggtctgtatatgagaagtgtttttctacatctttctttatgatagtaatagatgtttgtaacagtatagacatttcacaggagactttagttaaatttaggaatcatgactttatcctggcaattttactttagaaatattatatgcttagagtaattcagataactcagtcctttgaaggttctctacatattactgcctttcatatttgaagatagatttggaaatgattgtcctctgggtgtaaagagtccaatatatactgctgttgtttccacacagcattgtcatttcctaccagggactctcccttttaaacttaagagttggcacggaaacattattgctcaaaagagccacccattcccgagtgtgtttgacaggtctttgtaaacaaacttcttcagccttgctgaaattagtggaaaaatctaggctctcatgtttacagttgacgtgggttttcctttcacctaaaataaccattacaagtaagatactaagtaaaaaacatactcatttctacttggtatatgaaaataatatatgtttgatgtattcagtgaaattccagttaactcataactctttgaggccatggatggagaggtggcattattagtctctacctccagtgcctcacacaattcctgggcacagaaagagacatacaattcatgttgggtcaatcaaagaatgattgatcattggcacctcctgattctatttggtggtcagagaaagtggcaggacttaagttattttacatataaacatttcttgcaaaatttggagaggatgttttgatggcttgagatcttttaatttctttgagttactttcattgtccttcccaccccttccctctctccactctgaactgcatagggcctgcctgcagtgaactactcacttcttctgactccaaggaaggccatatcatgtgttttaagtaccccataaaatttatcttcaaagtaaagcttccttt

SEQ ID NO: 111243 - DNA, 1056 bp, Homo sapiens
ctattatccttttttgtaaacaatgtttattttatttttaattgacaagtaataattatatatatttctgggatacaaggtgatgaggtgatgttatgatgtctatacaatgtggaatgatcaaatcaggctaattaactgtcagcttgctgacttatttctttgtggtgagaacatttaaaatctactcttcacacaattttgacatatacattattatcagctatagtcgctgtgctgtctaatagatcactggaacatactcctcctgtctaactggaatttcgtgtgctttgactaacatgtcacctttcttcacccacctgttacctcctccttagcctccggtaacccccattctactctctacctctatgagtttggcttttttagattccaagtataagtgagatcatgtggtatctgtcttcctgtgctttttattcttaaagatattaactgcagaggcccagcttcatcccctgtcttagccacttcccagcccaaggtgaccttgggctaataatttaagtttcgcattttttcatctgtaaaatgatgattaactatagtattgaccttataagaccatagtaaggattaaatgagctaatatataataaaatatacagatattataaatatatacatatataatatatacagatataaatatatacatatataatatatgtatgttatatatacatatataatagtatacacatatatacatatataatatatacataaataatatataaaaatataaaaatataaacatacatataatatacatatattataaataaatacaatataatatacattataaatacatataatgttttatgatatataatttgtgtgtgtgtatatatatatatatatatatatatatatatataaacagtgagtacattacctagtgcatggtatgtgctcagaaaaagatgactatagtaatggtgctggcaggtgttaatgtcattcatatttttccctaaacctctattttcccatctattaaatagcatagtaatagtacctaactca

SEQ ID NO: 111244 - DNA, 1935 bp, Homo sapiens
tctttaatcccaactggctttatgtgatgttttactcagctctgagacctacctattcggatttgagattttttgctaagaataggcatatggatctcttgagagcaattagtttttgtttaatgttcttttaaaatagatgaagccaatattgcaagtgttaaaggaacacagacaattgtagttgaatttctgttaagattattttttctaattaattagtctttgcatttttttaaaatgtcagctgatatttttctatttatttctgtttaagtacttcttgtgctttccacatgaaaactataaggtgtttggacttctcattaagcatatacatgaaacatgtaattgccttagagttttcacctaatgatctaaaaaaacaaatggaggaagattaaaatattttgagtagacataaaaaccacacagtcttgatgcttaaaaacatgatttgcaggcatagcttacagtatttttctttttaaatttagcaattcatgatgaccaataaactggacacggcaatgtggctttctcgcttgttcacagtttactgctctgctctgtttgttctgcctcttcttgggtatgtattatacatattgctgcctttgatattcaattgttgagtcagtttatatggagtgccttttaggtgtaagacttattaacctgtaaagggtttagggacaaataaaatacaagttccagccttcaggtactaacaacctaataacattatcagaggaatattttatatcttgtgctttgtgaaactaacacattgaaaatccaaggaaaaattgatgtgtgggaatgagataagttcatgtttttttcatttttacttattacttgacaggaaggtcctgctttataaaattcaattttataaattgattataagaaattcagttgggcatatatatgaagtgaagctattaaaacggtagaataagttcatgtaatttttttctattgacaagtgatttaggtgttgtgcaattatgatgcaattcacaaaggaggaagagacactgcagttgtttatgtctcatgataacctctcctctggtaatttgcaggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaagtatccttttctaccttgttaacaatgaaattgccaactaagcatataggagatctcttctgattatttcagcaatgaaggcattccatgaagcctgggtttgttctcggcacttcatttgaatgaagatatgtttagtgtaagaatttctgactttaaaatgtgaaatctaaactttgaagagctgatttaggaattttaaactatctttgttcttgcctcttgtaagcttccctattagaatggatattttcaaattccccttcgaagcacaaccttacgcagaacttactttaatatttacatttttttcatttaattcacgtttttggcaaagtgtccagatgtcttgctttaaaaaagagaggtcctcagctctttccatcttaaccccagtgaactagatacaaatggaatttaaccaagaaacaacttatttaagcaggtaatgagataatcaatacaaagaaattaatatttgctgtgtatagagtagaaaataaggacacacatggataatccgtgaagctaatgagaaataattcatttggaatttgtatgttttcacatttcaaaggtgtgttgtgggatgatactgggtagtccataaaggaggggaaaaatggggaagaggttctatagtgaacactaggtta

SEQ ID NO: 111245 - DNA, 1316 bp, Homo sapiens
atgtcccatcataatttgtattggtttatttttaggtaaaactcattaaatgattactatactacaactgtaaatgataatcacatttgtttggcatattattggcttgaccagcctctgttgattgaagtgctttgcagtcaccaatgttaaaattctagcctttctgagctataacgggaagttatgtagagatttttggtcatgccttttagtagcttaaaatttctttggagggagaaatagaaatgacagaaaatgtgtttcaatgtagggtaaactgaatacgtcaataactttgggaacagtgcctcacacagatcaggcactcagtaagttttgttgagtgaatcctgaggtcttgccaaatgagactcatgactggtgaagaaaacctttctgcctttttatacagttggttatttggtagcccctctttcctgggaatgttgaagattaaggatttcatattccttaaattcttacaaagggaatgtagtaaacagtgggaataacataaactagtaattggcagcaaatgctaatctgattattaaagtgatatggtaataaataaaagcgggcccaaagtaatattacagatttgcgttctgatccttcttcttataaaagtgatattttgtccttgcttgattaataacagatagggcatttcacctcttatcttttctaaatacattgtattaatagtttaagagtaatgttgaagactaagattatgaatctcttaccaaggatttgtgaactatagaatgttagacataaaagactcattggcagtttctagctttgatctctgcatactcatttgccagagcatgaaacttgacctaggaaaattaggttagtgacagagtcaggagtggaactcaggtatcttgactcccaattcagggctctattttcactacctgacactgccccttttattgaattcagtctggatatgtgtcaaagtttaaattgaattctttaaggatcgacagagttttatagtgacttttggagagggttgtagcttccatcagtttcaaagtagtctatgattcattaaaaaatttaaaactttttatatacatatatgatctctacttaggaaatggacatttttcttaattcttgttagaggtgggaatgagttggtcaggatattaatttggagaactatattagggagttagggttcttctaatacttggatataggttggtgtcttgcttgtcaattggaaactgggacccttgaattcctaaatgagttatggttataatgaatttgatactcagattatgtta

SEQ ID NO: 111246 - DNA, 1048 bp, Homo sapiens
tataatcccagctactcgggaggctgaggcaggagaatcacttgaacccaggaggtggaggttgcagtgagccaagattacgccattgcactccagcctgggggagaagagtgagactttgtctcaaaaaaaaaaaagaactgtgaattttagaaaatgaaatagtttactttcttctttatagtgaacaaaatttgatttggcttaaagtgtatcagtaaaacaagccattccactgaactcattttagcagatgtttcacatctgtatatttggacataatacatagtctgttttgcagaatacttgatgacttttaaatgttttccttaattgttttctttagtgagtatcttcccagtcttgttattctctttgcttcatgctgccacatatacgaaaaaggtccttgacgtaagtaaaactgctctttgtctgacttctgaattacagatcattgacatgaatttgagttctaagacattttggtatttgtcacaaaaagtccctctataccttacaaacttgttatgaattatttagtgatttgaaagttttaagtttaaaagtgtttattgttgaagtttcacaaactagaacattttatagataaaggattgcacttaaaatcaccccccagtctccaggggaatttttcaagtttgaaatagatcagtttttttgaaacctgtgtctctaaagtttgttgagttgtcagatctcttgttctgtcagtgtttaattctggcatacctgataagttgagtgtactgaatgaatctcttgtacactaattttcagaactgctgctttcctgaaattctttcttattgctaggttggagcattaaacctaacttggcaccaggccatttacagcatatactgaaatttgaattaaaatatccaggcacatttaccaagcacatttacagaaatttgaattaaaatagccagatttatgctttgtattggcctttttctttatccctataattctttggtcacagcagtaattacactgctgtataattctaacattagctaag

SEQ ID NO: 111247 - DNA, 1008 bp, Homo sapiens
aaatattctgaaattcattgcttgcaatgaaatattcctgatgcctgcgacagtttttatgctttttaggtaaggaaaaattatatttgttttgggaggctgatgactgaacgtaataaagatagtaactcaagttttattctgtttaaatctgttgaaggtaggtattgacatgtagagctaaatgaatcttagcagttgcctaatctaacctttgtcatttatagtagagaacttgaaatatagtagacctaggaatttgtcttattccttgtgatttatcatttgacattttaaaaattactttcatagttaccacctttgaaagaatcttatgaaatctaatctagtccagtctgtcactattgagatgatgtttcttacactagagaaaaacttttaaaattatgttcttatattaatagtgcctactatcaccttattttgtttgtatcttaattatagaagtaatacatgaataaagaaagccatccttttaaaagtatgaacattaaaatagtattgacctctgcattgaaatttttgcattacattttaaaacaatacaccttgctacccagatgattgctttatcaatttttagttttacaagtaatgagacattacagataaaagctaaaatagcatttgactatatgaattcttgctgcaattttgtcctcttcccaaaggtgtaaggagtttaatatgtgtctatgtatgtagtcctttaaaaatacttatacaaatttgtagaacatatatattatggatgtggagttttgtttgttaatttgtttagttcttattttacatcaaagatgttattctggctgggcacagtggctcatgcctgtaatcccagcattttgggaggccaaagtgggcagatcacttgaggtcaggagttcaagaccagcctgaccaacatagtgaaaccctgtctctgttaaaaatacaaaaattagccaggcatggtggtgcacacctgtaatcccagctactcgg

SEQ ID NO: 111248 - DNA, 1010 bp, Homo sapiens
gtttagatttactgatgagccagtgtaatttttttggtggaggggagtgtttgtttctttttatatatataaaataagtcacttttcatttgcatattttatgaagctttacaacttgatttcatcaattagtaattacggaattatttaacattttctgatttatttagtattttaaaaaatttcaaaagtaatacagataagaatacatttataaaaaaattaaacaacattttactctttaccaatcatgtacattcttttatatccttttttaaggataacttggatttagacatgatagatttcactatgaccatttgatgaatgaagatacacatattctccagttgaattgcttttaagttttgagagtatacacatgaattgaaatgtatatttatcacgcttgtatttgtttatttcagtggtcaaggaagtttgctccaaccttttatatactatagatttcttacccttcgatattcgtctcgaagaaacccatattgtcggtaagctgatgattattttaggcatgttttatttgttgagagtattgtgaatatatagtattcgcaattcttaagagttacttagctaatgtgttagactttagaagcaagcagtgtttttgtaaatttaagttctaggccttagaatgtactggggttggtgaggaagtggttgtatttgttcttagaaactgagactgcagttatctacgccacctctaaagcactgctaaaacttagcaaattttaaaatgtataagacatagattccactctcaactttcctagttgaagaaacaaaacacgtgtcaattagataaacaatggttaggatacagaattcacaagccaatagataatgaatgccatatgtttgctttattatatcagtactgcagtccacagaagggagagatcattgggccagaagatagatgagcccaggaaggtttcacaaaattgagattgtgggaggagtaaagcttttgaatagggaaa

SEQ ID NO: 111249 - DNA, 3458 bp, Homo sapiens
gttttcatctaaagtaacagacatgggaggcctcctttcacctgagcacttagaggccattacagggttattaattggcctaatttcagtattgtgtctcaaagaataggtaggtctgaggagagggaaagagaccaatcaggaatggccttcatgaactgcttcatcttatatttgtgcagtttgtggtgccccaaaacagttacaatagtaacaccaaagagatcaccgtaacagaacagatcacagatcaccataatagattaataatgaaaacatttgaaatagtggaagaattggcaaagtgtgacgcagagacatgaagtgagcacatgctgttggaaagtggcactgatagtcttgctgtatgcggtgttgcaacaaaccttcaatttgtaaaaaatgaaatatctatggagtacaataaaatgaggtaagcctgtgtattgctttttccttgtgtttctcaaagaaaactattttgtcttgcaggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagtttgcatgaactcatagttagaaattctgcaataggaatatctacaaccggctgatttggaatttgaaattatagtgttacatgtatacctatcaaattaaaattaaggaaatacaatagcaatatatagaatgaatgtagtaacagaaattaactctttactgcatcattgaacttattgttagttacagg

SEQ ID NO: 111250 - DNA, 1154 bp, Homo sapiens
aaatctactttattttagcaaggattctctgtccttttgtatagttggtaccttactaatttaaactctaatatcaatctaaagagaaatttattatgcaatttgtatttaggtttttttttttttttttggaatgaagttcagaggtagatcctcctggaagaaagaaagcaagcgaactttttaaagaaaattagacttgaatatttaagaatgtcccttacagagaaaaggccaactataatactaagctaaaagttatgaaaaattaataggttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctagtttttgtatttttagtagagatgaggtttcaccatgttggccaggctggtcttgaactcctgacctcgtgatccccccacctcggccttccaaagtgctggattacaggcgtgagccactgtgcctggctt

SEQ ID NO: 111251 - DNA, 1069 bp, Homo sapiens
cccagccctcacaatccttggctatggtcaaatgtgccctaccctcatccctattcactttcctttctcctggtttaaatcatttcatgttattttaaatgacttagtaaaattttaattatgtatctctaacatattaagatgctttttaagatcaatataaaacgttaacgataattatcataggtcttttaggttggatgactggaaatgattaagagtaatgccctgataggaaaaaggcttacgtgattttattgcaatatattatgaagggagggggaaattccaacattttttagtaaagggaagacttgtctccatatattgttgccctcaggaaaatgcagagataaacatctccctcttggggaagttatagaaagagatgttgccattctactctttactctctccctcccagtggagatcgtgtatccaactatttttccctgaaaacctgagtatatgggatttgggttggtgctgtcaccagaaacagaataggaggcagttaagttctgcaaaggaagggagtcctgttaaccaaagaagggggcgggggtaagttggggctatgccactaaattaagacaaatttaatattagtaccattgtcttcattaagttgcccttaaaacaaatattaataaatatcaagtaattagattgtgagtttgtgaatttaatcacagatttactttaaaattttatatactttaaaaaaatagtttgtatcatttttttaaatcctacaaatttggagctttacaaccattattgcctagtgttccaacaataatagaccattccacttaagtaacaaaccaagactctgaagacacagaaataaaacttgtagtaatccagaataaaataggtatttctttttttttgtcattaatttatacaagatacagtcatatacttaggtttctttaaaataatgggtcttgatactatgaattcatagtattgtgtttggcagttcaacttagtaatatccaaagcatgtagttcatcttttgaagtgtttagaaatgggctttaaaaacaaaaacaaaaacac

SEQ ID NO: 111252 - DNA, 1574 bp, Homo sapiens
gcttaccttcgtttttgccgtagcttgacacacattgcttgacactgagaactgataggatctctgagggagaagacagaactaagtccacccttaacctaatccctccattcttgggatgcagagagtatttaccgaaacattcatgttcgaagccaggtgtggtggtgcgctcctgtagtccagctactcgggagactgaggcaggcagatcttttgagcccaatagttctaggctagccttggcaacatagtgagctgtctgtaaaaacataggtttgaaaaaacctgtaacatgttcgtgacctcctgaaagaagtcggaagttgcagtcattcgagattttatgtaatataagctatagtaactatgctgtggatataaattagaatatattcgtatcttttatttgcaataaatgtaaagctgaatcttagaatttcaaacggataaattttaacagcactattcccagggcttttttggtagtgatagaaaagtgtaactgttgagtttttccatattggcaatatactgccaggttcccttatggacagaatgaatcatcggctgggtgcagtggctcatgctgctaatcctcaggaagattgtaaaccttaggacgctgaggtgggtggatcgcttcagcccaggagttccaagaccagcccgggcaacatggcaaaactgcctctctacaaaaaattagcctggtttggtgacgcgcgcctgtaatcctagcctgtactcaggaggctgaggtgggaggatcgcttgagcccaggaaattgaggctgcagtgagccttgagcatgccagtgcactccagcctgggtgacagagtgagacctgtctcaaaaaaaaaaaaagaaaagaaaaagaaaaatgaatcatacgtttatactgtactccagaatccccaagtaagtttctaacacaattgtttctattgaccaagcaattttggcattttacactgaaattacagtggctgttaaatttagtctaaactgccctttaagtgttggcaaaaaggagaagaaacagtgtaatttgtaatccctcttctgtgtagctgtcattatgttgaaaattatgtattctttgtctcatctgtctgtgaaacacagataattattacctaccttagtggtcaaaatgactttgcaaagttgtttggaatgtttattactacaaaaaattaaaattttttttacacttaaaaatgcttagtaggtttttaaaaataactttgtgaaaatttagtttcagtaatgaagcatttcttaaaagggcaaccattattatggcaaaatttaaaaatcatttagaaaaagagtactatttaaattggatgcatgtgagaagactatttgaagaacttttggagaaagaaaatctaaaaacagttgtttttatttgtctagaagtaaggtttagtttatgcttctaaaatgcctgtggctgggaaaagcttataaagcataaggagaggaggaaaccttgagggattgcttgaatacttaaaaatgaggaatgcctttaaaggcaaaatagaaactgtctaaaagaaa

SEQ ID NO: 111253 - DNA, 1002 bp, Homo sapiens
attaattttaatatatcctagaattaattttaataacgaaatttatatattttaataataaaatatataaaatttaatactattttattaagtatattcaaaatatttcaacatgtaatcaatatcaaaattattgaagtattttacatcatctttttgtactgtctttaaaacccagtgagtattttacactttcagcacatcacagttcagactaaccacgttttaagtgctcagtaaacagtgactactcaattagatagtgtagttagagttagtatctaagttataaagaatttttacaaaccagtatacattccagtaggaaaatggacaaaggaattgaatacaaagttcataaagttgttcaagtggccaataaaaatgcaaaaatgttccatactgaaaaacagagactttaaagggttttacttctcactgcctatttcattttggccgaatttttcataatgataataccccatattgagggtgtgggaaaacaggaactctcttaactactgattgaaaacataaacggtttatgccctctgacctaacagtttttactcaaaaggatttactttaaagaaataatcaaaatacatattaaaatgtttgcagaagtttattatagtaataaattggtagttcatagttatggagagtgggaaactgaaatatattatgatacctttattatgggctggtgatgtatacaaccatttttttaaaaaattataattcagggctgggtgtgttggctcatgtctgtaatcccaacactttgggaggccgaggtagggggatcacctgaggtcaggagttcgagaccagcctggccaacatggtgaaaccccatctctaccaaaaatacaaaaactagctgggcatggtggcgggcgcctgtaatcccagctacttgggagactgaggcaggagaatcacttgaacccaggaggtggaggttgcagtgagctgagattgcgccactgcactcca

SEQ ID NO: 111254 - DNA, 1037 bp, Homo sapiens
catcgtctgttaaaatgtcacacatcaggtcgggtgcagtggctcatgcctgtaatctcagcactttgggaggccgaggcaggctgatcacgaggtcatgagatcaagaccatcctggctaacccggtgaaaccccatctctactaaaaatacaaaaaattagccggagccgggcatggtggcacgcacctgtagtcccagctactcgggaggctgaggcaggagaatcgctcgaacccaggagggagaggttgcagtgagctgagatcgcgccactgcactccagcctgggcgacagagcaagactccatctcaaaaaacaaaagatgtcacacatcttaacacaactactatcctacttcaagatatcattatctcttgtctgatttactgtggtagtattctccctgggatctctgcttccattcttgtccttctgtagttcatttttcacgtaacaagtgtggtctttttaaaaacagatcatgtcacttttttaattaaaactctccattggcttctagttacccatagaacaaagccaagactgctagaataaaattaaaatttactattctgactctcaaagttctttctagctgatctggcttccgtattcctctttattttcttctgctactctcttgcttgttcattatgtttcagccaaagcactctccttttggttcggagaaaatggcaagcttgttgttatagggcctttgctctagttgcgttctctttccaaggtgcccttctccacatggctcagcctcttctggtcattcatatctcagtttaaatgtcagctctgcatagagacattttaaaatcactcaacctaaagtagccacccagtaagtctttaatactaccctaatttaatttttggcataggtagcacttactcctgattgatgttttccatattttatttcctcatcacctacatgtttgcaagctccatgacagcatgaacctcagtgtcttgctgatagtagggacataataaatatttataagtgagtgaatgctta

SEQ ID NO: 111255 - DNA, 1051 bp, Homo sapiens
atgtttaaaatactagctgcgtgactttgggagaatttacaaaacctttctatgccccagtttcctcataacaaggaaaactggctctgtgactttgggggaagttataataatctctgtgcctcagttttctcataagatgaagataatagtattttcctcagagcaattttgtgacaattaaatgaaataatttgtaaagtgcataggacagtacatggcacatgttaaatgcttagtatatatagccattcttcataaactctgaaatgttattgaatgaggatataaatataatggaaaatgttttaagggtgagatttttacaatatatttgatacatacaaaaggatattataatacatatgtaagttaacaacataataaaatcaaaccttggaatttactactcaagctaagaacttcactgtcttgatcacatcctcctatctccatttgtcctatgtatccatgtgaaaaaaaagaggaaatagctttatacatttgtatatagccctgattatttacttttgcttgtttgtgaacttcgttgtgatagcttattgtatatattcttttgtgatttacttttttcattaaatttagttgctaagatttatcttattgattggtgtgtgtgtctggttcattaatgttcttggagataattatagcacatactgttcagggatgttgtatgagttaaatgagttgatacatgcttagagtagtacttagcacacagtaaaagctcaaagaaagatggccattattatgtttgttactatgcactgctgtatgaaatgttgtgtgaatataacatggtctatctatctatctatctatctatctatctatctgttctcttgctaatgggcatttgggttgttgccagtttacaacaacagaacagagtcctgctctgaacactcatgtacctctgtccttgtgccctcgtgcaagagtttcttgaagccaaatatattgacctagaagaattgctgggtcataaattatgcttgtgttcaactatagtagataatgccaactt

SEQ ID NO: 111256 - DNA, 1068 bp, Homo sapiens
gagatttcttgggaaataccaaggtatggatatctttgtaataatgtgtgtgtttgtgttgcacagcaaaattctaatatcagtccattgtaaaattctagcatgtctgtgatctcaatctaagattttcttgagtacattgtagttcactgaattatagtcaattcattcatttccgtctgattttcctttttttttttttttgagacagagttttgctcttgttgcccaggctggagtgcagtagtgtaatctcggctcactgcaatctccgcctcccgggtttgagcaattctcctgcctcagcctcccgagcagctgggaccacaggcatgccaccatgcccagttaatttttgtgtttttagtagagacagagtttcaccatgttggctaggtgggtcttgaactcctgacctcaggtgatgcgcctgcctcggcctcccaaagtgttgggattacaagcgtgcccggcctgattttcttgaaatttaaaacatttgtacataagttttctttaaagtcataaccatgttatgaaccttaagcatgtagatatagatgaggaagactttattttcttaggttttagtgagatttatatccgtcatacacactcttaattttctttagcctctctctttctgctcctaactctggttcaacattcagactgccaactctgtgcttgtatccaagaagcttagcccttggagaagaaaattacacagccagtgtgattgttctttcttccttatatgactatacaaaatcaatggatactcaatattatttgacagtcttactaaacttccagagtatgttcaccttcccactctttgaaatagctattgcatatctttttctttcttgccaacagcctcactctttactcttcagctgttgactttgcttcatattttattgaaaaaataggtgtaatttcataaaagtacctcatctttttcatcacctcatcttttcatcaccaaatttactaactcatctacacatgtgacaaaatactctgctttccttcctactagaaggaaattaatattgggacaca

SEQ ID NO: 111257 - DNA, 1730 bp, Homo sapiens
ttttgatagaggaaaatgttctggtctgtcaaagccaccagttacagtgcttctctgcaaaattttggaggtattaaaaaaagtttttgtttttttacagccacgctccagaacagcatcagtgttttttaagggaccaggaaaagtggtgatggttgcaatttgcatgtaagtactgaaaaataagctttgtgaaatagaatatattcttttaaatatgtatatccttaaatatgtaaatttattacatggtagctagctatagagtttgaggtttattttgttttaggaggaaattgaataagtctttattattgtcagtaaagtggtggggaaagagcatgaattcatatagataaccatgctcattctctgtatatttttgatgtagttagatctaagaatagttgctacctgaaaatcctttcttgtttttattggagttgatagaagtcttttttaaagaagttagctaaaccaacctgggttacagctactgaagaatatctttgtgcttattatctttattccacttatcttggaagaacataattatttgttcttgttatttttgcctcctctttttttttttttttgagacagagtcttgctctgtcgccaggctggagtgcagtggctcaatctcagctcactgcaatctctgcctcccgggttcaagccattctcctgcaacagcctcccaagtagctaggattataggtgcgcgccatcatgcccagctaatttttgtatttttagtagagatggggtttcactacgttggccaggatggtctcaatctcctgacctcgtgatctgcccacctcggcctcccaaagtgctgggattacaggtgtgagccactgagcccggccttgccttcccctttttccctctatcttcttgattcctattgttttgttcaccttttgtctgtttttctgactaatctattttaggatggatgaaatcattcaataattcattagttcttttattcttaaatatatatatgtaaaatatgtatcagtgtgataggatatgaaaatataaagatataatacataattctttaaggattggagggacactaaactagaggaagacatttataatacagacaaggaataatgctgtcataactacaatagtggtggtacagatagacgtagacagtttcaacttcttagaaggtatgttcaaggatagtgaccaggtttctggctgtacaattgtgtaaataatgtaccattcactgaggagagtactggaaggaggagcagggtgggagcagagaaaatgatgagttcatttttgagctggtggtatgtttagggcacccaggtggagataagtcaacagggttctttccaccagtaatacagggatagtgattatagcttttctcattggagggatgtatgtgtgaaaagtgcttaacatagtacctgctctaagatatgtacttaagaagtattattgttaatatatattggtctgaagctcaggagagaaatctgagttagaggtttgatagtttttagtatatagatgataactaaagccataaaagtaaagatcacctgaggaatgtatgtatatatagtatcaggaataaaaagtcctcaggaaaaattccttgaagaatgttaacattaagaaaaaggtggaggctttgggagacctcgtgatccgaggtcaggagattgagaccatcctggctaacacgg

SEQ ID NO: 111258 - DNA, 1011 bp, Homo sapiens
gtcattgttagcctgcaccctccacattggctttaccatattatactctccatcttgctaatgattattcacctttttttcttcttcttcatagggtttactagcattgggcatcagtaagtctgttcaaacaccagatccttctcatccgtaaggacattgccttattttgtttttgtttgttttggcgataagtcattgaaataactaaatatcagaaatctcctgcaatttatgtacctgcagtttgttcaagatttggtcatttcttccactgtagtatctaaaatgcagaacttcccactgtgtcaaagtaaattcaaggtataatttgaaaatggagttcaagttatttttatgctttgtagcacggcatggagatcttgttttctccatatttgataataataaagcacatattttgatcttagaggtctgttttatttggtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaaacatcattttaagactagcttcagtaatataatttgataaatcttaagaccaaaaaaagtgcacttttatttctgtaaaggagtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtac

SEQ ID NO: 111259 - DNA, 1055 bp, Homo sapiens
atcacatagcctaccctctcagcttctgcatctcatggtgtggtttccagacagtgctgaagttgtcttgcatttggaaagaatgccctttgagcagctgatctccttataaaagactcctagggacctgtgtgttaaaacagacatctttaacacactttctgtgggagtgcaggtttttctctcaagcccaatgatctactctgctgatacagccaatatcagttagtaggcttgcgtatggatgtatcactcaggtatgcatcagacagtttgctgtgatatccaatatcccgggggacacacatcaaggctactgaacaatcttagtagctcaacagctttcaccaaagaaatcttcatttttggcctcctcaatttcagctcttcttatgtggtctagaggatgtggagctagcatgtagtctagtgggtagaggccccaggtttgggctaccttctgtgcaaggcctgaatagatggtataacacctccttttggaatgtggggatacttgtacctattttcttctctattttgagttgtagtcagaactagacagaatcaatctgtctacttttttaatatcctgttatatcatgcaaatctacttaataacaagcacattaaactaggcttatttgttattctctagttttctatagttttgattgactagtttcttaccataatacatttcatataattaaaacaaacaaatgtgtttcctccattctgaaaagatttggccactttatgggtacttcattgttctagcgttcttctaatttgtatagtgtcactttataggggcaaagcactctctgtagttagagattaggtaattagttaaattttcagttgtgtataagttttaaaacttctaaaagctcttgtgtctttcagtaactaaatgggtttccattagactatggccctttttaaaatagtgttggactaggttcaaagttttcagacctctattttaggaaagcctagggttctaaacattgttgaaaattctgtagatgtttggtttgaatttcattaaaata

SEQ ID NO: 111260 - DNA, 2047 bp, Homo sapiens
atcaggattttcttggtattaggcatggaagcaaaatccagaagttacttgagtttgggtgtggatcttactgtatctggtgtctaccactcctgatatcaaatattgtattcatatctcattgtcctcctcatttgagttgtttcccattagtaaccttactgtctggcttaaatttgaattcgtgtttttgttttagacattacggactttatatatgaacaattgtgattggaagtacttaatttatgctttattttaatatttcttttctaggcatattgtattttagcaggatcattagtatctgaaggaggtatgtactgtcacaaagtatgtctctattcttaatttagtaatatatattcagctgtccattattatagtttgctaagttctgttgattaaagaaaagcaagtgtgggaataggcatctaagctttctctacttttagggagtaaagtctttgcataatgtactgtggttgttctgtaatggatagctgtgggggggtgtgtaactgcgccctgccatgggatggcatcctggcaaggcctcatttctctttgtgtcctgagctgctaggataggctcaagtaggtgactatcagatagatggaagacagtaactgatgtggcatgaaagcgcttagcaagcccaccatatttgtggttatttttaaactatgtggtggtaagaggtgttccttacagttttcactttgcaagcattattccttgattgaacccaccaccactactatcgctgttacttgccgattcactaaaaattggataaataattattttacttatttaaaagggaaagtatgtttcatttttgagtatcataccataatactcaaaacatttgaaatggagtataaaaaacataattaaactgaacttttaaaattagagtttaataatattcaccagaagaatattatttactggctcttgtgagacaaatatttcaaagtttttgaaatacacagctatagcagtatgatgacagagaactgctaatatcagtataaaactgcctgattcactgctgtgctcatgtttacttctgaaacattgtaactttctatgtataatgttcccttcatctatttttaaaattaacattttttattgacagatcctaattgtatatgtttatggggcccctcatctttgaaagtctatgaaatggttataacacaacctgcttcaaaagattgggaggctcagaaatgaatgtggttagtgtggtgctgccaaatagcagctcttcaataaactaaagctgttgttattagtaattatatttaattattatggtttagaactatggggttcattttattataatgattaattgataacaactaattaacatagaacttgtccttattgccaaccctagttttaaaatgttgtgcttatttgtttatcttttgagatgccatctttaaagtttggaggcatgaagtttctgtcttgctgatatgaatgcttttcttttagcaacacttcttgttgctgtaaatgaacttcgtaggaatgctcgggctaaaggaatgtcattttacaagtatggtatgtattttagaaaccaagtgtttgtttcacctcccttatttgcttaaaattacttagtactgttattgctttgttcctaatagaaatgtacaaaatatatctgaatatcatccctgtgtggctcttacatatccttcagcccttattaaaaagaaatgtagtatagaaatttgaacatggatactttatatttggatttgacttaagtgaactaaggtatttctttatatggttatataacttgagaaagtaatttgactttatgtatcagttattgttgacatttaagccaagaaattatgtttgcattgagcaaggtttttaaaatcataatctctcatacacttttttatcttaacttatatcttgattttaaatggatacttattaaaatgttacctgatagtatcaagttaagattttagaaattttcttgtcttgtctcttccccaatga

SEQ ID NO: 111261 - DNA, 1104 bp, Homo sapiens
ttaccatcttacagtttctgtgagtcaggaatcagggcacagcttatctgggtcttcgacttcagggtttctcatagactgtaatcaaggtgttgactgggattatagtcatctcctggggaaggggctgcttctaaccttactcacatgattgttcgcaagatttagctccttgccaaatgggcctcttcaacatggcagcttgcttaatcaaagcgtgcaaattgataaggcaatagagagcgagtgtgaacaagacaaaagtcacaggttagtcacctggtcttggaaatgacatctcatcactttgccatatttggtagttatagcccacattcagtgagaggagatcacacaagggcttgcgtataggtggcagggattgatcatatgggagccctccaaacagttttctgtctgtagttagttatatgtaagaacataaggaaaaagtatatctaaatatatttattagttgctactcacataccagccaaataatgaaatgtgtttatactctgtgaagactaaagtagaaatgatttttgaaaatgaataaatatgttctgtgagttaccaggagagaaaaaaaaaagaataaatgatatagccttttgccaatctgaaaaagttttgttttaacttgagcacatgtaactataaatattaaaacattaattcttatttcatccttgatggttgattaaaatatagcttccttatatggataaaaaattttggactcagtgtttagtaacctgctcaggatccctcagaaattagggtctaatgttgtaagaatacttggagtcttacgtaggcttgtttttctagtaaatctccatgtcctcagaattcagagtgttttgttatttcttatatgtgctgtacagaaaagatcttacagtgatcactgtagaaagaagagaatttctcagcagtttctagggaagattgtttactgagggttagagcaggaggggtgaaaagtagttatgcttgagtatctgctttcctgtctgggaggcaaaagggtatgatgcaaataccactgggcttgcatttctgaagagctgggctggggagtcctaatctgctgtttac

SEQ ID NO: 111262 - DNA, 1881 bp, Homo sapiens
tttgcagtgattttgttttcaccacacaaaaatgtgtatttccagtgcttcgcaatgcttggcatgtactagatccttaatgcacttttgtattaacaaacacatgaacaaacttaggaatgtgatactacttattgtactgtttatagtatgtctatttacctattgatcttactttttttcttatgcaactatttctctcattagtatgctatagtgaaatagtttgcaaatgttttcattggctctaatgaccaaaaggaataaaaagaaacaagattttattttgctacaaataatgtggtggtgatttttctttccagaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcagttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgatttttgacccagaaatctcatttactggaaaattgtgagactttacgttggtgtatttttcttttttttttttttactattacagagtattttgcatgctgtaca

SEQ ID NO: 111263 - DNA, 4274 bp, Homo sapiens
tctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgttaagtgttttaacttggtttttgcatctttctaattcattgtaaatacttttctgtttctttgaatacataacttttctctccctgaagctaagagttttgcttgtctctgaacatcaggaaaatgttacatgcttaatatccaaatacaagatgctcagttttgtcaggaaagtgaccagaaatcatccagaaattcatttgatctaatgaatgaaagggacggccagtgacaagctcagagtgatatgtagtccaagaggattttcatacggtatt

SEQ ID NO: 111264 - DNA, 2414 bp, Homo sapiens
atgccttacaaatcaaatttaccttttatttcaacagcaaatgttccttagagggattaccctctatatctgtgtaattttttttttttacttttgcacatgagaagaaaatttgtatggaataaattgggtctaatgagtgacatcatcatggcattgcgttggatttcccataaagcttttcttatagagcttctgttaaagtttaagcagcctgccctgtcatcttctgcaaaaaccagctgtttttttctctctctctttttgatgttgtatatattcctgcagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagc

SEQ ID NO: 111265 - DNA, 1428 bp, Homo sapiens
ccctcagtgcccaccagacaccaagtgttccaaccccattggacagtttgtgaatccctgaacagtcaaacacttccatacttctggccttcctttactccagctattcctttcaacctaagaacatactccttttctctccacttgagaaactcctattcatcctttagtacccagctcaggtgacactgtaacaaatgcttcccacagttcgcaagcaagcacttttcatagcacgtcatgcagattctgttatcgttaccgtgggaaattgttactctatatgcgtctgtgtctcctgatgtcctgatatgaagagaggccatggaggtctttgaggacagagacgcaaagtcatctttgtgtcccctctttcctagcccactgttaggcatgttgtaacatctgcatgtcaattgaattgaattaatggaatgaggatattgacatgaacaaaaatataacaatgcatctgtaggctaatacttaaagctcattgtttatttctagatatttacaattcaggagcttatactttacagagatgatgtgaatagggcacgtaaagatgattaaacacacacatggccatggttatcagaggacagtaaataattcagttgccctatgaaagtgtatgtggagtattttgagatgttttaagtccttgaaaacaactacatagcaagatagattaagtagtgcttgaagggtgaagagagaaactctcatcaagattttaatgcaatgaaaattaggaactagagacccaagcacccttaagatgggcaaaaccagaatctgagcagtttcccccaaggaaaactatttacgaagaccatttcagtagtcttatttaccagctgctcatacaagacagcacagtcaacagagtcaattaagtggcctcaatgaagaattcactagactcccaatcttaaaatgacagtagcttacaataggcaatatttattggatgcccattgctttacatgtattattttaagtaatcctcacaataactgtatacagtaggtcattttcccagtttgtttgtttgtttgttttttgagacgaagtctcgctctgttgcccaggctggagtgcagtggcactatctcggctcactgtaagctccacctcccgggtcatgccattctcctgcctcagcctcccaagtagctgggactacaggcgcccaccaccacacccagctaattttttgtatttttagtagagacggggtttcaccatgttagcccaggatggtctcgatctcctgaccacgtgatctacccgcctcagcatcccaaagtgctgggattacgggcatgagccacggcgcctcgcccattttcccagttgtacaggtgagatcatagaggctgggagaggttaagtaacctgcccaggatcacatggttaata

SEQ ID NO: 111266 - DNA, 1072 bp, Homo sapiens
gagtgacacccaagaatccactttttacttgattagctgtgcattttgggtggaggggtatctgttatcatttgaagaaaagtgcagtacatggtacactggttttgcatagaataaaaatgttttgtcatactgtaaccctcctacataatttgggatggattttccctaagcagtggtctcaacaggaccccatcgttctagaggctagtacatttctgtggaaggacctggggctttcttctagtagaatctacctgtgttgtgggagtcacttttttacagccaagcaggatggatgaatacaaaggagaacgcaacgctcagcagttagcacagaaaataaggttgaaaaggagatgggtcagctactgcaggtcagagcccaggtagcgttcctcggtcatttgtctgcctttccggaggagtgctgttgaggatttttttttttttctgaaataaagcctttatacctgggagcagttcttgaaatgagagttaaaaataaacaagcctatcagtctacaagaaaaaatgatttcacttgggcacctgtcaaggaaaaaggtgaaagaccataccaaaaaaaaaaagaagttgtgggcaggcactatttctggcactactctgagaggggcagtgttacggtattatttataaaatatccaacacagtcttttgatgatcagctacatgcaaggcaggggcttctggaaaattctctctaacttttcagagtcagttgcaggtgtagggaattcaaattttatcccaatgaaatagcattagcacattttcttttgtattagatcaccacactagaaaattagaaagtctgtttagaagttaaattttttgaaaagagtgaaattttataagcaaaaaccacaaaagcagaagacttttggatcaggaatgtgaagggatgagaggtttttaaaagaaggaaaatagtgcatagaacttctcattggacagagtgtcagcttagagtagtcacatttacttaggaagcttagtcaacactaaggagaactcataaaagagggcaaatataaaataccatatttca

SEQ ID NO: 111267 - DNA, 2631 bp, Homo sapiens
tttacatgtatattcttattaaaaagttggaaaagagcacttggacccctctcctctgactatcttagttatttcatgaaaggataataagaaaaaagaacacagtggaacgttgagcactgcatggagttctcctgtagtgtggtttccttggtcttacatcctgggtgtgttctaggggatttcttattgaagctgttctagcttatttttcccatagcagcccttgaacatctcaccattttttattctgaaagttttctttcctccagaaaaaaatgcagctagtcaacattttcagagagagctagtgctagttgcatttttatcttaaacaatagttataggcatctacaatctagaatattttgtttattgccattattctgggaaaggggagaggaaataagagacatcctcatgcttctgtgtcagctctgaaaagtgcccctctctgtatttataatagcccattctaggtggcaatcaggaaagaagcgaatctaccctgtgacatttatatttggggtaaattttcaagacccttcgatatcattaaattacattttctttttacagtgggttgattgcttttgtttgctttttgctttcaatggttgacaatatgctttagaattcatgtacatgggctaacaggcacccatgcctcgtgccattttaggatatttggcaatctactggaagaggttctaagaagtgatactactgattttcaaatgatacacgtcagcctaaacattggccttgacaagaagtccaagttagcaaataaatgaaaagaaggaatagtgaacactgatgttagaagacacatacagttttgtgctcatcctgtgcccataggcctactctttgttttaccttaaatttctagtgagctcttcaaaaagacttatctttcttccccagtttgcatctgggagctatgtactctctgcagggattgtatcagctgattaatagcaagggcatgagggcactccagaaatagaagtaatgattgctttaagccctcctatcaatgaggaattgagtctgcagtggctggctcgattccttagagtaaggatattaatgaaaccaaaggtgtgagttcagacctgtgcagccagttaatgccacagagagggaaatctctatatggtgcccaaagtcacagtccagccgtttcctagagcaagagactgcgtgtgactcagcaagcatcccgcagtcgcagaacaacaggaagctatgcgttctattcacagtggatttattgtgtcatcttggtttatgacagacagtagaaatacatatttttaacatgtttgaatgttaagctgaaaattgaggactttatttatcttttgccgttggctgttggtcactgatgtgtcctttcatttgtttcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccaggtatcctgccatattccttgcaagacaactgcaacccttctttctttcacttgtctcatctgtctgtgtatttctgtactcatgtatgtgtatgtgtatatgtatgtgtgggctttttttgttttttggccagtgatgtagaaaagttggaaaaaacagacatgctcaagagcttctcagcccgtccagtgccaaacagaaattttaggaggagccactagcctgtttacttccagccaccgtgttcttgtgtataggcctgaacaccatagtcctattaaaaggtgtgtctgtcaatataaaaataatttcttgatgtgctgctttgacattgaaataggtcaagtgctataagcctgttttcttaaaaggtggtcctcttcctttaaaatgggttttgaatttttaaaaactttgatcctatgcattttattagtcaatgatagaaattaaagtgaaatactttgagaggcaggactcaagtagtactgaacaaatgaaatggtctcttctatttcattaattttccctgcctttcctttgaagtttcaacaagcataacgtctttagcatatacactgtcctaataggtcaaagatagaccagtaattaagccggccccaaaccgtttcttggccctgactaaac

SEQ ID NO: 111268 - DNA, 2241 bp, Homo sapiens
ggattctccagcgccgccgcgcctgggcttccgacggcgcgcgcctaacaggtggctccgcggcttggatcccgcgccgggaagcacggctgtggcagtcggcgaccaggatcgctcgggcgtggtccggagtggggccagacgcccccccgggggatagcggcggccgctcgggaagaagctggagcttctcgggccgccccgctgggacgccctcgtactacttcactttttccgtctgctttttccctttctccttcttcctccatttgtttcttcttctctccacttctcctttgccttctagtgctttcttcgccacctctttgatgcactctcacgctgtcgcagtccatgctggctggctctcagttccgtttttccttctgtctttttttgtgcgcctgtgtttctcgggggcgctctgtctcgctctgtcccttttccttcccaccccttggttgtgagactcggggctcctccgcgtccgccacgccgtggatttcgggcgcggggaaccatcccgcccctccttcctgccccgggagtcgcaggcactctgctcccaccgcccacgtcgtcgtccccgccatcccctcgtccccgtccgtggcacgctgccgcgccgcggggtcctgcccctcccgagcatctcggcccgagccttacagaaacgcctcgtgggaggcacccactctggggtccgcgactcctctcctttatctcgagtctgcgggcgctgcccggcaaagcagcccactgcctgcctgcagggagcgagatgggctggttgcgaggccacagcctgaggcctgcgcccaagggacctctccaccagctcccagtgggtgcagccacgtttatccactcattagaactaaaagttcctgccaaggccttttatggcactttgaagccccccaaatcctgcatgtcagtgaatcttgagacttatttttttctcctgtggaaaatagaagtgttgtgtctaaatgagttatagatgcctccagtaataattctgttgtttgtcaatattttgacacatgaaggattggttttggaaaagaaaacctaattacaggttatagtgaagacttgatctgttgcatctctcactgatttgaagatgtttgattgctttcagtggggttcttaggtggacttccttattgtttgtggggtatgttttttttcagttgctcttgccccaatattccattgtgtttttatattctttgttaggcagttggctcacttgattttcctccttactttttttctttttccccccttcttaaggaggttcattttctttctttctggcttgagatcttattttctcctaaactacttcttgttcaggcatgtgtttatttctaggctcagctttatcatcctgtatttttatgttctttgccagcaatttgggtccttttcccattttctgtgttttgcttttactcttttgcgtagcctcagttccatcattttcattgacgttttcccctctatctgcccaggtcagtctttgatctcctcttgcttctccttccagcctttgttgattgtctttccatattttacttcctgttatacactgtaaatttacccccttctcatttccattttcatccatagttttagccggctatatatttcctgtattgcttctttttttctgcaccagtcacttgctgttctttccttggttacttctaccctggcagtttccttgctgtccttccttcatgtgggttttttttttccttccttttctcaccttgttctaaatgttctttttcagtgttccttctgatgtcctgtttagtttattttgtctctgttcccagatggaaattataacatcactaaatctaaaggagtgaagaggggcttttttgatgcccttcgaatttctccatatttccttttattctcacggttgcttttgttgtttttaaggaggtcatagagaggggtaagcttgatagcaccaagggctggatccctcgtgcttgttggaaagatgggaattggatggtaggcttcttccatacagtgagggaaatagtctggggggaagaaagccatagaactagacatcatgaattgtggtcataatattaatcactgatggacaaagccatctcttaacaggcacagtgatgtgagtggccatcagagaacagccacctgaagagctgattggttctctgagaaactagtcgttccactttg

SEQ ID NO: 111269 - DNA, 1981 bp, Homo sapiens
ttcaaggtcatccccgtctccccaccccccgcccccgcccccgcccccgcccctgcccccgtcttggggcagcccacgcccaatgattggccactactgaggtataaaagcccagcccctttgtccagacccgggacaactctgaagagccatgcctgctccagacctccctgtggggttggctgagaccgtgttgtggtggcactgcagtccagcctctctcactgccacttcctttcctctgctccactggtgttgaatcaagaacactccccagcacacctctgcacagaaatcatctgagtccaacttgcaaaactaggtctcagtgtgaggtagaaaggaggttgttctcaggtctttattttgtgagaaaatactcacctttgagatcttctttctttgatccttaaaaaggaaatcccaaaaaattgacctcctttgaaattcactacattcttttgctgaacgagacagtctgccatttgttatttccctttatttactaacgttcactctagttttaatttgtctcaaaatgtgaatagccaagcctacttgaaccaattttgcaattgaaatttgttgcagaacagaaaattacgtgaggaacttgaaggacgaggcatttgttggaacaggaaatgcagaacattatagcagagtggagtacttttggtaatgatgcatgggactgaaatgatgtgaaagggaaatcatttaaccatgtaaattgaacaaaggagaattccgtgataatgaccccaggccctagtattcaggaaaagaaaatggtgggcattggaatgaggtcaccctgacgcatgtggcattgcatctatcagtttgctttggtttggcaacctggtttgattctctgccagagcataagttggttttcatctcaacagtccttttgctccttgaagggtgagaaaataggcccatttttcaatataccacaaaatattttagggtgaactattttagggaaggaggattttaacaaacaagttggtgactcaatttgatccagagtttccaggttgaagcagttgcatttgctagagagaaggaagaggaggaagggctgttattgttgtcattgttttttctaatatttcctaccaagcaactgctttgggataataacaaaatgattttgctatggaaaaaatgcagagaaaagaaacgggggctctttgattggctaataatgaacataaaggacttcatgcttgctgaatggcagattgaaattcagtgtgtattcatgcagatcttatgggggtggtattggattggaccacaaattagtgctggcattaatgagatggaagctgtaaaatgcagagttccaataaccatgatctctgataaggcccaattgaaagcacccagaccgttcagacaagttctatgtgaaagcagagcaataaacaacaaagagatattcaaaatgcgggaaaaaaattgaggattatataactgactaaactggtatcagagtgcttggttaaaacattaatgcacagctgagtgacaaacatagacttgcatagaataatgatttttagaaacagacactgttcggctggttgtggtggctcatgcctgtaatcccagcactttgggaggccaaggtgggtggatcatgaggtcaggagtttgagaccagcctggccaacgtggtgaaaccccatctctactaaaaaatacaaaaagtagccaggcgtggtagcacgtgcctgtagtcccagctactcagaggctgaggcaggagaacggctggaacccgggagacagaggttgcagtgagcccagatcacgccactgcactccagcctgggcgacagagcgagacttggaaaaaagaaagaaagaaagaaacagacactgtttagatgctactcaaatgatcagagagaaggattatacctcttcgttatagggaagttagtctaaatctggaactgcactg

SEQ ID NO: 111270 - DNA, 1535 bp, Homo sapiens
gtcagaagcagatttactgtgcattggttacctctttagcccgttgcatcttgggcagcaacttctactacttgcacaagtctagtgagacagaacacttacacaagttaagcaaagcaacttcatttatttatttattttagagagagtgtcttgctctgtagcccagattggagtgcagtagcacaattgtagctcactgtggccttgaactactaggcccaagcaatcctcctgcctcagcttgctgagtagctgggattacaggcatgagctactgggcccactatgcaaagcaactttatcacttacagttaggcagcaagatcctaagcctagcattcacggtgaaccagtcccccaaggcttaggaaatctgcagaggatggatggaatcttgtctgcatggtctctacatgacattacagctgagggactccaaaagcagtcgattctgggttttatacctggagacaatagatcttgctcagctaaaattttgcaggaaaccctattttagtggggacatgaacagaacccaggctgttctggacagttacaccttatctcaagatgttgtgttccccgcatattttgcagttattctgaaaaccaaaggccagaaagtggggaaagagctgggtttctaaggggacttgtcctgcaacatggagagagatatttgatatatgtgaagaaagaggctctgggcagcaccagaatcacatttctgcccagtttcctttccccacctgcaccctccaaccagcaacacctaaggtgacacactgtgctctttgggcccctggaatatgaactatttcagtaacagctccttgaccccactttcaagatgggcaggagtgtcccatgctgctgtttgtgaaggtttgtgtttcagatggtagagcatcttcttgtccatgttcagtacatgcaagtggagcaggtgttttccccttggagaaccatgaagggcatcctcagacctcactatgcttggataatgttttgtagaacccctactaaggctacctgggccaaagctggccggcatggggtctttggttgtcccaggtcctactgaagggctgaggtatcctgcagctccaggcaaagctcttaacaattcagagcacaccaggatgccaaggcacacggaagatctgctcttagccattgcttccatgatgcagattcaagttttttcatcatcactgtcttcctctgatggtcatgtctgattaatatataccccttccaatgcataatgttcatacctgaaccccaggtgcagcctaatcagcaaaggagactcccaggaatactcacctctcttgacatagatattatatatatatatatatattttttatatatctatatatatatatatatttttatatatctatatatatatattttttttttgaggcgcagttttgctctttttgcccaggctggagtgcaatggcgtgacctcagctcaccacaacctctgcttcctgggttcaagtgattctcctgcctcagcc

SEQ ID NO: 111271 - DNA, 2047 bp, Homo sapiens
ctcgcctctccacatccagtcagccactagggatattgaccctgcctcctttatgtctttcaaaccccttctcctctcttgcccttggtctctgagttcagtaaggtaatgcttgcaaggtgttggccctgtgcctggcacatggtacctacagcatacatgacagctgttcctgctattagcagttgctccaaacccttgttaccattcacctatactgtcaggaattgtctcctgttctcatgcttccagtcgtatcccccattaaacccataccttaaattccttcaatcactattaatttttctcatagcatatatcttatgatctctgttccctgcttacaaacccttcagtggctccctatggcccattgattgagtttctatgacttctgttacccatcacctttcctgacctcagattttccaggatggctgaccagctgctcatttgtgctactgctacgtgtacattatcatagttaatccaggtctccaatcaataaggtagaaactgctgacagcattttaaatggaagtttttccagcattgaaaacaaaataaaattgtaaggtccagcctccagaaatcctgtcatagtatcattttttttttccagattgcttcataattatttctttaaatgtctgccttcccattaatatgatgtgtggggaaaggcctgggtcagagtctttgtctccacagtgcctggcatggtgcctgatactaagtgttgattgagcaccatttgtgtgccaaggactgctctagggtatgtggaaactataagggacaaaattcctgctcttcctgagggaagcctgtgcactacccatccctttccagtctctttcctacccagaggctgatgttattcactgcattttctgtgattagtaacataaagggggaaaaatcattcagagagaaaatatgaactgtcagatgagaatgaaattataagtggtaagaggagaattaaattaagagcagtaagcatcatggatttataaaaacaagtcatgtcagacaaacttaattgcttttcctgatagaattaccaaattaagggatggcgggatacaatatcctgagagcagtttccttcaacgaccaggtaatgaatattatttttgaagttagcagagccttttgaaatagaatcagttgaaattgtaccaaatgaattcagattgactttgatgtgagtctggttcactgacttgacaacagattggagaggagaaaaactaaggcaactacaaacaatatggtgctgagcttcaagacactgcctagcagaagcgtggggatccttattcagatggatttatcacaatcattattggagtcaaagaatgacttttgtggcatttaaaagacatcaagagaaaatcacagtacttgggggaagtcactgcatggagcacagaaatgagatgcttctacactatcattacaacagtgtggcccttggagtgataataaccaatatcttgcatagtgctttaaacctctgctacccagggtataagtctgcagacagcaggagcatgggggagcatctaggagcttcttagaaatgcagagtctcaggcctcaccccagtgaatctgagtccgcattgtaacaaaatcccagatgatttggatgcacgttaaagtttgagatgcattgctgggtttattttatattatcctatacaatttgatttttagatctttctcagaggggcgagactttgtgtttacctaaaaaatcagggattcagccccagtcttagcaattccattgtttactctttccaccttccttaaaatcaagcatatgaagctgatgaagttggtcccttggggaagttacttaacctcagtgggccacactgtgtttatttgtaaacaggagctaacaacctgggcaccattacagtgtttttacacgccacatgtgtatataatactttcgcatcttctaacatcactgagtatattattattcccattgcacacatatggacactgacatttggagtgtttatgta

SEQ ID NO: 111272 - DNA, 1089 bp, Homo sapiens
gttctgggattacaggtacctggccacagtgttttttctttaaaggccttttatctttctgaattggtaagggacacaaacttatgtggtcttgtttggtagagtgaggttcttaagactctgattcaaagagaactctggttattcttggcctatttgtatttacagaatcagagattaatagatgaggaagagatgtaacagatcatctacttcagacttttaagtcccaagtataagatttattgctagactgaaattcaaatggtgcaggaatggtgaacccagtatttccccctgtctgtcaacacacagaatgtggtaatccaaggcaatgcgattaagacagtggttcacctaaacattacttattttcacatcttatcaaggctgccagtgtagtattggagggaaagcgcagaatcaacccaagacacacaaataagaaataaaaacaggatgaatgtggcagacatcctcgggtggccatttaatacctgaatctgggtcacagtgaagggactggctctagtctctgacctaacaagcctggtcaatttacatgatttctgtctctgctttagctggaagatactcaccaaacaaacaaacaatgaatcttgatggtttggaggcaacagagagggagaggccttgcaaaaattcagatccgcacatgcaacatctcttggcaggtcagtgaattggcaactaacagctgtacagtaagatttctgagacaaatattcagattactatcaatacgactcaaatgatcctcctgtgtgttgcagggaggaggagggggagaggtagaagtgttcatggtggcttagcaacatggccaggggctaaaatgggagtctcctttgaggctttaagcatcaccagattctgaggagcatgcagagcaaagaactaagaccccaagtcttgcaacctagtttgggacatgggaaggggtgcaaaatttaaggagggatgcagatcattattggaaccagtaatttgaaaagtaagggattagcaagcagcagttcaagcataagcaggcagaggtctgggacaagagccaggcctggggtgttt

SEQ ID NO: 111273 - DNA, 1045 bp, Homo sapiens
ctgcttcctccatatcttagatgttggccaaaactttgtggccaggctggtatcctgattacagatcaaccacctggatgccaaacagtgtacctgtgggaacttttgcaagatgtgctctctactcccaatgatttggcctggaattagaaatgtgaactccactttgagaattttgcaggtgtctgggaagcgttgggtcccgtacaaaaccattctcatatcttcaacacagatttatcttttacttatgcagagatgataatgggctgccattcgctccttcaacttcctttgactattgaaagaaatagatctactatagagtttgttgagaatctttgtagtccaagttcaagtaaaaacacattatatcacggataaaatggtttcagaaatcagtggacaagtttatgttagtttttgcaacctcaggtcccactgccaggccaggtaatgctttccttcttggattccatgttgtgtgcttcagtctgaataacattaaaaatatttctcttagcaggatgcggtggggttgttttcttttttaatttcaaataacaccactccttgaactgggaacaaacaattcacttgcagctcggctctgcttttatttgtaattttcacataaatcaacttatatgaaaatgtattcataatttgagctttctctatagcgataaaatgtttctgcttctgtggtagaaaatagcttattatgcaaacaacattgccactcttacattatgcatgggatttacctggagaacatcacaaaagcttcaggaaaaaaaaaagccagggagggtgtagtagggtgcttcgtttactgcaccatttacctataataattagctacaaatgaactaatatctgtatttagcaacttctttaatattgctttggttaattcagtgaaacaatggagaaaaagaaaaaaatacaagggaggtctcctgacaaatggtgcctttcaggatgtcagctccatgaaaaatgagatctggtggtttcaaacttaggccagtggtggtgagta

SEQ ID NO: 111274 - DNA, 1173 bp, Homo sapiens
cagccctgaaaatgttctgctgttttaaactcttagttttcaagatagagtaaacagaaattttcataggcttgtaatgaccacatcctgcaagacctggcatgactcttaaagtcaaactgatgtcaacttctacccattccattttacattttactgccatccaagcaaaaattaggaacagtttgcagtccagtgtgaactagaagcctcctggtccaatgccactgttccctaggtgtctgacggaaggcaagttatttaggagaggcaagctggtggaatggacaaagcacacacttaggaattagggagcagctgtagcttatgactttgtgtgtctctgtttgcaaggcttagaagtgtgtagataatgatcacaagcactttctgttgtttgcaacctgtgaacaaatgccagcaactgactgactggctgagctggatgggtcccccagaggatgagtcgctggcagctgttcctggtgtatcttcatgcatagttacttgtgatagaagaaataaaattggagcaagagaacaacttggcttcattcctttggtgctgggaaagggttgtgtcttgaactcatctgtctgtatcctgttaagagtagctcagatgtaaatttcaaattaaataagaacgtctaagagaatgcattatgaactcagtgctcaatgaacaaaataaaaattattgcagtcaacggagttaattttactctggggatgagtttatatttttttctctttaagcatgcttggaattcagtcctgggagtcaaatattgacatttacaagatgacttcttatactatatgtcaatgagaatgagtgactctaactgcacacgacagttggaacaaatctcgtaaagataatgtttagccaaagaagccagacgcaaaagagtacattctgtgattctatttacataacatcccaaaacaggcaaaactcatcaatggtgtgagaagtcaggaaaatgattgcccacggggtcaggagtgacacaggaaggaacagggagagctagaggtgctggacagctgaatgtgatcaatttctttttctttctttcttttttttttttttgagacggagtcttgctctgttgcccaggctggagtgcagtggcacaatcccggctcactgcaacctctgcctcc

SEQ ID NO: 111275 - DNA, 1037 bp, Homo sapiens
tttctttctatttttttttgagacagagtttccctctgtcactcaggctggagtgcagtggcgtaaactcagctcactgcaacctctgccttccgggttcaagcgagtctcctgcctcaggttcccatgtagctgggattacaggcatgcaccaccatgcctgactaatttttgtatttttagtagagatggggtttcgccatattggtcaggctggtctcaaactcctgacctcaagtgatccaaatgccttggcctgccaaagtactgggattaaagaggtgagccaccgtgccaggccccaggatcatacattctttagtctcctttaatctgcaaccattccttggtctttcttttatagtatttcatgagattgacagttttgtagagtacaagcccctgatgttcccccaattttggtttgtctgattgttttcttatgattcgtttcaagttatgcattcttgccaggaataccacggaaaagatgtgtccttctcagtgccactttggagggaatatgcaatgtcagttcgaaaatgttcatgggcattagaatatatctttcattgttttccttcttatttgttaaaatgaagactacagagaatttcttacttggaaattctccttgaaaatcttactacatgaaacaatagagccctaaaacctgccatgttttttggaaaatgatcatagattctagattcagctttctagtctttatcacaaaatacaatggtgctgatgtgcttgaatgtttcaatatctcaggtacttctctaagagtctttgttatcaggagaattcaattgtgttggatatctgagggggctaattaatgacccttcctcttctacaggctcttgaccaattgagatgctgatcagctttattagtagcaatgctggagaatgtggctaagccttctgcctccccctccaaaacacaaccttccttaccctcccattcctgacctaaccattctcagcccatcttgtaaaggtgaagacctgaccaggcctgcccgaaga

SEQ ID NO: 111276 - DNA, 1035 bp, Homo sapiens
agtagagatgtggtttcaccatgttggtcaggatggtcttgatctcctgacttcgtgatctgcctgccttgccctcccaaagtgctgggattacaggtgtgagccaccacacccagccaatagtctttatttttatcatatactctctctggtttgaaaaatagtggtgcacaaacagattatgcttttctaactccttaaatatggagttgtttagtatttctcagtctacctcataaaactcagtgtccatcagggttggcaaattgggttgaacttatttgctaaccgtagtaggatgacagtagccgcctgaagtccagtgatgagaactgtggggctcatttggactcagcaggacagactgctgtgatccattagcaatgtctgcccctgggaggggaagggagtgggtggcacgtatgtaggctaggcctgaccaggtgtgagggttagtgaagagggcagtttggactcagttcaaggttgctcttgttctgacttacaatcaaagctgctaaatagcaatgtaaaggatttactcttgataaaggtttagatggaaagaaatggcttctctctgccttgctttctcatggaggatcaattcagtctggtggccttggcagcctgcatgcaggaagatgaccccaggtcacacagagtacagagaactgtgggcctatgtctcttatgccctggctacatcagcacttagagacaactcatgcgacctactaaggctttcattctgtccctctgcaagctgcatctcccaggcctaatgtctgggttatgggacctttgctgcagggtctgaggattctccacttacatccactacgcatgggtaggcctgacgatggctcaccacaaaccacactgtaccacacagtgcccatgccacatcgtggctctcagaatggcagccaggagatctgtgaacctcatttggatgcaaagctgcttcttgaagtctaattgattgtcataaagaagttcatatgtcaaacaattttgtttctagaagttcgg

SEQ ID NO: 111277 - DNA, 1004 bp, Homo sapiens
gtatccactcttattagcatcttggattctttgtcagttgattttactttgttgctgtagcaggcagcctctcatgtaactctgtgttcttgggttttattgctagaaatgcactgagcacttttatagttttactgtgcattctcttcaaggcaaaattgttatgtctatactgatatgcactgtgtataggacataccattaaaaatcaacttgtcactgaggagcctgaatctgggaatagaattactgatgtttcaggattctagtgaggatcatggaataaaatttggtgatttcaaatttgggttatgaatgccttttagccatgtgaggttaaaatggttgaaatttggtagtataaaaagtcaccggtttattaaaaatgggtttttaccaggactctccttggttccctttggtcaattccattagaaaatcattagctgtttacataaataattgcaaactgctagcaggtaatgtggagatcttaatcttttttttttaagtggaacttaaaaaaatgtatgtttagataaatttttctcttcttttctcccatccacaatccctgcccatttccctactttagacagacagcaagaagaaacgaaaccagaggagaagaatggagctggatcgtctgtgaagaccctgccaggctgcaaagaagctgcactcataatgcagagaatgcagctggaggagctctttgatttaactgttgttactgaaatctgtgcagcatcaagtgacttagagcaggaagttatcttagaattctggaaagattcaaggtgattagacagttgacgagtgagagttcaaagccggtaccactcatttcaggcaaggtttgggcagtgacataaatccttagccaagagctataatagtctcctttaggctccttgaagataggaggcagatcttaatcctttctgcatctacagtgaattgtatagaacaacagtaggtgcttcatgaatagctgtcagatg

SEQ ID NO: 111278 - DNA, 1079 bp, Homo sapiens
cccatgtgaggacacagctacaggcaccatttatgaagcagagagtgagccctcactggacaccaaatttgctgacctcttgatcttggacttcccagcctccagaactatgagcaataaattgctgttgtttataaattacccatttgtgggcagggcgcagtggctcacagctgtaatcccagcactttggaaggctaaggcaggcggatcatgaggtcaggagatcaagaccatcctggctaacatggtgaaaccccgtctccactaaaaatacaaaaaattagccgagcatggtggcaggtgcctgtagtcccagctgctggggaggctgaggcagaagaatggtatgaacttgggaggcgaagcttgcagtgagccgagattgggccactgcactccagcctaggcgacagagcaagactccgtctcaaaaaaaaaaaaaaaaaaaaattacccatttgccagagcagctcaaaaagattaagacagctacagctgtggctttaatgacttcaagtgtgtgtatgtgtgtctgtgtctgtcgatacacatgatgtgtgtgtgtaaatgtgcatatgtgtgtgttggtatacatgtgtataactgtgtaactttgtataggtgtaggtatgtgtgcacgtgactatgtatttatggccaggagttggtctggttttcagacatctcctccctcttctaagaactaacttctcccaggaactgggggagggggaagaaaagggcgaacatctctctgccgtcctgcacaagtttgcatgctccacttgattggctgtgttgctcttttttctcagtgtctgtgtaggagtgatatggatgatggtcattgtcattttccactgaccagggactcgctttcaagtagttccccaagtattagcaggtcctttcaagatacagctggatcttgcagcagacccctggctggttctgttccactgcatttctcattgtccttcctgcggtgacagtacctaatctttgctatcatctggagctaacccagtgcaagatccatcctctatacctttctcctccagaaattcttggcttcc

SEQ ID NO: 111279 - DNA, 1036 bp, Homo sapiens
acttttaaaaacaaaattcttattatttaaatatttgcttaccaagtcaaagcagaagaaaacaaaatcctctataaagattttcatgaaaaaatatgttactattccaatatttcataccacctggtatgactgatttatcggatcatttttactaacaacttttggggattactaaagaaattgatacaaaatctcactcaataatccaaatgaattactcaaactttccaagacatgcttggaaaaaataaagaacaaattctcaatttataaattgaattctacaaatgaacacaaaagtggaacaccctgccatctgcttcaacaagaatgatgaaaatgacaagacaaaaattgcatcaacccctctgtaatttttggcagaattttgtacttattctcatgtacctatattcttgtcaataaaaggtgatggtcgaatgtataactcataaaatttgattttgtaatttttgaggctttctaaaaataaattcacaaattaaaagtataacttgtcagaacatgaagtcaaatttgggctctagaaatacggtcaccatatgagtgttctggatcagaaagagcactctaagtcagaaagggtgaagcaaagacagtcacagtggatgtaaatgaaagaaaaatgaggtgtgggtgatttgaggattaatgggggctttttctgtccagaagaaatgcattgcagacataagatgattcttgataaggtaataatcgcttactatagtcaaactctaagtacttcagccagaaactactgagcaccaggagagagctattaggcattgttaaagcaattgatcgcttccatcattatttgtgtggctggaatttcacaatcagaacttatcatgctgcattatgaggcttgctgaaattcacagatttgtagggacaaattggctggatgtttacaaaactgtaaggctatcatttgcgaattgaacatcgacagagagtaaaaaaacatcgtaatgcccatacattatctaggcaccctgtgttggga

SEQ ID NO: 111280 - DNA, 1073 bp, Homo sapiens
gtgatcctcttgccttggccttccaaagtgctgggattacaggcatgaaccactgcacccagctatcagtttgtcttatagactcaaattatcgaactttcagaggggtggggaaaaaactcccttcattcttacagtgacgggaatgttgctttcctttgtgtatggaggacatttttcacatggagattttgtctcctgcttttgggaaaacaaagggaaaagagtgcagtcttcttgtgcttgctcttgtgtgcctgtaatcccaactacttgcttgaacccaggaggcagagtttacagcgagccaagattgcaccactgcactccagcctgggtgacagagtgaaactccatctcaaaaaaaaaaaaaaaaaaaaaaaagtgcctctaactcaaaataatttatatgccaaagtggcatcttttggggtgacatattccaccacccttcactgtttatctggggaaatcctagaggggctatgtttcctgaattcacacattacactcctgaataaacacagagtaaattttctgagtaaacaagaaaagcaggtggagataccagccacaggctctcacccctcttaccagagtggtctgcctgatttccaaggctgcaaatacacaaactgatgtccttgtatgagaggcttcttccttctgcttgtctcactcaacctaaagggcacggctataatagagaaaatgagtgtctgccctgaacagccaagataaccttgaagggaataaatgaacatgcatattgatggagcaatttgagtacatattgattcctggtagctggtgtctgtattcttagctcatataataggtagtaggagttcttataaataagcctacagaatacttttttttaagaaactcaaccaacctttgggagatcttgttatttttatttacaaataattgatggagaatgcagtgtggcctatggcttggtgattattgattttcagtcctgattaacagagctcaaaacctataggtggctacagaaacaatcctgagcaaacatgattccctactgggaaattaataatgcaaaa

SEQ ID NO: 111281 - DNA, 1022 bp, Homo sapiens
catggcacatgtatacatatgtaacaaacctgcacgttgtgcacatgtaccctaaaacttaaagtataataataataataataataataataataataaaagaaaggttggggaagattgtgcagaagggagagaggagcaaggaagatctgcaggatgatagttcactagacaggccaggtggagaggcagagtggagggcattttaggcagagagaaaaatgtgtgcaaagtcagagtggcaaaacaccctatcatattgtgttcagggaaatgaaagcagttccatatggctgaagtataaggagcaaggaagatgaaatggagagagaggcatgggcctgagagggaggggccttatttggtctttattctggaataaagaataaatggatgaaccataactgaaggcctttaagcaagagcatgttagcatcccatctgaagttcagagaaatactctagcaacgaaaaagaaacaggatctgaggacagacactggagggcagagatgacaaggacccgagcaagggtagctgcagtgctgatcaagaagacagaatagactggagagagggctgagaggcagaactgatgggagttcatggtctccatgatagacagcagctcctttgatcctaatgtctagattaggaaatcaagatcaggggttctttttcatttagtatctcccaaatcgaacacagttcttggcagacactcaacacttggtaaatggataaattccattgtttagcaaacacatcttcagccaggagctaagtgaatgagtcaagaaatgaatcagtgaatgagttaataaatcaaatgactatttcctggttagtttctgatggtcctccaaagcaattaaagacttctccttcatttctaccactgtccccatcacacggagagcagaagtcacagttggaatattgcaatatcctcctaactgattctgcagtctctattcttttgccaaaagtcccaaagctagaatggttgtgaagtgaggcttc

SEQ ID NO: 111282 - DNA, 1072 bp, Homo sapiens
aaattagagaaaatagtctgattttttaaaccttccttaactggaaaaaagtcacatggttttaccaggattgaaataaacagtcaatgtgacttttaacatgtgtttttttgaaataaagggcacgtactcttcaattaaaaagttccttatagggactctggcaaatgctaacacagttgctttacaatgtttacaattcagacaatacgacttataatagaaaatcctcattcatttagcattgaaaagctggaagttgcttctttaatgttgaatagtatacagtggtattgagcatggactttctaaatgttttatatatacatataaaaatatattggtgtctcacacccagaaagatgttatattgtagatattattaggaaaacagtgtttctcaggaacgttgtaaattttaaatgatatatgtacttcccgtcctcccacctccactctgtgctctaatgtgagactgcttcagcagtgttgctaagttaatggaaaactttttctaatcaagtcaggtgaatgtgtattctgctaaataatgttagccatttacatgaattgtatggtcattaaatggaatcagtgattcctctttaatttccagaggggaaatgaattatggaaatcagtcagcattctgatcattaaattttatactttaattttgccgttcagcattctaaatatccaatgtgaaagtcacatgataatttgttttgcattgcgtgcactgtacaacacttacaacttgtcatttaaaatgttttctcgggaaatgaatgctagtcagaaagtaatagattgtattattcatagttttaaaattatgacaatgtcataattactacaaagctaaataatcgtgtttatttttgtgcagttgccctttgatagttcctggttttaaaacctattaagtgtataatcttacaaatagtcatctacaaaatttatggagaaagtgcccagcccattcacatcacatggaccaggaattcttttgtaaatgacttaaggtaacatcatgcagttcagtgcctaataaatgctttttaatgat

SEQ ID NO: 111283 - DNA, 1013 bp, Homo sapiens
ggtagtacattttccccatttaaaaaatgcggattttactcaggccggtaactttacagtcagaggacacgttcatcatgagtagcttttgttagtatgttttaaaatgtatcttcagttcaattattttcagcatttacaagacatctgaaaatggctattttgctaccaacagtaaatgaaggggctgtttaaaaaccacaaccagttttctacactattttttaaataatactttcatttgaaaaaaaggaattagttttcagatacacttcagagattgaagcaaactatttgccttttactcaaaagcctgcttgcctttacatggacttaccagcaaaataggtagaactttctcttttaaaaaaagtcaactagaattgagaagaggtgattttttttcagatcgcttctcgagtttaatattttcacattcttttcaccctttttctcaatctagatttaaaattaggatatatgtcatttccttgtctgtatttgtagctccttagttaccagtatgcctctccattttctacaaataagaggttataacacatatacataattctaaccttaagggaacacacgtttacatactttacttcccaagcccttcctgtttggggtacagattgagagagtcatgaatcaacacatctagcaagaccacaggtgtaagagtctaagatcgtcttcaaaattctgaagtcccagtctttacctgtccagtgaatgaatattcagagcagcttttcctgggcttcccagtggtgatagctgaggtcaaaccacaaaaaataagaaagcaagagtgaaatgcacccctccagagaaacactttgtagtgtttaattctgttaatagagaagagctgcttctgtttgcgctcacttcatcagtggcacccttctgcagaattttaatataaaaacattatggatataatagaactggattttctgacttaaaaatgtaagttttattttaatcttgaaacgtggattgtt

SEQ ID NO: 111284 - DNA, 1071 bp, Homo sapiens
aaatcaagccactgcactccagcctgggcaacagagcgcgagactccatctcagaaaaaaaaatagtatgtaatcaaaatcatagtttgatataaggcaaattaccttgtataattgcatttgtggttcagtagttattaggaactgacctagatatgtatcatatatgaagtgaattacctatcccaagttctcttccttacaccaccccctccaaaaaaaaaaggaaagttagaaagctaatcaaatccactaaattcacaaagcattgtaagaaagaaattataattagttgcagtctataataaaagacaattattaagataggaggaggaatttattttttttcttcatttttatcatactaaagctgaggttttggctaaactataggaaatattttaccctagtatatgtcaccttaatcatgattcactgttgttatccattttgacacaatggagtagttgtcagaactcagtgagaccttggcttccagctctcttgctctcattatgctgaaggaacacatcacacaccagtgtgtgccacttttttgaaaataatagcactgacctttgttgagcgctcacttcgtgccaggtgcttcccttgcattttacgtgtactatctcactgaatcccagtaacaaccctatacagatccatcatctccatttttttccagatgaggaaactggggcttcgagagatgaagttcccaaagttgttagtgacagatctgggcctggagtccatgccagctgatcccagagctcctgctctgaaccattcacaattctgcctccttttgctgtttgttcaaaaatataatagagctgcaaaaaacagcctactactaacttgacaaagtacttaatctctgactcagcatcccagtgtacaggatgggaatgataatacctactttcagggttgtgtcctcctccctccacctttttcttcatctaaaaatttgcatcacaggattcctcataggaaagtacctgcagtttgtcagtaaattcagctagtaaattaattatgtcagttctctttctctagcgataa

SEQ ID NO: 111285 - DNA, 1020 bp, Homo sapiens
aaggctcctgggagaataccagggtagtttacgtttccctccaggactcttctaaactatcagtcttctgataattacaatctgtgaacagcatcttcacagcttggataacattcagaccgagggatgcacatttgcctaatgagccacatagtgccctgttagctttaactagtattttgttatttataacaacccacaacgaatatttgcattccccaaaattagttgtgtgggatgtttgtaagaaggatgtaggggaaagtgttccataatcaatcaatacctttaggaaacctgggtttaaaaaactattcagtagggtgctttactctgacttcttgaagccttacgctgctctgcgctgtgactctccaagaggatgctgccatggtttcttttcacctttactaaatctctggccatgggcccttttcaggggatgctttcaggactagcaaccacaggacagtttcatgagatactgataagcaaaagctggacttcattttaacacatagttcagaaattgaattatcgaattaaaaggaataaatgtttgtggtgttggtgcacattgccaaataccttttccaaaggctagttcattgctggtgggaatataaattgctacaaatacctattccaccatacacctctcactccaccaaactgatggtgaatttttaaaatctgatctaatttgtcagtgttctctaagactgcagagtgacttaacacttttccatgttgttaattacttgctgctgcttttatgaatacctttccaggtctcttgcctatctcttgagattgcagctattcttatgaagataaatgggctatttttctggtcagatattaacccagaatttcatgtatttgtagtagtcattctcccagttttttattgtttacttttttagttatgtttctttgaacacgtggaagttctacgttttcgtaaatcagttctttaaagcatcctttcatagttttttttcactgtttttaagcttt

SEQ ID NO: 111286 - DNA, 1576 bp, Homo sapiens
aatgcaggttattgtgttttacagactgatttgtaatcaaacaactgatgctttatgagatggctttttaaagatttttttaaaaaggtaaaatgcagaaccatcacaaaattataaaaatctgtaagaatggtgtaacaagtaaatatattgaacactgagatatcataccctgtctcatacaacttacttaataacatcatagtattttaaaattttgtttctcttaatgaaaaaaattttttttactaatactgtcctcatttttctgcgacttttaagtttttaaataggacaataatgaagattaaaataaaacgaattatgtttttaattatcttcactattctgggaactatattcctagagaatagtttcagaactgcacattttctagtgctcttgatgcctttttagaaagactattttcttttgcatgtttagttctcagtatgcattgatatatagtcaaaaaattttttataaaaattaacttctagtttatccaggtcccaactagctcttcctcctttccctctaaacaccttttttaatcgttttttttttttattactctcttgccagagaacagagatgcaaagtttctttcttgtatcatatggctagattgagtattggttcttagcccccacgagatgataacccctttttcagctcctcatcaccccagagaaatgtccaaaggaaagaagcacataaatgctgtgagctggtatctaatttgcatattttctaagatttgtgtttgtttgtttgtttgtttgtttgtttgggataacccaagccaagagttttctttgtctctgagtaatcaaaagctgctgagaataattgtaaacatattggggtttatctgaaacaccctttagttattttctgggtgttctgccctgtctagtttcgtggagaaagtaaccatcccatgtaagagcccaattcagttcaattaaactgagatttatggagtgcctatgtctcaggacctataccgggttcagtggatcaaaagtttcaaaaagagtccattctgaagagctagtttgtcatggagtagtcccacagacaattaggatgtaagacgctagctgttatgctcataatgcacagggactaacagagaagagagcgctggacgcccaagctgttgtttggaaaagtgtcttggtactactgttccccaagctgtccaggaaggtgggtgtgaaaagagttttccaggtacagaacagcccaagcaaggagcaagtgtggtgttaccaaggcagaaaatgattggagctagaaccagaaagttgagcaaagaccaggtcacaaaaagttacctgaatgtcattaacatcattactgtaagtcatggcagacatcttttcattacagaatatacagtattccagagagtaccagaagccatagaataaagatttgagtcagaggaagtgataaatgctattgataaactaggaagtcatgaagataattatattttgatgtgaatatatataccatataattgaaatttgcaagaatttttttcagctaaaatgaaagacagtaa

SEQ ID NO: 111287 - DNA, 1090 bp, Homo sapiens
cattacgagaaccagcattgtgttttgtaaccacagcacctttgcctgcaatatacggcaagtgtagatcgagcgtctaatgtgtgccagggcctgtgttaggcactggaggatgcaaggatgaatggaattggccttgtcctcaaggatccctttgtttaatggtggggcattgatgtcataaacgagagagaggccatggtgtacccgtatgctacagtgatgagcaacgtatgaaagctgaacgaagcctgctcctggtacggcacagctttaactattcagccctagagtcaattcattgtcgcattcattcattccataaatatgtgttgaggacttaattggtgccaggcactgttcctcaataccaagttaattgggcaggatccccattgcctaattgagggggccagggaatgggaaggagaaacaggtactaaaccagttaacaaatgactaaatgaagaataagtaaagataatttgacaaagtgataagtgacgggaggaacacagaacagatatgataggggacaggattataatgggtgttccaggaaggtctttctgaagttgggacggttaagctgaaactcacatgatgcaggaatgaatacctgtcatatgaagaagagcatttcacgctcaaggagtagcaggtgcccattctccaaggtggcaacgggattttccatccaaacacaaggcccgtgactgcagcagagagagctggagagagcactgtgaggtggggtcagtgaggtgggcagagggcggactgcctctctgccctccaggcccagcattctagtgtgggaaccaccacagtttttgtttgaatgacaggccagaaatactcatgaaagaaagtatgaaagtcgttgtgccatctgtttcaataaagctcataactggagatagtttgtttttttttttttgtttttttttttttttttttttttgagatgaagtctcgctcttgtcccccaggctggagtacaatggcgtgatctcagctcactgcaacctccacttcctgggttcaagctattgtcctgcctcagcctcctgagtagctgggattacag

SEQ ID NO: 111288 - DNA, 1113 bp, Homo sapiens
cagtaaaacaggtgagagatcatggtgtgtggggcccggagggcagcagtggtaagaagtggttggattctgaatacagtttgagggcagagccaataggattgatggacaggttggatgtgaggagacagaggagaagtcagggcagactccgttgtgtttgccatgaacatcaggagagagtgcttgtcggtaactcacatgatcctcacaccaaatgggttgccatgatcaccactttacagatgtggaaattgaggcacagagaagttaggaaccttatctgacatcactatctgactcatagtggcagagataaggtttcaacttcgatgtctgatccccaggtctgctaccttaaacgttgccctgtgctccttctctgataatagttgctaagaggaatgcatggtatttgatctggaaattagaagtctaaagggaccctcagtcctcgcaggtatttcagggatttgtaaaggaaaggaaatctctgtattctgttttactggcagcactacctcctccatgttcttctctctgccatttcctctctatagacattgcagcggtcttgttcttcctcagtccttcttccacatcagtgccacagtaaccatttcagaatgcttaaactgcttctcgagcgatgactgtatcttcatttctttcctcattcactcagacctaatggtgcggggcccctagtgccccataaatgagtgttaagtgattggcaaataacattttttgcttgcttccgtgttttagacaaacaaatgagaaacagtgaaatagaggttatagagaagcagctttcagctcacataagtacatctttccaacatcttgtgatttccaacacatgaagattttcagcagcagaacaggatgctggtctcatttaactaatccttcccaggccaggcagatgagctcccagccactgtgatacttaagcagcactacattctatgcctctgagtttgtcttccaattcctaagagtttctcttgtatgcctctctttactgcgtccacttcagagaactatcttaaaagggcacagatattttgctctagttaacaggatctcggggtgcaaattatacaa

SEQ ID NO: 111289 - DNA, 1034 bp, Homo sapiens
taagggaatttgagagagtttcattagtatttgtgtactcggtctacataaaacttttttgactcagatttccttgctctacagttcagccacatagcgatatgggggagcatcgcactctgggtggtgttttttggaatctactcatctctgtggcctgccattccgatggcccctgatatgtcaggagaggtaatgtgcgctaataactcacaatccaacaaaaccttaaaaactggtattttttagcaaaccttaatcgtttagcataattttccatcttgttgatttatattaaaataggatttgaccatttaaaagctgtttttaaattccacagtttcgagtgattaatcttgagagaatattttaaacttgaacattttacttaaatctgacttaccttttcataaacataaccaagacaataaaatatggttgtcgggagcttgaatctcgttaagaatatccatatagaagatgccattttaaaattacaccataaagccacaaatacattttgattaaagatttggggaaatggtgagtttctgtctggggacagtctatcatttcttctgttatctcttattccagagaaaaatctgctgtcactagattaaatgcactttttgagttgtcctaatgacatcagtttggttttcattttgaaagaattagggcatctgacatttcagccttatcatagtccattttcaattctgtctttcagtttcttgttacacgggtaggaattgagttattaggtgttcatgggggagtgtcaaaagatctcctttccttctgaagagattccagcagtaggagggtttatgatttcaattgcaggaaatttgacataaaatgtataaaagtaaatgtggaaaacattttgggatttcctgtgacctcacagtaacttgcaaatcaaggtaatgtgagctccgtgacagtacattgttttaccgcagtcccaggaaccctttccagtggttttcatgtatttgttgcccctaagtactgcctgagtacct

SEQ ID NO: 111290 - DNA, 1029 bp, Homo sapiens
ttccctctgttgatgtatagtttgaggacaataagtgctaatattttatgtagcctatttattatacctatgaggcttgtatcaagccctttatactgaacttaatcagacatgctggtattttgaagtatacttgagccaatgttttggatgaggtttttaatatgtttttatgttcatcttggagtgttagcttttactctgctcattttgagggaagtgattttattctctcggtttggagaaagaggatcatggtgcatttcctatacacataaaagtcattaaatagctactttagaaaagagatccctgtgattcttaagctggtgctgctctgtcttggagccgactttgccttgagatcctcgggaagacaccaaccattcagcgtgcctgcttcaatactacggtaatcaaaaacacaacacatagtacacccaaggaattgtcagtcctttataagtacaggccatacctacgtctatcaattaatggttgccaacagaagagagtgctgcctgctgctgcccactgatgatctcctctccataggtagccagagtgatccctgcagaacatgaatcaggccaggtgcttccctcctcagaattccataaagatttagcatacttagaacaaaatcctccacctccaaattgttccccattcttcacagatattcgaattggctctctcccctccgatgcctcaggtctgtgctcaagaagccttccccgatcatcctgtccaaaagagcagccaccacctgcccccactgctcctaggctctattcccttgtcagcctgtatgtcttcatggtacttgtcaatcaggttttgatatgtttgtttcttttgtatgatctttctcaaaactcttttaaaattgaagcttcagatgggcaggtaattagtagtttcgttgcattcacagtgcttagaacagtgcgtagcttgtagtaggcactcagcaaattgtgaatgaattaccaagagcttgtggcataagcgaggtgagtattacaa

SEQ ID NO: 111291 - DNA, 1048 bp, Homo sapiens
gttttgttttgtttttgagaccgagtctcgctgtgtcacccaggctggagtgcagtggcacgatctcggctcaccgcaacctccgccttctgggttcaagcgattctcctgactcagcctcccgagtagctgggatcacaggcattcaccaccacacccagctaatttttgtatttttagtagagatggggtttcaccatgttggccaggctggtcttgaactcctgacctcaactgatccacccagctcggcctcccaaagtgttgggattacaggcatgagccactgcgcccagccaagacatttctttaagcatctgcaaaggcagaaatttcaaaatactgatttgaaaggggaatattttacttctctaactccacagcaatgcccaggaaatgtcccacagacttctaattaatgataaacccttatacctagtgatacttttgcatctcttttatatcgtttagtttgttttaattttttaaagtctgtctgttaaatctggaaacatctagaatgtgagctaagcactagagaatctcatactgtggcccatctttggctcccagtttctaattaaactctttcgaaatgcactgaaacagttctggaaggattgggtttatgcgatattatttatatcctccatggcacatcaactccaaatctctggaaatactttcaggcaacctaacatattatatttttgtataggtttggtctaagtttcctcttgtgggagaaaaattttgaagacatgtttcattgagatagctcaggatttcaccacaatttcatctaaatctagagtgggtgggaggggccatcattttttaagccattaactgtgtgacttaaacagattttttagaggtatcaaaattgactgtcttgagtctctcgtgatatacccttaaccttgatctctccttctggcatctcttttatgtgaggagttgtgggatctgtccccagaggtagagctacatctcaaatccattttttctatttttcatcctcctttctgtactgccaggctttcct

SEQ ID NO: 111292 - DNA, 1030 bp, Homo sapiens
atttttgccctgcagtaagtgcaacaaagcaagagagggtaggaaggtagaggatgtactgattctcccaggaagggagatggtgatgggatcagcggatccaagagacagccacctgcaccttccctaggtgtctagagaagggttctgttattctattttctagaaacaatcgttggcctgtcttttgctcttcatgttggttatcatgaagtgtattacaaatccatttgtcagcttcaggacatcgagaatccttaccaccatctttttccagatgtctttgtagccttaacaggccagatgtacttgttgcatatccctcctatggcaagcaagagcatttcatgtttaacttcctacaaacctggaaaacaactggttgccctcagtcattataaaatcatctttagatattttcatagtacatatcattgttttaacatctttacatattctctggagaaattaattttaatatactctgtgtttggatacaggacactcctgcaaactgttgaagaagaacatgggaatgattgttataaatgaaggctctcttgatgtaagtaaaattatgtatttttaaaactcctttaataatatattcatgctatagtattttatattcagatagctatggaaatattttatctttctgtggttcaaggtaccttatcactgttgttctgttttaacataatgtactctgttttgagtcacattgatgtaaattgattcaagctttacatctgtgacagctaaaagaaattgcaaaatgatttgcgtaatattgtgagacagaaaagttgttttacaaaagcattatgtcaagaggttgctgagtgactgcaacttgctcatatccaagtattctgtatgttaaacattttacatctgctttaacttccagtattcatatatattttacctcttctaaaaaaatgtgaaagctattgaacaacacaaaacaaccattcctagtaggacggactttctttaatgtcctaacatctggaatgaaatgtaa

SEQ ID NO: 111293 - DNA, 1020 bp, Homo sapiens
caggctggtcttgagctcctgaccttaagtgatccgccagccttggcctcccaaagtgctgggattacaggcgtgagccaccgtgcccaggctgtttttaactgactttggattttactccccttctatgcaaatttattttagaatctgttccttaccttaggggttgggttagacagtttcagggagcctcagtgtaatgcctaaagactgcatgaaagtcaaggatatttcagaaaactcaatgggatagttggaatttacaccaaagtccatgaattatcatttagtctctgattttaaaacatatacacacttcaattttttgtttttaaagaatatgaacggatttttaaaacatttctaccactaatttttttcagaatcttcagctacttggagcaacagccattgaggataaattacaagatcaagtgcctgaaaccatagaaacgctaatgaaagcagacatcaaaatctggatccttacaggggacaagcaagaaactgccattaacatcggtaattcacctagttcacattttacatgttggtgctttttaataagttaatgtagttcagaagatggatttgagacatttcaagatctaaaagatttgatatgtcaagattggaatattccaatcttttttcaccattgcatctctgcctcccatccataagtggcacatgtggataacatttctgcagttgtctggagattgggcttatggaagatttatgtattgatacttgattatgtgaccaaaggttattttaagataataggaaagaagaaggttgctaatttgcattcatactatgttaatccccatgttttggaaagagtttataatagctcgggcttccataagagcgtaccacacactgggtggcttaggcaacagaaatttattttcacacagttctagaagctggaagttcaagatcggctgtcctcacgtggctcctcttctgtgtactactccttatgtctcttcctcctaaaacatcagtcct

SEQ ID NO: 111294 - DNA, 1100 bp, Homo sapiens
ctttctgagctcatttttccccttagagtagagacagaaaatatacaaaatatttgtttatatgtttctaatgaatgtgttcgtatcttggctcccacattatctagttaccccagtgttttgggaaacatattgcaaaaaaatatttttgcaggaaattttgagggcttgtattaataagctgtccccatgatcactaaaaaaaaaaaccttatgccttgggtaaaatgcttaaaatttgaacacagctatatcctgatcttcactgggatgtgagccagaatgatttaactgcaaatgccctaaaagtagctgaagatttggaagaatcattgtgtaaacatttaaattcaacagttgtggtgctggcatcactgatgctgaattgttcttcctttccttgcttgaacttcttgatgataattgttcatcaggttatggtagatttcaaatctgcttcccattaaaggaaataaaataatgctatcttcttgaaagaaatttaccttcctgtattatatattatacactaagaagtcatgcatcaagtgtgtctaataaccatccatattatttggaatatattgaaaagaaaatggtctagattgcagcagtatttttgtaatttctggattttggtcttgtcattagctcacttagcaaacatactaaatgctgacattcaatgctgtggagtcattaagatgagcaagacgtggtccctaattttgagcaaacctaccatactcatgcatttacacttctcttaatgtacatgaagatgagcaaaattctgtaggagaacagcagaggggaaattttattttaagaaataaaggaaagcttaaaagaaacaataacttttttttttttttttttttttttgagactgtctcgctctgttgcccaggctggagtgcagtggcttgatctcggcttaccgcaagctccgcttcctgggttcatgccattctcctgcctcagcctcccgagtagctgggactacaggtgcctgccaccatgcccggctaattttttgtatttttagtagagacgaggtttcaccgtgttagccaggatggtctcgatctcgtgatcca

SEQ ID NO: 111295 - DNA, 1060 bp, Homo sapiens
tctggtctttcttccttattttataattaaaccattgtttgaaatatgaaggcgtgccttcgtggaatacataattttttgaaaatgtttaatatttatttgcttcaatagaaaaatacaattatgtctttagtactgcatagattacctactaataatttctgtgtttctgaaagtaaatcatttatcttgagaattacagaaaacagcgtaagctataatacctgcctagattcatcactgattaaagcagtatttccctggtgataagatttttatttttctcttattatgatgcgtggattgggaaacttttttttttaatggaaacttatccaatgcttttatctgttcaagtttttctaaaataggttatgggttagaggatcatttctgagcttaagagtaaactcagaacactgtaactctgctgtcaagccttttttgatcagatagcaatgttgtgttttatgtgcattttgtagtttgtgattgatgtatgtcatccactagattgaagtttcacgaaagcagggactgtgtttatcatatttatcactgtgtctccagcgcttgactgactagcctatgttaaccactcaataaatatttgatgaataaatgaattattcatttaaataattaattcagaagttggagcttaataagtacttgcttaatgaaagcctgccccctattaacaaatctagttcatgctttccatgcattgaaggcactggtatcaaatgtgctatcactaaggattaatttaggggtatgttagaaaagaagccaataattttacagaaggcattctttagaagtttagattcgttcatttataaaacctgtcttcaaagttacttgatatataaatgtgagaaaatcatgggttggaaagattcagcaacaaatatctgagcaccgctgcgtggcaggttctgttctaggctctagggctcagcagggagaggatagaagaatttctgccttttgtttcagtggtgggagataggtagtgaacttgtaaactaaaacaatgtcattccagagaggcttt

SEQ ID NO: 111296 - DNA, 1031 bp, Homo sapiens
cacagggatctttgtgaccaagctgtttttctgaagtgtttccattaactgtgatcataggaggactgtaggatttttaatatagagagccagggttatatcacttctttcttgatctcagattctattctttgttaaaatcagctgggattagggttcagaagttgtgatttactgccattaaaaccactctagtgaggcaagtttcagcgtgtcagaccacagattcttccagaatgttaccctggctttaaattgagcaaatacagtcctagggttcatccattgtcttcttccttacctgctttaactgagacatgctgtttatgcaatctattttttatgtgattggaatctatttttacgtagaccataatattggacttagcatgtcattattggacttagcatgtcagacagtgaatctttaaactgtgagggtcgttttcacatcttttattttttaagaacagaattttccaagcaaacattgcctgaatcataatatatataattgacgaaagcaggactgctttggctggagtaagagtagagaggagatccaaactggctttcccctcagcctccaccttgccctcgtgggtgctccaggcagggcttgttgtgactctgaggatccactaagcacagtttgaaaaccatgtattacatttgtatgtggacttttagaaaacaaattcctcaaaagatcagtacatcattgtgcccgtatgcaagatgtttctgaacatatttgaattgatatgtcattgccacattaatggtagtattatattcacaacattcaaaatgtaaaagatttgtaaagtttttcctaaaataataatttagtacaaaataagaggaaatgttataataggattaaggttatacttttaaatgctgctctctgcctcttgttcctccaatgtttgttcaaactggtaattcagtttttaaaactaagttgaatccttattcctttgggtagtgtaactcctagcataagctgaaaaaaatatccaaataga

SEQ ID NO: 111297 - DNA, 1103 bp, Homo sapiens
acattgtcactcacgctgtaggagtgttactgcctttggtatctaggtgagaggagggtgcatcaaagagctgattttcagagctgagtcttaaactgcttgcaaggcagacagtgggcagtcgttgggaaaagcagaatggagaaaaagttaccagcatgtgcaaagacccccctatgtgggaagtgaatggcagggaatgagagtgaaggcacctgatgaaacatgtataagccgtgctttggggcttaaattttgtcctggggaaaaattggaagattcgaagcaaagaactgcttgataagattcagattttagaaacgccacactatgcatggaagatggattaaaagggttgggaattagaagcagggtaccaattttaaagaccaggggaacattaatctacattttatactaagtttttgtcataatttaattggacttcatcatattgtttgtatggaatcacttttttcaaaatgggactttgtgaaataaaaacagaaacctcagacttctgaagaaaatctttggtgtgttggggtgatgtatgctatctttttcagggttaagaactttatgttttgctgtggctgagatttcagagagcgactttcaggagtggcgagcagtctatcagcgagcatctacatctgtgcagaacaggctactcaaactcgaagagagttatgagttgattgaaaaggtacgtggatgattctgttgatcatacagagggtttggtttccagatagttttgatctttattcaaggaaccaatggaataaaaatcaaaatatcttgacataccattcactattgaataccctctcatcatctaagcattaacaagtattaatatgcattaaaatattgctgagaagcctttggggttagacattactttgtatagatcttcactcttttcacaattttggatcaaggtttggccagtctggcaatctccttgccaatgtatttcagtttctggatctctgaggatatggaacatgcccctacacacacgcacacattacatacatgacatgtgtgctttgagttaataactataatatgcaatgcaatataaaatagtactg

SEQ ID NO: 111298 - DNA, 1550 bp, Homo sapiens
tgaccattcacaggacacttcacagaattaaggccatgaggaagtaatgctgctgctcaaggaaataagtgtccatcatttttcttgaactttcttctgcataagacaaacttgtacattgcttaggaaaggcatttctctttctgtgccaacttttgttgctgtcttgattaggagtgaccatatgccagtggttaataacaaaaataatgcagtctgtctgacttattatttaaagctttttttaacttagatactctgaaaagcccaaagaagatgaatacattgaataaacagaatggagtattttcaaagtgcactcctcgtctctttcttttcatgtcagagtgattgcttttcccaagcttatttgtattatatctgtagactgtcattaagtagtctattaattgccatttagatacgttttttaaaccacacttagaaagcactatgctaggtgatgagtgccatgaagaaaaaaataaagcagggttgggagtttctgttctttcaggactcaatgatgaaggtgggtttaagaatgaacatgagaaaagtgaatatgatgctgttaaatagtccctatgaaagacattagtggtttagactaggatgatggtagtgaaaataaaaggaagttaatagaatccgtgtaccttgtagaggaatatctgagagactttgtgagggattggcagtagaaggcgaaacgaggaaggggtgagggtctctggcatgaacaactgggtagatagaggtaccatttacacagatggcagaagtgggaataggaatagatgtggaggttgaaatgtttgaagtcttaggttttagatgactgtgagacatacaagcagagctatcaggcaagcagttgaatataagggcctgaaacaaaagagaaatctatggctgaaatagcaatttggcagtcagtggttggtaagtggtatttgaagtcataaaactgaatgggatctcctgaagagaagatataaaatgagggggaaatggaaggctgaagattaagccatgagggtaagggttgattagaaaaagaggaatcagcaaaagagacaaccttgttgttaaagatgtagaggacagagagagggtcatagcacagagccaggagaagaggattcaaagagagagtggtcatctgtgtcggagactgctgcaaggttaggtaagaagtttgagaagtatttgttgaatgtagctattcattgtaatggtgaggagagaagaaaaaggaaaagactgggaatgaaggggatagatgagtgatggtttagagaaggtgaaatgtgaaagagttgaaaagggatgtggcttaatggaggagtggttgcatcgggtgagtttttttgttttttttttttttattatactttaagttttagggtacaggtgcacaacgtgcaggtttgttacatatgtatacatgagccatgttggtgtgctgcacccattaactcgtcatttagctttgggtatatctcctaatgctatccctcccccctccccccaccccacaacagtcc

SEQ ID NO: 111299 - DNA, 1056 bp, Homo sapiens
tataagcttagatagtaatgatttttaaaaataacaatagggaaggctttcactaccgttacagtaaagtgagttgtttgttaagagggagtctcactctatcacccaggctggaatgcagtggcacaatctcagctcactgcaacctccacctcccaggttcaagtgattctcctgcctcagcctcccgagtagctgggactacaggcatgcaccaccacacctggctaatgtttgtatttttagcagagatggggttttactatgttggccaggctagtcttaaactcctgacctcaggttatccgcccgcctcagcctcccaaagtgctgggattacaggtgtcagccaccatgcccagcctcaagctttattttaaatatatacttggattctccatctataaaataagtaattacctataggcctgcaaaaatgaaagaacaaatgtttcctgagctgctactgtgtccaaggttacgtggagtgatcaaagatgtgggctttggatactaagcaaccaagttcagattttcattctactggtactgttgaacaagttactcaactctttgcctgaatgtcctcatctggaagaatgtagataataatagtagttgcatcatcaggaggttttgaagattagatgagctctgtttgtgtagtgctttggatagtgtctgcacatagtcagcccacactgagtgttagttctggtgctctcacttaatcctcatgacatatttgacatggccattttaaagttggtgaaattcaggcaaagaagcagtttgccccaaattataaaaacgagtagatgatgtgagagttgaaacctacatcagcctggttataaaacagtactggttacattacatcctatggactctaagtaactttaaagaatatctgctttttagatcacaagatatccttgaaatttcagtcattttaccttgatatttctctttttcatttaatatttttcaacctagaatttctttcagtaaatttcttgtggtgttaggcaagagcagattaagcaggtaaaattt

SEQ ID NO: 111300 - DNA, 1324 bp, Homo sapiens
tgaataatatatttgttagtgcatgatgaacaattctcatttttaataaatcagtttttaaaaacactgtctcaaggagattttgctctcaaggtaaagcactccaagagcttcgagatgtcccttggtatatagtcaagctagtatgcaacatattggctattttcaagttataaacgtagttttagaattgttcatacctttcagccaggaagggaggaaaagttcatcaacgaagctatgtgagtctagtcaataggaatgttagatttataattcatactatattcacatatgtgtatatttgtaatccattaacatattctaggtttttcttttttgtattgttgccatattccaacttatgctttacaaatagcatctagtccagaattattcttatttcttaccagttcagatgttgcatgaagttaattgcgcaagctgttacaaattctacaattgcctgttgcattgagaaatgctgatagctgtttcagtgctctgtaaatgttaagtagtggtagtggcactttctagtggaaattcagaccatactaaggcatatgtctatatagttttctagtatggtgatagtctttaatattcatatgtgaaaagattcatttgtaaaatactttttaaaaagctgaatatattccttgataaatgggcagaaaatagttccttagtaatattcattgtgcccctgcaatgttaataaaaagcatgaggggtttctctgtaaaagagtggcataaagactttcaaaatattaatgagaaattttaaacttttttaggttaaatacatattttctgacaaaactggtactctgacatgcaatgtaatgcagtttaagaagtgcaccatagcgggagttgcttatgggtgagttttttcctttaattaggatatgaaatacatgcttaattagtgctaacagtttggtacatttgggagttcttattaggggagggtatggggttgtttggttttttttagtctgaaaagcagctgttataattttaggacacatgtatatttcgcgtttctagtttagcattgttttcatttgggatgacatgaggtgggtgctctgcccaatggtattttcagtgtttagtgttgctgaaagtctctctcttgccctggtaataaggaacaaatatatttccttttacactactataaactggagtatagcttggatctggtaaggacagataatcaggccttgagcagttttcaagttaaaatagtgacagttaccccttttgatactttttttttcttctatcatctctcctttttgcagtcatag

SEQ ID NO: 111301 - DNA, 1008 bp, Homo sapiens
tttaaatgttgccttcctatgttcaaatttccaggtgcctgtttgcgggagcatgggctgccttgtctgcctgtcttcctgaacggaaacactaaatgtttctagactaccctgtttgcttacatagccaagtaatgcattattcatcttacctgccacaatgcaaaagctatttttgcaaagggaatgtaatttcgttctcttctttcttatagtttacttcctagaaaaaggcctgggtggtgtagtggccttgaaaaaaaggtggttaaccattggcaccttattacatttgtcatgggtttcacataattttcacgtatccacccacatctagatactgagttgtgactttgtcatcctcaacagaatactaagtatagattgctaaatcattggtgtacattttttattactcatcttgtttctttttacagaattcaacaagtccaccacttaagctctcaaatgtggaacggattacaaatgtacaaattttgattttattttgtatcttaattgccatgtctcttgtctgttctgtgggctcagccatttggaatcgaaggcattctggaaaagactggtatctcaatctaaactgtaagcaataaagtgcttactgcacttttttagattaagacatgtatttgtttcacaattgatcttgatttactttatttcgtattgtttctaaaaagaccttgttgccaagatagctggacatttgatctttatttttcagtgagatttctagcaagtgtaagtaaaatttgggaatcctaaaatttcagaatccttaaaaacataatgagcactctatagtggtataaaatgttcactaagtatagtcatttattatatatatcaacgaaaactattccttaaaaatatttttaacataggtggttaactatatggtaaagaaagtagattgaccatgtgtggatataacaaaacatatatatttaaatatatattgtatgtatttataaatatataaaatat

SEQ ID NO: 111302 - DNA, 1054 bp, Homo sapiens
agggtatagacagaaaactgaagagacccaagagctatcctgagaccctccaacgttatgttgggaaaggcaaaggcactagtgaaagagatggagaccaagtttataggatggtaaccaagagagagtgaagaaactgtaccaaagcagggggaccaaaactgagtctgacattgctgatggtcaagtacaatgagactgaccactaacatatttacgtttggcaagtggagatcattgaaattgattagaacaggtgcctgacgatagtgagtttgagaaaatggaagaagagttgaaaatagcaagtatagacttctttttcaaagagttttgttgcaaagagagcaaagaaatgaggcagaaactggcagaaaaggtgaagtctttcctgcttcccttctcccctcttttctcctcctccattcccttctttccctgcttcccctactttatggtataccttatctcccaggcattgtagtggccaactaaatgttggctaaatatactagttgaactcagcagcctgagagaatgtttttggtgttttcattattttgtaattgcattattagagtgtttgaattctaaaggacatttgaagtataccctgaactgtcatcctcattcagatcctccaaaagctttcctgtaatccgtgaagtaattatatgttgttctaaaattttcacagagtgatcgttccatgaacatctggttaaagactaatgatagatttggccatttataccagtattgtttctatagtctgacattcctaactggccagcttccatgtcttaacagttttctgtcaaattgttgctgagcaaatctatgctgtgaaggagaaactttgtatgatggtgccaagattcaaggtacaaagagaatttatataatatgctgtatttcatgtgaaagatagattttcaagacctttgtatctgtggcacttttggggtttacagtgattacccaaagctcttggagaccctttggaatgagtatactttgttgcttttaaggatgagggtcatagtctaatgcc

SEQ ID NO: 111303 - DNA, 2292 bp, Homo sapiens
ccctatcacaaccctaaaaaataattttcattattattttcttccttttttggtacaagtggacatacagtagatggcatgaggttgagaaatttgagaaagaaaaatctagactataatgtagttctctataaaatatgctttaatttgataagcttatgagtaaacttttaaaaattaagttttcacactaaaactttaaattgggctaaaaagcaaataaataaccctcaaatattaaatgttttcttatgccttcagacctgatcaaaataagttttgaaaaaaattggcattagatgtttttattaacatgtattattttctataataatttcgaactttctgtctcttttgtccatttgtttgttttttttcctctgttcatttttttttttggccattttaattattttatactgggacgtgtaggtggcagtaggggagatagtgaaagtgaccaatggggaacatctcccagcagatctcatcagtctgtcctcaaggttagaaccactgagtcgtataggatgcgtgtatgtgggtcctcaccgtaaaccggagaacagttgcacccaaatatggttgagttctgtgtctcttcctttaaaacacaaactttttatactgcttggtgatggacatttcacagatgttttaaagggatttttgaatactatgttgactgatgcttgtccttcagctgggcaaattgaactcctgttgttatcaataggagtctaagaggcatgacagtaaaggtagattttaatttcctgtgcaccattaatatatattcgtatttaataacatgcctaagtactaaggcttaatttattatctctccgggatattattttgaataatgttaagcttttcatgaaacagtcattgaaaattgattagattataaacatgtcttattcttgtattttaaatttttctgtaagttctgtaaaatccttccagcgattgtgactataatttgggctcatagggtttatagaggaccccctgcacaaagctggatgttgcacattttgtaccgcatgctttgggatcgacttttatcccacttgtatctagtgacaaagtgcacgttactgtgatcaatttcagctgtctactagtgactgtattgtgatatgcatcttgtttcatttttcacttactaatcaaaaagcctgctttgcctctcttgactagtttgtgttttagatgtcatcataatttgctgaaatatttatgatctagcatgattccttatctgagacttcttgctgccttttcacagcactattaagaattgcttcagtaactgctgtcctaagtgattgttgagaatgttctgaatttcgatgcttattttattaccccaacttcaaatagaacttagccatttgaacttcctaacttcctagccatttaaagacctagataagttactttatgcaaaaaaaaaaagtagaattagaatattattctaattgtcagaatatggaatcaacattgtcatttagtattttctttgtcatcgtgcttctatattatcaggtgtgttttataaattcataaactatgtttcaaatgtatacataagtaaattacaaatttcgagcaatttccagagccaaattgctattgtgacagtgattttaaaaataaaattttgaataagttatagagtgaaaatataaatattgaaggacttaattttggggaaaagtagcagcttttacgaaagaaagctcatagggtaaattgaagaacctgcagagctactttaaaatgaatcagtaaaatatttttgattaatgtctatgtgtttaagcaattttcacaaatcttcgggccacaaaattaagctacatgcccatttctgaaactaggaatagtctgttttgcacatgtacaagttggaagttgattagaaaattccaggtgtttgtaatttgtaaatttttttctttctagctttgagtacacatgcttataagagattacatttataatacttatgtgatattagtaaattaagcctattatataaccaagcattaattagattagaatgcttttctttagaattaaggatcagattatacagttgggctacaaacttagatgtctgtagttgctgggcaagtcaaatcagcatgtgaaagggaaagataagacagtctgggctgtggtggtgtgataaaactggagaacatggaccccttaggccagccgccacacaccagattttactaagacacactggtggggaacccatgaagtgcatcttct

SEQ ID NO: 111304 - DNA, 1024 bp, Homo sapiens
taatattcaacctaataaaatttgcaaatttaaaccatattgaagtttcatttgctacctattcaataaataaaaacaaacatttcagatttatttttatgaaatattttatttacatactattgtgaacgagcagtttggctatttatattgagaactgtgaaaacgggattctggaaatttatcccaagaaaagaaaaagttggagaatatctccacgtgtataaaaatgtttattgtagcattatttacttataatagcaaaaaactagaacatatggaaatgcaacaatagggacagttttataaattatggcattttatactcatattttgtgacaagtaaaatctgtaatgtcacatggtgtagcaacacagaagaaattatactattcattcgacaagtgtttattgagtgcatatgccaagcagtgagcttaaagcagcaagcaagacaagtaagggttcctgtatcataagatataatcataggtgaaaaaaaatagtactatgtacactgaaatactggctttgtaaatcgtttattgaacaagcgaacaggcacaaaagcagccttacttgttgggataacaagattttgaggcaagtcttttctttgccttatatgatatttagtccaattaaaaataaaatcaataaaccaaaaccaagagtgtcgtctacatgccaaggtaatatgatagaccttagtgtaaatgggctttacttcagggctctttctctgcctttctaaatgtgtggctactgtggttgctctttaatgatcctcaaaggacctacaaatttgcctagcatgcatctaatcattcacagctgggcagacttcagctctcagatattagtggtttatctctccagttactgccctgaaaccttttccctgttgcaaaaggttaacttgcagatacatagttttaaaagaaagtatggtaatcacaaagccctacacaaggaactacattgtgactcctgaacggtaagctgctggcttcattgctcttgc

SEQ ID NO: 111305 - DNA, 1037 bp, Homo sapiens
ggtgtatctcacaggacagtattttgctaggacaatcgaagtgtaaccaacagtttatttgcactccagtacttcccagctagttgaagtccatgcccttgattctaccttgtcatggtcatcttgtatttctgcaggggatatcttgtaccccccaattaaaaattaattaaatttctgttgattttcaatcagtggctagaatagagactgacatctcctctttcatatagttgaaaatttacccctattttttctttggtttttgacatgagagcaacaaatgggaaaataccttggttgtgttttatttatttctgtgataggaatctctttttcagaagaacaaaataaaaatgctaaaagcaatttcaaaataagtttcttttctactcttttctggcacctatggaattaaacattttagaaagaagacaggtaggatataatcaagtatgataagatgaattttattacaaatattattttacctagggttgtcagtgtagttaacataaatatgcatgctaataaataacctaggctgcttgctcagaaaataaacagaaagtcaggagataataatgtactacttcactctaaacctttaaaatgtcttattttcctaataaacaatcattatttcaagattgtgctaacctacctggattattgtaattcttacttttcctatttttgacagacaaatcaccagccaggattacccataataatagcattttcagtcatctcacaggtcaatggcacacctaacctaggcatcccattttgagataaagaaggacagaatttaaagtgttgccaaaagtcatccagcccaaaagagctgaagttatttaataattagaattatagaagtaattagaatcactaaaagttggttcagtgatgaaatcatgataaatattcaaaaattaacatcattcttaagttggcagtatcaagtttgaaaataaagtgaagaagaggtctcattcccagtggcctatgggaggcctacaagtaaatttaatgta

SEQ ID NO: 111306 - DNA, 1067 bp, Homo sapiens
gttgatagacatgtgggttgtttctaccctttggctattatgaataatgtttcagtgaacattcatatacaagttttgtgtgaacatatgttttccgtttgcttgggtatacacctagtagtagaatttctgggtctgtggtaactgtgcttaactttttgagaaactgccaaagtattttcctatacaactatttattaaatgtcatgtttatgttatttttaacatgagccctactaggtagtggagttgtatcttcagtaaatctataactgttgcaatggttttatatgatcctatgacagataagaatattagtggatccagcattccacccagttagtacttactgagcaccagtgtgtgctgtgtgataacactggaatggtaacagtgagtataatagggaaggtttctcttgtcatggatcttataatctgggggaagagacagcccttaaataatcctgtttaattaagtatacagtaaaactgtgatgctgtgataagtgttctaaaggaaaagtgcacggagctcatttagatttgggggtgaggaggaaggactgggtgtcaacacaatgtcccctgagaaagtgctgttaaagctgagatctacaaggtgtgtgtacaagttaactaggtgaggatggagggaaagagaattctaggcatggaaacatgtgcaaaggatttgagacagcagagagcatggtgcgctcactacagagggcataaggagggtgtgttgggagtgacaagaagtgatgacaggaaagaggcaagagctgcttcataaaaggccttgtagatgttttgatttattttttgagcctagggaagccaactgaagagttctgagcaaggggtgacccaagtttgtgtgtatggactgatacataataatatgtaattataacatttatgtaaaatcatcatagataatccttatagctacactgtagaaactgaatttgaaagagattaagaatgaatgcaggaaactagcctgaggctaatacagacatccagttgggagggggtggttccttgaactaggggtgctga

SEQ ID NO: 111307 - DNA, 1054 bp, Homo sapiens
tcaacaaccctaaatgctcatcacaggctgggcattgtttcttgctttctctaaacttaggtttgtgccgggtcagaggaggttgatgatttaaaaatacctagattgctaattcagtcaccagcataatacatgtggtggtgtttattttcattgttctaaggactgggtgtttaagaaccagttctaaaagataacaatgaattataggattgactagtttccttggccagtgttcaagtcttgatttgtatggaaacttttttttatgttgtgagctgatttttaactttatcagagtatactcatctatattccaagaagacactagcctcaagtttgtgtatttcctttcttcatttctgtattctggttttgtatttcaagaacacagtaaatgggggatggggtagaagtacgtcctcatttctagggagcctaccagcactgcagatgcagcaggcccatgcagcaagtgttgaacagcaaggttctgtaatattttcaaagaagcgttactctatttagttaggattccaacccagtgtagggatgtaaaggtaatttatactttcattaatccagaccactacagccttcagaataaatatcaaatactcatcagactgacaaaattcaaggaatggataagtttgtgcttgtctcagtttatagtcagtggaaatttatacattgctggtaaaagtatggagtgctgtagattcttaggtatctggttgtatctgataaaattacaaactcaaatgccccggagtcagcaatgttctctggggcattctctcttacagggtacaatcatgtgaatatatttcattgctgtggtagtagaaaaaaatagaagtcagaatttgcaccagggggagaatagttgaatgctttatgatgcagctgttgtggaaaattgagttgtctcacacagggcaaggacagctctgtgcctatctctaggacacctggaagtgtgatgctgaacactgcctaagacaaggatgagacggactagctggtgatttataatgtgctgtttaaggtt

SEQ ID NO: 111308 - DNA, 1022 bp, Homo sapiens
acttatattgatgtttaataagccattggttctcaaatttggcatcagaatcccctggagcatttgttaaaacacagattgctgggactcacacctagagtttctgtaggcctggagtggggccccagagtttcagttttaacctctcagtgacactgctggtgagggggtcgtgcttttaggacaactcatttaaaggttgtataaatgagttgatagaagtagtatcaaccaatttgacatcaatatatgtattattatgtgtattacatgattgaaagaggaatccaggaagtttccattgtcttttgtgtcagtggacactaatggttcagccaagcccctggtggtttaatgtaacctttataggcaagcttatacaagagactcttcctgtgccatgtcagtttgtgccacactgaggcttttgccttaaagttgtctttggaagtaagagtctatatagtgaataaaataatattttaatgttggcatattggctttccttctttgccccagtcaaagccatagtctcagctatactacagtccttgatgacctaaaattcctcttaaatgctgactcagaggaattggagcacactacattttctgtggttttactattcctctatgacaacagtagtgtcattgtctttttggatgacttgcctcttgttacccacttaagaaatgataggctgggtgcggtggctgacgcctgtaatcccagcactttgggaggccaaggcaggcagatcacaaggtcaggagttcaagaccagcctgaccaacatggcgaaaccccatctctactaaaaatacaaaaattagccaggtgtggtggcacgcacctgtaatcccagctactcaggaggctgaggcaggagaattgcttgaacctgagaggtggaggttacagtgagccgagatcgtgccactgcactccaacctgggtgacaaagcgagactctgtctccaaaaaaaaaaaaatgatattattgcccggggagggcaccccgg

SEQ ID NO: 111309 - DNA, 1044 bp, Homo sapiens
tactgggaattgttctttcagttttaaaattcctaggtgtgctctaattcttcccatcaccactcctccatcaatgtatactttaacattgacatgaatgagaaatgataaaaaccttgagaaacataagctaaatcttttttggtatgagtgctctcttgttttagtaatcttattcacattttcacagttgttctttttgcttttaaactttagaaacgacataaagctgataatgcagtgaacaagaaacaaacgcaaggtaggaattttacatgcttttttctcatatttgtcaaacctacttgtagtatatacaaacacttcaattacatataattcaattgcaaatagtgtgcatctcaagtttttgttttggggtagattgatttttgctttgtggcatttgttaggatgacacttaaactcactttaaagtgatttatagtgataatacttttgaaagccaacattttaaatatatttaagtgcttcatagcaatagtctctcaaatacagtccataaagtctgcagttgttttgacagtgttaaatattataaatttattttgtttgtaatctacagatgttattctagaaaagatgtatagaaaataatcacatgtgatgtcacttgagtgaaaagcattttggaaacactgagttatacatgcagatgacagacactccagaaataaaacaaatacaacccggcctgcttctgtacagtgcatggcattttggcacagctctttttggatggggctcattttgatacagccaaaagcaaaatgatcttcaatacaagcaaattcgccatcatgctctaagattttttttttttaatgcccaggaatgtgagaaacagacatcttagctcatctctgaatgaatttgccccatctgagaatctcatctctgaagttctctgatgtggtgaggataagtgatgtctgccaacattatctggtatttaggaagactatttttatactgctgatatttctatggagtcctgtcaaaattccctgcttctttttcacc

SEQ ID NO: 111310 - DNA, 1122 bp, Homo sapiens
caggggcttgtcgcaatttagcgtgagttcaagaaatgttaagccattactttttttccttttttagacaataactgctgtggtgtgttttacacttgtttatttttaaatcaattccctcaaaggcacttaaagaaacatgtcatttaccatgtctcctaatgacaggtcctgatgacaaaatatattagtggttattaggatagagacaagactataaatttctgggaatttttggatgccttatattgaaatagaaaatttagcaaacatttagtgcacagaagggactttcctgaagggtcattcatgttacttccccatattagagtagcatacttaatagatacttacccatacccttgtgcctgtcccatcctctgtacataagcatgcatagcatttattattattgaactaagcatatagctcaaaagattagtgtcagatgtatgatggtcttttacatagacaatatattcaaaacttttgtaggtatcccttcaaagaagaatggccaaggagagtattttgacacttaagtagcatccaacaaggctgaaggggtagagaaatgtctgaactggaaatactgttgaggtgtaatagaccagcaaaggacagagttaaagggagaggtgaggtcaaatttaattgttgaatgaatgcatgaatctatctatcagtgtcagagctttagatatgggttggactttatcagtttccaaatgttgtcttgcctttggtgctcagtgactctctaaccttgagcaagtctccatatgacaagtgatgtctcctaatcttcatttttagaactcttttaaaaagtgaacccttttgtataatgaaaagctatcaattgttgaaggagataaccatgttttacatgatcaagggtatgtaatgtttgttataactcagatggacttggaggtaatgagctagcatcacagttgcatgaacaagagggtgatggagaagaaggtagggatgtggaaaaccgtttggctattgtgcaagttccttagagttgcaatccacagttgtcccagaacgtgctggactcagagcttgtttagggcagctgttaacatcagaagagatctgatccagcaagta

SEQ ID NO: 111311 - DNA, 1050 bp, Homo sapiens
gatgttggagctgagaagttctgccttttattatctgttaacaacattgtatcatctattctaggcagcaggctcatctcatcaattctttgtgtcccagatgaaagggggaaaaatcgagtggtctctaacgttttttacaacacctttcctccagtctcagatgtctgtgcatctgttaatattcactgttgaacatgtgaacctatctattttcaacctttcctgtgatctttttttaatcttgtgcttgttcaagtacttcctgtgaagcagcagtggtctctaaatacaactccttcaaccctccctgaccacctccccgccttgtcagggccttccacaattactcagcatgtgggtttggacagctgttggggcttctgcactttgtgggtcttgataataaattgaaatgtgccctcctgaaatccagaatacatatctgacatggcctggtattcccctttgacagtcaaaaactctttgatacagttattttttgaagagtatcattactactttaccacttttgcttggattagaatccagtccgtagtgtcagtctgccttgtttcctgtgcatttttagaggtgaacttaatgccactgcaagtcagtggtgctttaagctaattgagacttctaggagatgcttggtagatgtctggtggttgcaacccctcgtttctggtgcagtctgcttctgtgtcaatttttaaacatctatgttggcaaatatactatttaattcttctgtcagataaagttatctgtgggttattcccaaggagatgtcattaaattccttctgtctttcattgttctggttccttttccagttaagcatgaaatggcgttagtaaatgttttattatttccaagcaattcagcatgccgaagatgactattattttaggttaatatccaaggctggctgccaacaagattgactgtttactatgtgtgacgcccaactctaggcatactatagatttccttgtaatactgcttaaggatatcctttcttctgaatgtcaggagtactct

SEQ ID NO: 111312 - DNA, 1059 bp, Homo sapiens
cttgctcttggcaggacaagatgctggttcccaaccctagcttggactccagtgctcagcatttgtgagccgttttgatgccacgccaggcctaccaaggtttctgagtatcatttgctttcactttacccacagttgcttttggccagctcacctgaacccacatcgttgccccatgcaggagatctttggttctgagtgtaggtgttgcccatttccatttgtcctggatctgtcgctccaccattgtattgttattccagtggctgcgactagttggccctttccagttcccttctagtctgtctcactctacttttttttttttctctaacctaggccatgttctgtctctgaccaaagaaatgagatgggtctaagttttatccaatcctggtggctgctctacatgttaagctgggttcagtctaccatctatgccagaatggttgtgataaatattctcagatggacttaagtcaactttcctaactttattttcattgtcatgggtaaatgttagagaaatgacatggggaggaatgtctctgctatctttaatgaaaagtgtgtccaatgtggacagggcagtgggaggcttgtgaaatgtaaattgtttttatagccacatcgtgtgatgctcaaccctggcttcatagtgaattagatagggagcttctaaacaatacagattcccagacccatcccagaacgatggaatcagttggtctgttctatagggatagggaccaagcattaatattttatctcctaggtaattctcatgtgcagtggtattgaaaacactggtatacaaccttgaatttacttgctggcagagaggatgggaataaattgtatacaactatataggttgcgagccaagaaaccaagagtattagctagccaagtgatagacaagcaatttacccaaaatatttaccaaagaaaatcaatatttttggtaaattgtgtatcatccagttagctaataggactaattatactcctcttaatttcccctctcagaaatgatcaaggtcatacattaatactatt

SEQ ID NO: 111313 - DNA, 1026 bp, Homo sapiens
gtcagggccatagtggtgcttggtgagtgaatgaccctttcccctgagattagttgattccagtttattatagcttcagcatgtgcttgggactgtggtgaagacaaataatgactctgtggggctggcgttgtggctcattgcctgctctgcccacacttttctttcctaggaaatatttctttcctaaaaaatatagtcctacctttcctaaggaatattctcctttgagagaggccctgctgcctagagggccttgttctgaactgcagcctttttggcctcagctgattggactatggttggctcctgacccagggtcaaccaattcttatgtgactcagacacttgtaaccttgtggtttggctcaaaaagagtctctgtgttaatcatatctctcttgaaaacattaaagttagagatttagagtaaaagcagaagggagcagaggtgaataggctggtatgggagagaatgggtggccataataagtcatgggaatgctgctgatagaagaaagcagaaactatgagtgagtagagagatagcaaagaaaatggaatggatgggcagacacagatcctgagagagggtggcgagaccttggagcctgccctcccgaattttatagccctagttcccaagtagcattaaaataagctcttttcccccccttgaaatgacttgaatgggtttctgttcccttcatccagattggccagatgtatgactgtcatgcctgtaagttgtttacaaccaaactggggagaaaggacttaaagagggaataaatagtctaagaggggatgttgttaattaaatattgtgcatgctgtgggggacgcaggacctgtggaagattaggaatttagtacatacttattactgaacataaggcctgctgagtgaacatttcattgaggtgtgatttgagatgagccctcacacagtgcttctcaaactcgaaggttcataggaatcacctgaggatcttgttaaacgcagagtctgattcaggaggtctg

SEQ ID NO: 111314 - DNA, 1094 bp, Homo sapiens
tgtttatcctggaagagaccgcatcctacctcttccccggcggcagtccgactgtcgcgcccggcccctaggggacccttccccccgcgctgcccccagtgtactcgcagaccctttccaggctccagtaccctcgaatgggtgttctccgcgggagccccgaggcgtgctttgcaccgcagtgtgaccattaggtcccagtcactgagctcactcgccctgcccacctccctccccaccagttcgatttccactcagcagatccccagcccgccgcccctgcctccggcgcccaccgttttgcaaccccctatctgagctcccagcgaagcgagtttgcttttccccggctgcaggatcctttgatccgtagtcccttggctctcgaagcgcggggagccttcatcggggtcgggtgccgagtgggttccctgcattacagcttctgcaattctgcctcctgcagcggagtcccaccggctcgcgtctgaggtttcgtttttgtgtttcccttttgcccgaaaccctcacttcggccagctgagctgacttttcagccaggtggaagctgttttctttgctccacctggggccagctcttgaatggccatggttgtcaacactgagcaacagatgctccggggtagaagcaagtaagctttccgagggcccagactcttcatcgtctccgaggagccctcaacatcctgcctgccatgtggcaggcactctgtaaatattatttgattttgctcgcgtcaaagccaagactgtaaatatcccaaggtttgtttgtcctctcccataaacctgtacttgaatcctgcagagggtggaataacatgtttttcagaaatctatcttgccatcatcgctgattcccactcttcctccccacctccatcttttaatgtgagacaggtggtgaagtggttttagaaaaatatataagttaggagaattggatttcagggatggagacaggccattttttctccttaggggctccctgtaaaaatagggtccctgaaattttctgattgcagtatttaggaaatattaaatgaaactgctgtggggagaagacgaagcaa

SEQ ID NO: 111315 - DNA, 1050 bp, Homo sapiens
gtagggtcttgagagcagaaagcataactcatctgtccatactttccttgtatgcttctgctttcattaaaaccagttttggctgctagatttgccttggatgttgaatttttattaagttcacatcagagtactgggagaaataggtgcagaataaataaatcaaatcaaatgaataaagcattaggtgggctgtgcaatggggcagaagtgtctgtatgtttgcaggaaattcgatatgagatgaatggctttggagagcatgtgcacagctagggaagggttccaaatgagcaagccaagagcagttaagtcttacattcacagttcagttgcccataagactcaaatttgcatggtctttgaaacccagctgttgaaactctctttttcattttgaaaccaaaggcattgaattctactatgaatttcacacaatgaaataaacatctccattgatagtttattattctcttcactagaatttgtgaaagtgatgagatgaagtttacagtaaattggaagatgttgatgagggtagattcataattatcagtggctttctttactccagcagttgcttgtgttatatggttacagtcctactgaagtttcaagctaaaatttgtttttcaaaaggcagtaattttctgaacttgttttctacattaaaacaaaacatacttctaggatgtgatatgtcaagctgtgaaaaagcagtagcatgtatttcaccaacatccacaaccttcttttagatcatgaaaaatgtcactatctttcactggtgagttggcaagagtttgagaaatgtcagtaaggctgaaaaaacaaaaaactgactgtgttttttcacttacatttcattttcaatgtgttgattgacctccccgttcactgcttggggaaaaaagttatgaacctaattatatgttttggttttaattaccttttcccagtaactttatatagatattttattacaaattataaggcattctcacttatcaaaaatctagattttggctttttagtaacctgatttatctt

SEQ ID NO: 111316 - DNA, 1097 bp, Homo sapiens
taactgagcagattaggacaatttaccagttaaaagtcatttaaactttaagaatccatgaatccatactaatataaataagcaaataaataggtgcagataagagaacatatttgcttttggcataaagtcaaccaataaatgtaaaatgaaagatagaattagaaaatcacaatttggcacagtaatattcatttagcccaaacgtatctaatgctaaaatgagtagattaaattttgatgagcaatgggaatttacacagtctcaaagtacctccctacaaaatacttattaatcacaaaaggtcacatgggtaattttacagtggaaaagcatagcagatgccaccttaatcaagtgatcaaaattaacatcaccagtaatggacaaattaaaattgtttagtaactgataggatacaatgacaagaatgtaatatcacttctctcatattcttgccaaaaatatgtaactttaatcatggaaaaacattaagtaaatcccaattgaggaacattctaccaagtaattggttgtaattccaaaaaatattgagatcatgaaaggcaaggaaagactgaggaactatcactgattgaaggacattaaagagattgcaacatgcagtcatggtttgaatccttgggacaactgatgaaatttaaatgaggcctgtagattcaatgacgataatgtatcagcattcattttgatggtcatattgtggttttgtaagggaatgtccttgtttacaggaatcacacatcaaagtatttggggtaatgaagcatcatattattgactaattatttaatgattaagggaaaatgaaattatttgtgctattattataacttttatctaaattggatataatttaagaattgaaatcatcttaaaataaaataaataccacaaaaacccaaagttggaaagaacagaaatattcatcaaaaggtgaataaagaacaacttacagtgcattcatatagcataatactatttaataaataaatgcaacaaactactaatgcatgcaatcgcattgataaatctcacgggtactgtgcttaataaaataaggcagatacaaaaa

SEQ ID NO: 111317 - DNA, 1113 bp, Homo sapiens
atcatagcagcttttgagttattaatctagcagtgatgtgtaggaaggattgaattgaagagagagaggaagcaagaaacattaaagaattttggaatattttagtctaaattaggtatctgcaaacttttcttaagggccagataataaatatttcaggcttacagtccataatctgtattgcaacttctcaactctgcctttgtagtatgaaagtagtcataaaccatatgtaattaaataaacatgaccgtgttccaataaaactttataaaaatgggtggccagcctctgggcttaagtttgctcctgcagctctacatgtagcagtaacaagacttcaactgtggaaacaaagaagaaaggaatttgacacatgtttagaagtcaatcaaatataaattgccatgccagtgtagtactttccacattgaccctaataattgacataccttttactctgccactagactaggaactctgtgaagtaaaagtgtaactgtattccctttttattgaaaagatagtaaatattcaatgaaatatttctttaaccaattcgataagtttttactgattgaatatggagagtgcaaaagcatgaacaaagttcccaagcgtttcagagtgtctgttaagctttaatgagtggaaaatagtcatgctgttattagaaatgtttgtgactctgataaacttatttaacccttctacacctacacgtcccaaaggtatctcaaagttaccaggtataaaatgctatattagttttcccttccttctccaccccaaaatatgatcttccagtgttctctatcttaattgcctgtcatctatccagtcactagaaacagaaatcctgagccgctcttgtccccttacttggaggaataaggacaatacaatttagggggaaatccaagtcttcagacgtttttctggggcctaccttcaaattatatttttaaaaatccatctatttcactctactatcatttttcatctggattactgtaaaacatccctgcttccaatattgcccttcttgcattctctacataatgaagccagttacttttttggttagcactattcaatgattttctattgaat

SEQ ID NO: 111318 - DNA, 1036 bp, Homo sapiens
cacaaataaaaacagatttcttataccatagactaatgaagttgaaagattctcagacactgaaataggttaataggatttataattaaaacacaaacttttaatcacatttacaatttctctgcacattggtggtaactaattatgttttattcctctggtttactcacgaatctgatcattggttcttgtagtgaattaatgttaccaagactgctaactttgaaacatttcagagcataaacttttatagtaaaatagaaagcctatgatcttgaagtagtttctttttgttttccccctgaaagtgattaaccagcaatgccagtggtttaggccatatcaggagacaagcttagaagaaattagtttgctgaaaatgtgttaaaaatctgtatttttattttcatttttaatatgttgattgtttcataaatctctctgctcccatttttattgcagcactaaaatcactgaattcaacacttaattatacttagtgtttcttggcctagaaattatgtattaaagctgtttctatgttcaaaattagattatgcgtgaagtccccattgtacaagcagcatttatgctatcaattggtttcactggattacatatatcactggaatacatatcaatctatttatttcactggactacataagttttaagtgtatctctaaaatgtcacatatttcagagttttacatataaaccaaaaaggttatatttcttctcaattgaatctaatttaataataccaggtcccatgttttaaaacaatatacatttctttcttttttcagtttttctcttttaaggatctctccaaggacttaggtatttgaaaatgatatagatcctatgacgacattaccttcaaaaatttgatactgcgtaaggcaactgtgagcataaataattttagtattttacaactaaaatttagtattttagttcgaaaatactagaatagaatcttatttatggaatttaatggattctcttagaatcaaaaacacaaaaagctttt

SEQ ID NO: 111319 - DNA, 1065 bp, Homo sapiens
ctgactcaatgataggtgaaactatggaatgacagtttaaatcttaacccacaagctgaatttgtgttttattaatatggaaaaatattgtcaacaatatgttatttaatatttatttaatgccttgttttacagaaggccatatacatcactgtgtaaaacttgtaagacatgagagagtgtcatgatatgttgacttagaggactaattctatctcctacattcttaatgtcctttcttagggatcaacttaaaggaaaggagaggcttattcagtgtttatcggaaagtaaaaacctataaacctagttttatgagttaatgagaagagcataagtctaaataataagatctgtgaggtttgaagaaatgcaaaaagggccactttgaccaaaagtttgtcctctacctgtctgctactgtttctgaaattctgacagttggtaagactccgtaagagtcttcttttaggcttgtactgaagtttcatataggacttgaaatttggaccaaatctaatgtttggctttaacttatgctcaaatttaagaagactgatttgctgaatggctactcagtgtcatttctggaaaatctgaactcgtatggaatcacgtggattaactttgtctactcattataacagtgacactaacaatgacattggtattaatctgaatgttcatttattacagttgaccctttaaaaatataaggctgaggagtgccaatccccatgcagtcaaaaacttcgacccaactttttgactcccccaaaacttaactacaaatagcccactgttaactggaagtcttactgataacatgaacagttgattaacacatagtttttatgttatatgtattttatatatattatatatgttatatccttataataaattagcctagagaagagaaaatgtttctaagaaaatcataagaaagagaaaatattgactattaagtgaaagtagattatcataaagatcttcaccctcatcgttttcacattgagtaggctgcggaagaggaggaagagaaggggtttgtcttgctgtcct

SEQ ID NO: 111320 - DNA, 1112 bp, Homo sapiens
tctcttttccctatggagtaaagtcttgcactgtgtctgacagtactatttcttgtgtgaagtattgaaagatggtatgttaggtaggcttttaaaactgatgatttcttcagttagagacagtgctttctttttttgttcaacttgctctccatgctcattaaagcctcacactatgtctggcagcaagttgtcacttagcaaatatttattgatttaagtagggaagctgtgtgatgggtgagtatagacatcttatgactgggtttaggagtgttctcgagtaaaccagggctgcatttataccctatttcctttagttaataactgtgtgactttggctaagtcatttatttactctgtactttggtttcccttttgtaaaattatcagaataatagtacatatttcagagagttgccccaaggattaaatgatatgacgcatagaaagcacttggcatggtaccttttgcaaagtcaaggctcactaaagttaactattttacttgttatttatagacagttatggtgaaatagagaaggaggtaattgccttgaactgaatggagagttcagggaaggcattagagaaaaggtgacattgcaaattattgacagaaatgtgggcattcatgtaagagagcttgggagctttgctagttcatgcaaaaatggcatgttcggggaatagtttgatttggctggatatcaggggaagtgttggaagaaaaatctggaaatgtaggcaaaggaaatatgatgtagcacattcaatatcaggaaaaggattttatatcagaatgtgcattttcaaaaagcaactgtggcagcagactgcacatagaattggggaaactaaatgtgtttggatagttggtgggtattgaaaacattgaggctagggatgagtcagatgaacattagtggagatagggagtaagggacaaattctagtgctatataggtggtataatcaaatgaactttgggaggaaggaagtcagacaactggcagctggcctgtgattgattcatttcttttaccaggggtatgtcttggtggaaaaaataaggaaataggtgacccagtctaatctccatgtcaactggc

SEQ ID NO: 111321 - DNA, 2437 bp, Homo sapiens
gctattaaactgatgttccttgtaatatgaacttagccatacatgtctttttcttagaataataatataaacaatataaatgctagaaatgatattgttcaacgattaaaagaatattctttgaattggtatacttgtttgatagtatgccaaatttatactcctaaatgtggtatttcccctttctaggaaaaacttgacatgtctaggtttcctgttgaaaatattagaaatttcagtattgttgcacacgtggatcatggcaaaagtactttagctgacaggctcctagaacttacaggtatttcatttatgttacatacttaactgatggctgcgagttattgggaattacttttactcttaaattttaattttataagtaatattctcttttttttttaaagcccagagaaatatcaataagtgtttctgtttatagggacaattgataaaacaaagaataataagcaggttcttgataaattgcaagtggaacgagaaagaggaatcactgttaaagcacagacagcatctctcttttacaattgtgaaggaaagcagtaccttttaaatctcattgatacaccggtaagtttaatattaattttgcatgtattgttaaagtcaacattgtgtcagtagtgcaaacagatccttgtttaatttttgaactgagtattaaacatctgcctttgctttttgttttctcagtgttcttatgttagtgtcagttgtttcaaaagtgcaggctacaaaaaagaaacgaatatttaacagcttttatcaagtaaagtcaataaatttgccataatgctctttcctaaaaaattaactcacatttacaggtatcaatatttttgtttctcagggccatgttgattttagttatgaagtatccaggtcactttctgcttgccagggtgttttacttgtggttgatgcaaatgaggtaggtatttttcattttgtatgatgtgatatgacatgactatttggttgtttcaagagtttttctttaaaatgtgttttggaaatagaatttttgtgtttgaaaaatagatttaatctgttacttactgaaaatcatatggtttcatcctgttaatctgaaatattattacaataaagcattctctggaattgactagtttttaaattggaattgttcaaaagattgttgtatttttttgaagtgtgacatcatattgtcaatgcatcttaccaaaaaaaccccaccaactttagcagttcttaatctgaggtttctatatccatttttagcagatcttaagaataaatcattagttttcagatcattttaggtgattttaaggcaataatttggaagtattaggtttttaaaaaatcagtaacattactaagctcttttgttgtgtaagccgtaaagacactcagcagatgaccatgtaagagctgtgaatataaacttttgttacatgtttctcacaaactcttcattcaaaacccaacttttttttagtggtggtggtgaccgtgttgtgttaagccgttaagcctttcctgatcccatcaaggaaagtcaatctctaccttatgtaggcagtactggcctttataaactaccttgatgactgtgttctctaataagctttgaggtccttgagagtccatgttacatcttttgtttctccaatgcctgatgtagtttctggcacagaaaaggccctccaataaatgctttctgaactgaaaggaattattacagaggatgattcagatgcatggaaaaataggtatcatagttgagctgccgtgtacctttccttaaaggcttcctatctcaagcttagtagactgtctgttggctcactctacttgatgtgattattgctttaccatcagcgattttcatattgaccccaaagacataagttggagagaaaagcatgaagggtagctacatggcattttgtttaattttattattagcataacgcaaaatctcttgatgaagatgtatagaatggtcttaaattacaagttttgtgatatataatagaatggtcatctcagtatcttgtatcttgatattttcagggaattcaagcccaaactgtagcaaacttctttcttgccttcgaagcacagctatcggtaattccagttataaataaggtaattacaatgagacaacagtgttgctatttcactttctaaaagtacaattaatgtttaaatgtcagttgtactattcattatatgagggatcaccagctatttattaaatatattggtgggatttatctctttgaattgtatataacagaagtgcaactgaaactcacccttgcacagaattgagaaggtagttctcctgaattaacttgtggtagctgagggccatttctgtagggaagggaagcagggcagatgaaacatgtttgtcagatta

SEQ ID NO: 111322 - DNA, 1032 bp, Homo sapiens
tgtagaactacgtaactataatagaaaaagtatttgtcaatatactgtttgctttgttcttttccttttggtgtatttctcaaattgataactattggaatttttttttccttctgatcataagtcacaggtcatcaagatagaaaagtatagtcttaactttaaatgcttatatttttcacatgtatctttttagatttctgctaaacttggaacaaatgttgagagtgttcttcaggcaattattgaaagaatccccccgtgagtatttggtgatttttgtactagttgtctctatttaatagttcaaaaactgtccatgtttaatagttcaaagactgtcagcttgaactgttattttagcttaatggatgtggcaaatattcttgcaggcagcgagaataaatttatttgcttttagtaatacatagaaggcaagtacagtaaagtaaaagaaaaagtaaagatgattgatagaggtcttttcatgacaatcattataaaatatacctcagtacattggcagttattttcctttgctttaagctgaacaaatatattcataaataatttgttaaaactagaggttattaaatctaatatattttataaaaaggtctttttatttaggctgttgtgtatcaaactttctcaagaactcaagtacaatatctaagttgaaaataagaattttattaagattttaatttagtgtatatatatttactttttacttatatttactagtcctaaagtgcatcgcaaaaatcctctgagagctttggtatttgactccacctttgaccagtatagaggtgtgatagccaatgtagcattatttgacggagtggtttccaaaggagataaaattgtatctgcacatactcaaaagacatacgaagttaatgaagtaggagtcttgaatcctaatgagcagccaactcataaattgtaagtaatctgcattagtaaaattaaaatgcatttgtatgtggttctatttctgcatttttctcaacttggtatgcttag

SEQ ID NO: 111323 - DNA, 1051 bp, Homo sapiens
tttagatatgcaggacaggtgggctatctgattgctgggatgaaagatgtcactgaagcgcaaataggagatacattatgtttacataagcaaccagtggagcccttgcctgggtttaaatcagcgaaaccaatggtatttgcaggtgaggagttcacaaattcaaaggttgagggccatgatatttttaaactaaaagtctgtctcagtggttaaggaaaaaatacacattctggttattttaaataaccactaattccagcatattgtttcactttgtgctgtttatcagtttataattacatatgtgtgatgaaattatatgtgggagatcatttaggatgtgttaagaaataagttcttgaggaagaagctgtgatatataggatacagtaatataaatttctttcttatttttctagggagttcattattatatttgaaacatttttctaattaggatgttcttattagtaattatcagtagacactgactgagtgccttcatcttcgatagactttctttaatattgtactgtactaatgtagatatgacagaatggtgttgcctcaagtacgtataatttcagaatcttttacttcatttactttggaaaaaggaagacctgattgaaggtcatcaggttactctgtgctgagtatctagcccttaatttttgccctacagtctctctcactgggaattaggaactttgtttacccctacctttaggcaaagtcagtcatgtggattttagaggacttcagaggtgtcagatgaaagagaatcagtagtgattcccatagtttttgtcagtaaataccaaaaagcaaaatttaactatggttttaagtagataatctgccttagagaattgagagtgcagtatagttttcatgtctacttctatttttatccaataataaagtttcatttgggttgtggaatgtcttgtgcttttgtttttgaaattacactgtgttttcttaataggcctaattcccatgtttttttttttcttttccctgtattttttcaaaaacattaaaa

SEQ ID NO: 111324 - DNA, 1043 bp, Homo sapiens
gttcatcgggatagtagccttgctctgggtgctggctggaggtaagattcattcacatgtgttttataggaaagggaggtgtaaatggtgtattttaaaaatatttttataggaaagggaggtttttaaaaaatatctttataagtaagggaggtataaaatggtgcattgttctggaacatttactgaaaataagtttatattagtgtaaagtgaacgaaaacaatttttatctgcctgtttcacgttgcggattgacattttatgggtaagttttatagtgatttaaaatagattcccaatggaagattttaatcttatttaataaaattatgctagcatttaattatattgtgaattgtttgaatgacttaattccatccctcccttaaagtaacaatatgttcattaaaaaaaaaaaaaatgaagcccatgggacataaacattttggagtttgtcttttcctcccccaggctaggatttcttggacttttgcacatggaagttttcaaccagcgactggagcaagaatataatgcttctgttattttaacaacccctactgttccatataaagctgtactgtcatcatcaaaattgataaaggtacttggtatttagtactggtatttagtactgttttgcattagtctcttggaaaaaataaatgtgtgtatatacaatgcaggagaagctttttactataccaatagctgattaagtattaaacaaaatatttattgattagtagtaataaacattgaattaccctatggctaatgatgaagaacttttttgaaaactaatttatgcaatatttttcttaacctgatgtaatctccagattatcaaaactagtctattgctgatagtaaaaggtaaaattagtagtgaaaataatgttctgattctagcacaaagatgaaaaatgtaattttggtcataagtaatttatctcgtaaaaagtgaagcattcattctggtgactgggaaattttaaatttcaaatcagtgatgaagacagtattgtattccatgtaag

SEQ ID NO: 111325 - DNA, 1249 bp, Homo sapiens
attggaaagtgtgtcaaatggtgactgagctttgattaggttaaaaactagattgtaatcttggtcttaacttttaatttctctggacctaattatttgtaaaacaagaaattaggacttttgactttatatgtagttacatttgatttactgttaaatgaaatagtgttcattttaaaagataaaattgttagataaagattaaaagctttggtagcaagcctaatgcaattgaaatataaaatgtttctctctggattataaatactgcctataagtttttactagacctttagagaaatacatcattcctcagtatttgagtaggttatcattaaacccattttcttccttccctttttaggctcgaagagcagttcagaagaatatgatatttattgatcaaaatagagttatgcttaaatatctctttcctttgaatgaaattgtggtagatttttatgactctttgaaatccctatcttctggatatgctaggtaaaaaaataatgagaacctaagatgcctgaccaacttttttgaaatattgatgagcaagggtatactaattcttcatttatttagtaatttcagctttcttgaagatagttgagaatcatactctaaggttagaatgacttggaacaactttataggtgttacagactacttgtgatttgcttataggagaaaagtttcctttgatttattatctaacttttatttctcttttaacaaaaaaagttagtccccttttcatgaagagctgtattccttgtctgttaagaattagacctaatttcaaaaatttaccataacctcagtggcacttttaaaatgtatatttatgttatgcaatctcaagagcatctatttacatttgaaaaataaaagtgcatattcagtctgtaaaaaatgttagatgtgccgctccattagtgaacactttaataacttagtcttttgaggaacaggttgtcctcatcacgaaaacctttgtgtatctcataggagtacatggagaaaagccagataaaagtgaaaggagagttactattaaataacaaataagaaactcagggcatagcattctgagaggctgttttttgttgttgttgttgttgttggggcatataactctagataccctcactatgccctaaaatcttatgttacgggatagtatatatagaaaacagatgtgaaacatggggaagcaggaggggaaaaatgaacattgacatctata

SEQ ID NO: 111326 - DNA, 1220 bp, Homo sapiens
catattaaaaaaagttttaaacattttataatgatggatttagaattgggaacaagtttttttgttttgttttgttttttttttagatgggagtctcattctgttgccaggctggagtgcagtggcgcaatttctgctcactgcaacctccgcctcccgggttcaagcaattctcctgcctcagcctcctgagtagctgggactacaagcgcatgctaccatgcccggctaatttttgtatttttagtagagatggggtttcaccatattggccaggatggtctcgatctcttgacctctgatctgcccgcctcggcctcccaaagtgctggatttacaggcgtaagccaccgcgcccttttatatttgtaaaaaaattataaaaaggaaaacccccacgtgttcaagaaacagcagattggttaaaatgaattacaaagcacccatattgttattttcagccattaaaacttgtggagtaatatttagtgacataaaaatgtctgttaaatataaagagggtagaatatatcgtaaacactgatcatacaaaaaaatgcaaaaaagtgattagaaagataactgtttaaaataatcattccaaaatgtttaaccgttttcagcgggtaaggaaagagaatcaagaacagtttctattgtctaatgttgtatttctaaatattctgtaatcatacattacttttttaaatcagagaagttgttcatgattcagagagtaagagagatttataagtaagttccatttgaacctccttaagagatcacctttacactgattatgcaactggcctagaaaaatacttgaaatattcttatttaggatatataaacagttgtatttttctgtctcagagacaaagctcattcaattggcaaagccatatgtgaacggctgaaggattctcttcctaggcaactgtttgagatagcaattcaagctgctattggaagtaaaatcattgcaagagaaacgtgagttgaaattcatttttggtcttgagccagtttcagaaatgatatacctaaaaagtgaaagaatattgaacattttaatttaacattggcctaagctttcttacttgtagaaacagtatgatggtgctctccagttttctgatttaagtaatgactgttactttgaattacttatataacagcactgggtgatgtgatctgcagttagtataacgtatacgagt

SEQ ID NO: 111327 - DNA, 1003 bp, Homo sapiens
gaacaaggtgggaggtggaataaactataccgagctgaccaaagaatagcaaccatacattcatttatccagccattatttaataagtgcgtcctatgtgtcacttgttattctaaatggtaatatagtaatgaagataaagcccttactttcatgaagagtgcatgtacattctacccttagaactgtaggaacacaggaatgacatttactccagacagtgagttttagagatgtttcatagaggtgctgatatcttaatttagacttaaaggctgaataagaattagccacatttaaaaaaataattttatatcaggaacctcagttattcatagccaacaagcaaataccttgacccagctctgttattaacctttgctcataatttcagcttagctgtacacttctataaggcccaaatcatcagtgaggtcagtagtagtagatcttagtagacttcatatttttttcctgaagcttgtattttcctgatcccatccttccctctacacatatatagagaaatataaatgttagggatatgtatacctaagaggagaaacagaacacttttacaaatctagataatttaatgtctataattaatatatatttataagcagatacatacttaatagtagaaacagtcaatgcatattaaccatatgtaggtctggccttatgtctccatattaaaaattcataaattgttgtactttggcattctgtacttgcttcaatagagtattcatttcttcatttttcaaaactgggttactctttgtcatattttatcttcttgtggcctgggaaaattttgttaaacttgtgtgctaagtgtcagtaaaatacagatatcattaaagtaaatatgcagaatataaatgtaaaagatattttaatgactcaaggaattggcagatttattttttggctgaggttaccagaaatgtgactagctactagggtacttataaataaaactcgatttatttatgtc

SEQ ID NO: 111328 - DNA, 1669 bp, Homo sapiens
tttttttgggagggggttatgtttcttcagtataaaccacctcagttctccttttgaaatagatgttgcataagttataattatatatgtttatcactgacaccactaaaaagaatttgacttggttttttaaccagtttgtcttaagcttcctgtagttgtttccccgctcctccccgctcccaaatatattttaagagagttcctgtgcctcttacattaacatcttcactgtagtcatggatgatccaatgcctgacattttatatgtaccatctaaaggacataattgtgcagagagagagaaggattattgcattttctttgaacttttccttatttgggatgccctattattggatatgtattcatgaaagaatctcatttgttgatctaggtttatcatcattggatttttagatgaggattggcatctgggtcttacaactacccttcttttgttccagggtttggttaataaaaactctaagaactgtgccaaatgggatcaaaatatcagctttattaaaggtaaagttgaaatagagattgcagtttgggcttgaagccagaatggggtttttcactcctgccctttgaattggaaacagtagaatgagaagagctcaaaaatgttaatctgctattgctcattccagggaattagagcagaggtccctttcctctgagggaagagggaaagaaaaaggaggaaatacatactcaaatgttctaattcctcctctgatggcaaacgtgttcagagaaagggtaaaaggtgtatcatgcaattcctgacttaaccccagcaataagatatacaaacatggatttttaaaaataaaatctagggctgggatccggtggctcacacctataatcccagcactttgggaggctgaggtgcgcagatcacctgaggttgggagttcgacaccagcctgaccaacatggagaaaccccgtctctactaaaaaaaaatacaaaattagctgggcgtggtggtgcatgcctgtaatcccagctactcgggaggctgaggcaggagaatcacttgaacctgggaggccgaggttgtggtgagctgatatcgtgccattgcactccagcctgggcaacaagagtgaaactccgtctcaaaatgaataaataaataattttaaaaatctagttttacaataaaatctaaatatataaacttttaaaatatcttaacgcagtagtgtcttgggttttttgttgttgttgagacagagtctcgctctgttgcccaggctggagtacagtggcttgatcttggcttactgcaacctccacctcccaggttcaagcgatcctcctgcctcagcctcctgagtagctgtgactacaggcacttgccgccatgcccggctaatttttgtatctttagtggagatggggttttgccacattggccaggctggtctcgaactcctgacctctggtgatccacctgccttggcctcccaaagtgctaggattacaggtgtgagccactgcacccggcctaatagtgtttttaaaaagtaaaaataaaagaagacagtggagaaaatgttaaccttctgatttggttgcatgcttggattctttgctttggtagaaaaaggaaataactaatgggatcaaaagtaaattaactggaatg

SEQ ID NO: 111329 - DNA, 1052 bp, Homo sapiens
tagcctaaaccattttttcacattcagaactaaaggtctgggtaatttgggaattaatactctataacctgtgatggggtggggtgagctgttcattagcatctcttgtgaggtctctccattttcataaagaggcatgagaaaattttcagaattacctgagggtagaagcaaagcaacactcagttatagtcaatgttatcaacctactgaacttgatataaaagactttttgggcaccttactgcctattaaaaaacagtaaagtgtaaaagatagttctttagacaaattgggccatggaaatgccaagtcgttagttttggtgtctgtaatgcctcacaaagtaataaacttttatgaataatttgctaagaaattagccataatggcaggtagtttatttatatacattgatgaaatctatattatcctatgtacatgttattatacaaacatttgtttgggtttttctcagtcattttccataccgtaattccagctcagcccactccacttgcaattgcttgctctcatcttctaactcctgtttattcttctcaatttctgctttaatggcttcatttaacctgctcctccatatcctgtatgtttttttgctcacagcttttttccttcttcctgttggaaaactttgctaaataacctgtattaatattttagcctcatttgactttaagattatctcataaatgttctcttggatatcctgtataaatggtagttaatatttctgagcaccaacttcccttactccagctctcagacttcttctcattattatgacaattgaaggattttaaaaatcctgtcttaggagaagtggccccaaatttgccacagatctatgatgttttaattaatagtgacttctgaatgatctagaaaataatggtaaaccatgtacatatatttctgtgtgtgcattttatagattttttgtctttgtatgaagaaatttactgaatatccaaataagcattatttctatataaatgaggtatgtgggttaaaatctagtgaacaaaata

SEQ ID NO: 111330 - DNA, 1048 bp, Homo sapiens
tttcttttctctccgttttctctttctttttctttttttttttttttttttggagacagagtcttgctctgtagcccaggctggagtgcagtggcatgatctcagctcattgcaacctccacatactgggttcaagcaattctcctgcctcagcctctccagtagctgggattacaggcacacaccaccacccccggctaatttttgtatttttagtacagacggggtttcaccatgttggccaggctggtctcgaactcctgacttcatgatctgcacgccttggcctcccaaagtgctaggattacatgcgtgagccaccgcgcccggcctctatccatttttatagtatctattctatttcaggttcttgttatctctaatttgagagttgccataacttacaaccaatttctccgtttaattatttcttcacattctccatacaactgattaatattccaaacttggtgtgatatgtcattagtttttactcaaaactatatgtaataaagttcaaaatctttatctgtattctgcccttcagtttaattttgctgttattttatgtcacttcctatatggtataatatattgtgtaaacaaaaatacctaacacatcttttacaccctgctcattttcctacttccctttgttctgtttacatggaaattgtaaaccttcttaagatccagttcaaatgttgcttctttcacaaagcttctctgatccccttctttaataataagtaatttcttcatcccatgatgaagtgccatcagatggagtgtcatttatgacacattgctttaattatagctacatgtgtgtcttatctcacctactagaggagattcatgatgacatgctttaagaaaactattactaattgaatgttttacctggaaaaaaaattgcatgttaaaataaacttattttcaagagttgtatcaacaattttcttatcagcaatttttccaaaagataaaagtgggtgcaaactgaattagaaaatagatcctcaatgtgtttctaaatagattatta

SEQ ID NO: 111331 - DNA, 1047 bp, Homo sapiens
tcaaattatgggaagaaatccttccaagctcaaaattatctggtttccatgtaattatactctgagtaagtttgatttgaacatcctaaactgtcgtattagaggaagtgtctctaagaattattcttaattacatagtgaccattattcattgacaactgatttatcagaagcctattacatttaaaacctgtgattggtcctgccagaggatacaaatacaaataagacagtttcttaaaatggggaatatttttagtttaactgctgtggaaagtaattctgttaatttttccttttgatgggtttttaaatcactactgggatgatattaggaacatgatgaaacacagttattcaacgcctaatatgtgcaaggcattgtgctagtttgggacttcaaaaaggattaagattttgcctttgctgttacagatagaaagacccaagcagtatgctgtaataagaataatagtaaaggcatgaaaagcgctttgagaaaatacttcagaaactaatgaacaaagcagggaatgtaggtatagcatgttatattctagatatgaaattccacatttgcttaagtaattaataatttattattggtgatataatgtagtatagtaaagctagcacatgctttggagatcaatacaagggggttagaattctggctctgtcatacattatttaatctctgtgaactcagtttccagatccataacattctcatgaggatagcgcctttggagggtgtcgtgaggattacatgaaatagtatatgggaagaacctaatagcctacctggcacataattcatcttcaataaatagtaattattgtatcttcgcttattgttctttggaaaataccgacaccctgtgagcataccagcccctcaatctgtccagtcttcatccccactgccacatccctagtccaagctgttatcaccaactctcgacttgaacaacatggcagtctcttagaagagcccttcttctacttttgcttccctgtaatgtattgtcaataccattgtcagaa

SEQ ID NO: 111332 - DNA, 1030 bp, Homo sapiens
ttctcgttattcttttgctcatacagtattcttctgcatgtgaactaccttacctagactaaactcttttgtttccctttcaacatcatcttcacctcttacaagctgtataatcttagggaagtatatagagctttttgtgtctccagttacttaacctataaaataagacttaaagtaatgcctcctactgtgataaattaaagattcatattgtgaactataaagcaaccacttaaaaagttaattgaagatgagtggttagtaatccaatagtggacataaaatataacgctaaaagtttaatttaactaaattaaagcaggaaaaggagaaaaataaacaaaaaaagagaataaatagaaaacaattagcactaagacaaatttacaactaagaaagtcattaattatattaaatataaactatatatgaatattccagtgaaaaggcagagggtgtctgaataatgcccataagaaatccattttggatataaagatgttaaaatagaataatctaaaaagatgtaatcttcaaacacaaataataagaaagttgaggtagttatatcttggactaaattaaaataaacatcctacaaatcaaaattatggaaagtcattaaagtagtgaagaaagaacgttaaggctttaactgcttgtactaaaaaagaaaaaaagttctcatcaactatctgcgagtccatcttaagcttggaagagagaattaaaccaaattaagtatgagagaggaaataataaaggtagaataaaaaatccatgaattagaaaaacctctacctagattcatctattagactaatcaaataagaggataagatacaaattattaatatcacagataaaaggaaagatattacttcatgttaaaaacattatgctgaacagaagaagctagacacaaagactctatatgtataattccatttatatgagactcaagaaaaggcaaatataacttagagtatagaaatcatatcatgtagccaattccatgcatttaaga

SEQ ID NO: 111333 - DNA, 1094 bp, Homo sapiens
tgtaaacaagccccaaaatttcactgaatagagatcagttcttaaaactttagtacaagtagccttatactatcaaactgatgacagtaattgctggaacaatcaataaaatatcactttgacatatctcaaaatatatttattaatattttgtataaagtcactactaattcatttctaaagagtaaattttttaacttaattttacttttgccatatgcttttgtcatctcctggaaatctgtcaattctctatgttttcaggaattatagactcattcatttttgagttgttagagaatggaaattctggattattaattattttagttatgtgaaagtctccatttatgttttataaggatgaacaatttttcagaaatttggaatgtaataagatgacagcactaacacacttattgctgatcttgagtgccccaaacacatgacaccacttaattcacattcaactgatgcatttgatcatttgctatccactgtacactatgccagggccctgaaagataaactttgcctttcaggaactcagaatctagtgggactgagaaataattttaaaacaatagggtaagtgctgcaatcaaagtagaagagagttgtgggagctcaaaagagtgagtgactgatcctagaatccaatttcccaggggctctatcctcttctcaccttatgctctctccatggtgagctaatccattcccacaacttcatctgtcactcatgagtcacatagctgtgtttttccttgagccctgtcttcctatattctgacccataactacttatttggcacctctatgtgcatgcgccactgacacccacaacacaaacccatcttagatgaattagccatcttcagcccccaatcttcaactcttcttatcgtagtctacctacctactcaggtcagaaacctggtggccatcctttggtgcctccttctccctaacctcccatattaaaaggtcaccaagtgctgccttaaataactcacagttttcctctctttcaccttcctttagtggagtattaagtcaactctgatttatctattctctaggctaatgcaagc

SEQ ID NO: 111334 - DNA, 1595 bp, Homo sapiens
tctgccacaatttattcacctattgatggatattttggttggttcaagttttaggcattagaatacacagaatgctgcgaactttcttgcatacatctttgaacgaacatatgcttttttttgagcaagtactttagaatgaaatggctggatgatatggtaggtttattttttcaagatactaccgaaattaaaaaaaaattttatttgaataatttttgagggtacaggtggtttttggttgcacggagaagttatttagcggtgatttctgagattttagtgcacccatcacccgagcagtatactgtaccctaaatgtaatcttttatccttcatgcccctcccagccttcctccccaagtccaccatgtccattatattactcttacgcctttgtatcctcatagcttaggttttccattcccgagttacttcgcttagaataatgactgtcaagctttttcaaagtgattttaacattttgcatttccattgcagtctatgagagttccagctccatcttgccaacacttggcattgccagtctttttaatttcagttattttaatatgtattgtctcacagtggttttagcaatatttaacaaatttccctaatgaccaatgatgttaagcatcttttcatgtgcatatttgccatgtatacatcttcagtgaagtgtctgctcagatctgttgcccatttttcaattggattttttgttttcctagtattgaggtttgagagctcttttgacttattctgaatacaaatcctttattagatagatactttgcagatactttcttctaatctgtggcttatcttttttcccccatgtaaattgaccctatattgttttagaacagttttagataaaccaaactttaagagatagtacagagtttctatattattaacattttacattagtacagtgcatttgttataattagtgaactaatattgacacaatgttaagtaaattctagagtctattcaaacagaaaatttctaagtttttccctagtgtccttttcctgccccaggattctatcctagatgccgtattacatttagttggcatgtttttgatgaccttgacagtgttgaagagtgtgggcgaaatactttgtgggatgtctctctctgttggaatttgtctgatgttttcttcatgattagacttgggttatgggtgttgggaaggaagatcacagagataaaatgccattttcatcacatcaaatcaagggtacatactactaacgtgatttatggcttgatattaatcttgatacctggctgaggtacaggtttcttcactgtgaactgactcttcattttctccttttcttactgtacttaaggaaatcaccatagttcagcccatacttaaggagtgggaaggtgtgctctcctttttgaggctggaatatctacataagtcgtggaattttgtacccatttgtttcttttccactattgagatttctacttattatcagtatggactcattttatactttgggttataattcagtactgctttgttactcaaactgttctaatggcttggccattaggagctc

SEQ ID NO: 111335 - DNA, 1090 bp, Homo sapiens
agttttattgaaagctaaaaataggttctaaagtaatgtaaaaatataaagcacaaatatacttgaatattgcttaaagaattgtgtgaatagcaacatatattatggatatatactttgtgatatttttaaaaaataattttttcaaagaatgtataagctgcatatataactcaggagattccatgtctttctcatatttcagaggaaagattataaaatataaaatttcttagagaacacctctttgtcagagataaacaagaacaaatactctaaacttatgtgaacagttttgagtttatgaattctagaaactaaaatcaagaatacagaaaaatgaaaataacattttacttctgcgcttctatgtttgggaaacattgctctgataaaaaatagctgtcattatgcagtgtgtatattcaaatatgagataagactatgtacacatccacttttgttaataaactcaatattgaatactttgggatgttaaattcattggaaaaacaaaccatttgtaacctcagttaactttaacaacaagcattctgagcaaatgaaaagtgtcttgttttatttttatatattgctttattttaaatgactccaaataactcagtagttatacgtaattatacgtaactcaataatacataattaataggtgcttgctatttgcaagccatatggcttattagagcatcagactattctttgaggcatccggagcaattattactattctcatcatacagatgaggataggcttagagtgttttctgagtgtgatctaaacagtgctactcaaaatgtgtctgcagagaagtgcttgtctgtgaactgtttgttacaggtcagtgattcaataaggagcttgggccagaaagtgtatcagtatactgctgtcttcatcgagaaattttggttttaaaaaaattatcagctgaaggaaatagtgtgcttagtgtggtagttaatttatcttcttgtgcaagttatttgttatgatgggccagtgatggtttgtagaacagcacttcgagtagcactcattgtgaagtctcttctaaatttcagctttcca

SEQ ID NO: 111336 - DNA, 1338 bp, Homo sapiens
tcaggaagaataagtgagattgactttatttatttagtgttgtgctacttaattttcacacattcagaaattttttggttaccttttctcattagtcataacttcattacccagtaataaaaatataaacagtattatttagttctttgagatctgtcgtggtttgccaaatggctcagaatatggtacgttatggtgaatgttccatatacatttgaaaataatgtgtacagttgtcaggtgtagtattctatatattgctaaggttaggtagaatgcattttttcaattcttctatatcctcattgattttttttcgtttctttgtgtcagctattgagagttgtattaatacctctaactgtgaatgtggatttattcatttcttttagtattgccaaattttgctgctttatatattttgaagctatggtgttaggtgcagagggatttatgattgttgtgtctttctgttgaattgcccttttactgtcgttctctatttcttgtaatgcttcttgcctaagggctacattgtctgatatattaatacaagttgagtatcccttatttgaaatgcatggaaccagaagtgttttggatttcggatttttttgactttgcaatgtttgcattatactcaccagtgcagcatccctactcaaaaaatctgaaatctcaactattcaaatgagcacttcctttgagcatcctatcagtgagcagaacttttcctgttttgggatttgagatactcaccctgcgtggtggtatcagctttggtgttttccaggtgtattcatttccatgctgctgcttccatcagtcctttttctttactgtatattttgcagaaatttgttaaaacctattttctggttattcattctcatcttactcttttttatagttacagaagtatttctctttttcttttactgttgctttaaaagtgtgcaaaaggagagtggaattgtgtttttacattttaaacagaaagccccttttgcctgtttttatttttatagatatttcagcagttgaatcagttgaattcacttcatcaagaaactatcatgaaatgcgtgaaaagtaggaaagatgaaatcaaacaggctctgtcaagagaaatagttgctatttcctctgcacagctacaggattttgattggcaggtaaaggtaagagtctatgagtatgtgtattttttatttcattttttggatatagagaaatatctttataatatcatatatataaaatttgttattttgggaatgtattatcccaaagaaatatcaaagatagtttaaattacatcttgaattaacttgggca

SEQ ID NO: 111337 - DNA, 1050 bp, Homo sapiens
ataacggtagctattatagtttctttgccattaaataaagtcatttccatgacctttgtcattaaataaggtcatttccatgactttatttaataactgggatgaagtgttcattacatatttgtgaatgaataacaaacatattccaaaaaagataatgcttttatttttcagtttgagttctgggttttttttttagcatggggacagtataggataaggtgtagagaattttgaatggattcaaaattgagtatgttgatttatggtaaataaaaattcagtttgtatagtatattagccaccatttggaagcagttgcttgtgttctggcatgtgtggtgttagagggaaggagttattagttaaaatggggtggaatatgattatttccaagttatttggttcaaatactcctcttgtaagatacaaataacttcaagaaagataaccttattaaatgttaagtgcttagaatagtactggcattgtgttatctcagttaatagatgctgaaggcatgaattggaggaggaggactagtgataataattagaatggtaacgagggctagcaatgtctacatgtctttgtacatgccaggaagatgccaagtgatttgcacgtattcttattccatccttacagcaagattaagagaatagatgatatcctcatttaacacttgaggaagcagactcagaacatttaaataaaacttgaaaatactgaaactgggattggaactggatagttttattccaaaatccgtagtcttaatcactatgctcagttatacatgtgttaggctttctgttgctgatattaagatactaataggatagaaaggaaagtaaaaaaaggaaaaaagtactggagactttctgggaatacagcaaaagtaactgctgagctgggtgcggtggtgctcgtctgcagtcctaactacttgggaggctgagatgggaaaattgcttgagttcaggagttcaaggccagcctgggcaacatagtgagaccctcaaaagaaaaaaaagtatgttgtgaaaa

SEQ ID NO: 111338 - DNA, 1332 bp, Homo sapiens
tatatgggagcctttagagagttttaagttgtgaaattgtcaggatctaaattaggttataccaggactagactgataatggtggatcaggttgattgtaataaaggtgatgagaagtggtaagattctggatatagtttaagggaagagtcaacagaatttgcggactgacatgatgtgagttgtaagtgaaagaaaccaaggatgactcaaaagtttttgggctgagcatctagaagaagggagctgccattagctgacagggctaatataggggagaagcagtttaggggagagtgcttggacctccatttgcacttgttactgtctggagatgggctgccttttgggcatcagtctggagttttggaaagaggtctatgctaggggaacttgtggaagttctctttggatagctttggtattctcagaaaaatagaaacaaggtcatcaccaggaagaaagtcaggagggagatattggatgtaaagaggagaaaggaaagggtatgaaacagttgtgtatgagagtgggagaatacatggcgtggaaatgcagtatgattgcaggcagtgtgaatggccaacttaagagtttgcggtcaggacgttaaagtgactctgacaaggtgttgtgcatttctttccagccactttcaacctgtaggtactggaacagagtacatagagctttacatgtgaatgtaagcagggtgagggttttgccaagaagtgagagaggagttcactggttgagagaatatacaaggaagtgattacagtattaaccataaaatttgaagtaagtaaggaaataagaccacttgagaatatggggcagtgaaaagatggttggtggttgtttatgggtaggatcagtgatattggagttgggttaaaagtgagtcatttatttgaaagtaaattttatttgcatgtattgaattatagttcaaacacatataaagtcctctataaggcacagtaagcagtaaaaatgggtaacctcacctagtacaaaatgaatgttttaaaagtaaataaatgcaaatatttaaatttatttaactttattttttcaaatgaagcatgcctttagcgtttttctctgaataacttaactttaattttttaataccactcttctcctattctctctcccaaccctcacattccttgatgggttgccagagctatatgccttctgccagctcttattcaagtgttactgccctgtatcagagccctctgatagccaccaaggctctcattccatatgagatatctggattaagcttaagtaactacttactaagctgtgccacttgggtga

SEQ ID NO: 111339 - DNA, 1130 bp, Homo sapiens
cacaagctaaaagtgaatgcttctgttttctcaaaattagatcttacactcctacttctaatggcagaaaagccagattgagccatgcaaaaggaaatgggatgtctttatgttcttttctataaaattcagtgatcaacagacatttatatatcatctaactttggccaagcactggacagatgcatagagaggaattaggtatgttcccgactttgaagaataaagccatctgtaacacactatggcaagtgcatatgagccatgctcagggttctaatgggagcagagcagagaacaccttatggtgtctgttgtgtggatccctcccaatctccctcattccgtggtcaagctaaaacagtctcaaggatgaatagaggctggtgtggtgagtgggtgatatggttaaccagccctccagaaagagagggcagcatttggagaggtgcaaagtgtacactatgctttgcaacctccttaactcattgggagtactaactaaattacatattcatagaccccattccagatcctctaaatcagaatctccaggggagaggctttggagactgtgactaacaggggccccaagtgattcttatcagggggtcttgggcaacagaggacaagtggaatacagttcgttcatgaacattgttgggatgagttttggagagaatggtgaagaatgagattaggtagtatgaaggtcactttatgtcatgcctgtctttttgattgttcggttttctgtttgtatcctacctaatgctgctacttctcaggcattaataggtacattgaactgagcatttacttggacaactttaaattgaaagctttggacctaagcccaatgtataagattcccacccttgacttatctgtggcttgagaaacacttaaacaggagagtggggaagaggatgagcattgtttatttatagcatgtcccttgactattaatcgtgtttcattttatttgttagaagactgagtagctactaagtagtacagctaatatttgagcctggacttacagagtagaagaaatgtgatttgtcaaaaagtggtgagcaaagtgctcattccttcatttaaaacgggtgaactgcaaaatgcagggt

SEQ ID NO: 111340 - DNA, 1687 bp, Homo sapiens
aaaccttagaatatcattctagttgatatataacatatttttcattttcataaccctgtatattacttaaacctaagacatgtgacatcatccttgacaattttgatacaaatctgttgtggaatgatgactcctcccattcacgtagcactttccaattggaaaggtgttttctctttaccagaaaagatattgtaattcacatattataggttaggaaatgacttgactgtggtttagccaatgtcatgccaatgtcaagtagcagaccaggggctgcctctgggggtcttcttactcttgctttagtgttctttccatgaaaccacgcgcattttaatttcaaatttttcttactgataataggaggaaatagagctctgaagccagtgcagatgtcagatgtttaggtgaaacagtgacctaattcaacttaatatctcattcatggacaatctcctgtgagtttaggcactgaaggaaatggaagtgtgagtgccactcctctccttgtggagtttgcagttgtgctagggaaacacaatatatacatatataaaacaaaaagacatagggaatgcaatgagtgttataaagggctgtcaaatagaatgaaagcctcaaaaagagaaataataatggtaactggagcaatagaaggggaagtgacatttgacttaataacagagggtgggtgagatattcaaagcagaggtgtgagcaaagcatatttcagatggaggaaggagtatgaataatggcataaaggcagtagcataaaaggcttgcttgaagcctgggaaatagtgttctctgacttacatgtaacatctgtgctgaggagcaacaggaagtaaagtcagaaagatagatgtgacccaggaaagaggtcttgctatcaggataaagagttgagggccaagtctgcaggcacaattaccatgcttacgtcagtatttcactatggaagcagtgtggtgggtagatgaaaagacttagagatgatggcagagaaaacatttaggaagacattgtatatatcccagtgaattgtaatggagacctgaccttggaacaatgtgggaatgaaaagaagggtgatctcttacagatactgtggatttagtgtaagacattcagtgaaaggagtaaaaaagatgatgtgaacatgttgagctgtgatgaccagaagtactaacagaaaaatgaaaaacaagagtaaaaagaaccttggctggaagagtattttgtttttgtaaatgtattcaagacgccaatgcaagtaaagagattctccatattctttagtcattccacatacattcattctcatcattcattctatatatgttccatatgcatttattaaatagtggctatgtttaaaggacagatttgaatttgttgaattaatggctatgtagccctatgtgtgtttcattcttttatggagtttggaatctagtgtacccaatggaataaaaacctgaaacagagttcaaggttagagctataggtttagatgtggtccacctggaaagaattgaagccacagagtagcagaaagggttaagaaagaaattttcagagtaaaaagatttggaggtgacaaaaaagaagtatatatagattattcttttgagaagtttcatggtcaatggaaaaatatgttatcaaaatgtaatgg

SEQ ID NO: 111341 - DNA, 1003 bp, Homo sapiens
agaaatctgtacaccaaagccctgcaacacacaatttacctacatagtaaacctgcacgtgtaccacctgaacctaaaagtctaaaaaaaaaaaaagaaacaaaaaacaaagcaagtaactgcaataaccaaagtaaatgggccagagatttgaaaactttcttgtgaaatgcctttttactccaagtcaaaaacattcaagggccatgagatttatttttatatccccacttttgctgtttaaaagtgaatttatatgctgtctttcttatagagaacattccaacaaagaacgcgtgggtctcagtaaagaaaatttgttgcttagaggatgcaccattagaaacacagaggctgttgtgggcattgtggtttatgcaggtcggttatgtttctaattttcattgtctactctgtgcttttctacaagttaacatttttcatttactcaaaaatgcaatctgttgaagcagaaaggaaattttgcctgataaacttaattattggtctctgtttttctaaatggatcacaaaagcagattgaactgacaaaatagatcatgtaactgtgttttattaaattgtctgcaagagagatttttaaatatggtattcgcttcttggctttaatttgtacattttctatcatactgcacatccttcataggccatgaaaccaaagcaatgctgaacaacagtgggccacggtataagcgcagcaaattagaaagaagagcaaacacagatgtcctctggtgtgtcatgcttctggtcataatgtgcttaactggcgcagtaggtaggtaaaatttgattatttgctgacatcttttcagcaagatattaaagtattttatttcaaaattatatctgtgaatatttgactttggtaaggtggattttgtcagtagtgttttacctcatatccttgtctctttcatcctttagcctgaaaaatattaatattgactctatccatttacgttttgccatagtactgaag

SEQ ID NO: 111342 - DNA, 1494 bp, Homo sapiens
tgggaaacattccgtgttgtttaggcagattatatgatgagacttgcagagctgggaaagatcttaaagtcaccgaatccaaatcgttcattctgaaatgtttcattctgaaaacaaaggcccagaaacagcaagtgattttgctgaaagccacttagtctttgaaaaagttggtactggaacctaggatcaccacatagacccttagcctctccttgtccttaaagaatacagacaaaaactattacaaaaaaatagaatgtgcaaacattcttcacttcatagaataacttacccaaagccatactttatcctatagctaaatagagaagactggcaatccaacaagcacctatttatcgatggtctatattccagacactggatacaatgctgaacaattcacataaggcccctgctctcatagagtttctattagagaaaatattcacaaatatattacttttttaaatcaagaaaaaaattagcgataagtacttggtagaaaattaaaataaggtggtataatataaaatgattggatggccactttgaactggagggtcaggcaaggcctctctaagtgggacatggggcttagatctgaatgacataatcttgaaattccgtaggaaaggcttccagtcagaaggaacatctagtaaagaagccctcaggcaagggtgagcttgttacttttcaaagtaaagaaagaaggccagtgagtctggattttagtgggcatgtagaaagagaagtgaagttagataggtcagcagggctctgatcatcttgagttatttaagccaggatagggagtccagattttattctaagtgaattgtaaagctactggagtgttttatgcaggaagtgatctgatctgctttatcttttaggaagatcactctagctactatttgaaaaatggattgcagaggggcaaggagaccagttatgagactattgcactggtccagttgagagatgatggtggcttggactaaggtaatggatatggagagaagtagagttatttgagatattttttggatgtatggaggacagatgttagttatactttgaaaataagaaagaagataggaaattaggaggattctagatttctggcttaagtaactgtgtaagtcgttaagtttgatttacaaagatagtacctatcaactgctgctttgaagtctgagattatcatattggcaaaacagacagaattctctgaccttttggagattgtattctactggatgattcaaaaaataaaataaataagatatatatgtgtagatggtggtaggtcttggcataggatctattataaattgtgtggtcagatctgggaagtcttcacttcccagtgaggtcatttcaaagatgggaccagttgagatcaccaaggaagatgcaggtagagaaggaaggtgcttctgcagctctccagtatttgaggactaaaaagaagagacagcaggagaa

SEQ ID NO: 111343 - DNA, 1045 bp, Homo sapiens
gtgtcagtgaaagagggaagaattgtaagggtgaagtcattgagttcagggaggtgagattcagatgacaagtggagaatttggtgtctgaaacagagatgctttgtccacagtaggaggaggaaaggccgagagtatgagtaccaatgcagataagtaggtagatttgacgatggaaaaagaagggaattttgatctgattgcttctcagtgaggtataaggtaagttcattgaccaaggctatgggaggtaggccttggcagccaggtttgaaaggggaggagatggtgtgaaatagctgcttaagtaactgcctgatatattcaacttacaagtggctcttctcagacattgactcagtgtgctttttatcccacagccaggaggttggagtcctatcaggaagctgtctctgaagatgaagattttatagacacagtcagtggttccctcagcaatatggcaaaaccgagagcccccagctgcaggacagttcataatgggcctttgggaaataagccctcaaatcatcttgctgggagctcttttactctaggaagtggagaaggagccagtgaagtgcctcattccagacaggctgctttcagtagccccattgtaagtatgaatgcatgactagagtcttgcacatccacaatgtatgatgagagaacagccttgtaattatgatagagtcaaactctgttgtcttttctaccttagaagagactacatgattgcagctcagcaagatcaccacacataattagaagtataaacaaacaatatcacactagtctacttttaaaaaataactcaatgttgagaggtagtataccatttctgaaaaaaaaaaaggagaatatttctggccagggctgattatgtgtgagcctgaagaaggctgccttggtttaagaatcatggctcactcttagaaccagcaaagcttaccagagttatctcgtagtcagataagcaagtgtaatttatagggacattcataggccatgtggtacattgaaggcctttttattgctctgt

SEQ ID NO: 111344 - DNA, 1179 bp, Homo sapiens
gcctcgaacttcccaggatcctggctcttctcaaattgtcaacaaatgcataattacagcaactggagtgatcattttagtccagctcatttctgtggcactaatataaaaactattatattatatcttagccatatgtcaagtgattccaagacttaatatttctccaacttttgaaatggaagaagaatgtacacagttcattctgtgtactcattataagcccatatcggaaatatatttttcttctatttttctatcgatatattttcttctattttatctttttatctatccttgtattgaacttttcattttccatccacctgaaagtaagaacatgttggctcttgtttagacagaagcagcacagtttggtaataaggtggatctgtgccacaccttattggtttcttgatcaaacctcaccctattcgtggaacaaatgattggttatttcttagtttaaagtctttgtccctttatagataaatttacctcatctaaaatatattctctcttcatatactacctctatccatcaaatctggtgaaatatttatttctttaagaactaaattaaaaatatcacctttttctgaagacctctcagattctcttctttcagcatccgagctctgtttacaccgtccctccgtccctccgtcccttcatccacatggcattggtcttatttctgcctctggcaatccaccattaactccctgagagaaggatttatccatcttgaatcaacatctagcacaaaggctggcatgtccattctcaataaagtatttttaaaggttgttgaaggaagctacttaccaggctgtcttttcatctgggccattttcttttcatttgccttatactccaatgtcattgctgattatgtggatgctcttgtgctgctgttactgttgtccttgttttgtttgtgttttgcaaaaccatacccctaatatatagaataactaggttatggtcttcctcaatgtataagattatttctcaatcttggtctaaacaagttgattttatctttttgaagactaaagattattttgagaaaactacataatatttgatctgaaaaatgagcatctgcaaatatatcatataaaattctaaaagcccatctgtggagcccaggttaagaatgccagcttgagggca

SEQ ID NO: 111345 - DNA, 1079 bp, Homo sapiens
agagttagtattcatcaagtgatggtgaataaatctatgaccgaggtagaattctgggctcaataaaatctacctctgctattatgtatttcaaaatgagaaaacactcaactagatttggtgaaaactaaactcctgtttagtttaatagttaagagagtctccattgatgaggtgcattctggattatccatttgtttttatatcttttattttcctattctcacttcccatgacacgatatacattacaattgtttttagaaaaataaagtttaccatctcatgattcatttagatcctggctatacaagttatttctcatgttgatttaaaactaatttttatatacttcttataacaacacactgtcttattggatcttcaggaaacagacgtggtaccagacaccaggcttttagacaaatttagtcagattacacctcggctctttatgccactagatgagaccatccaaaatccaccaatggaaactttgtacattatcgactttttcattgcattggcaatttgcaacacagtagtggtttctgctcctaaccaaccccgacaaaaggtgagtaagttctctaatgcaaacaagggtcactttccagaagagaattttgggtttaaatgtatctgtactgagcttgatatatggataaaaatgataaataatagtagctgtataacactgattcagcatttgttctgtgctctgcacttaccatggtctatgtcatgggtccccaacccccttggttgcagaccggtaacagtctgtggcctgttaggaaccagtctgcacagcaggaggggaggagagggccagtgagcattactgcctgagccccgcctcctgtcagatcaggggcagcattagattctcataggaacgcgaaccctattatgaactgcatatgcaagggatctaggttgtgccctccgtatgagaatctaatacccagagaatctaatacctgatgatctgaggtcccacccaacccgtctgtggaaaattgtcttcacaaaactggtccctggtgccaaaaaggttgaggaccgctggtctaagtg

SEQ ID NO: 111346 - DNA, 1052 bp, Homo sapiens
gactctgtctcaaaaacaaaaacaaaacaaaacaaacaaacaaaaaaaacatcaaaaggtatgaaaggtgctgctggttacagaatccttcgaactaaacagtcctgataccactttctcaactgcaccattagaatcaaactggatttaactgtcaattggagaccactcccaactgcatactttctgatttaattaaagacattaacccactgtcatcatatatggtgcctagaatttccagagatgctgagttaaagggtcatccatcatcagtgttgcactagtctgaccacagagtttgggaagctagtgtccaggtggtgtgaggatatggatctgacatggctgtgcccagagggaggaatatgtaaaacaagttgatggtttgatattttgccagaggtcagtcctggtattcccacaagatcatatggcttgcttcatacctctcttttaattcttcccgtaggtcatgagtgacactgaatatgcagagtggctgaggaatcattttttagctgaaaccagcattgacaacagggaagaattactacttgaatctgccatgaggttggagaacaaacttacattacttggtaggtgaattatgtttgtattgcctgaatggaggattttgaaaaacactggatatctttgaataagggttattttcttccattgttatctaataaacatatatggttctgcctaccctgtccagtctgatctctatccaacttccaatccattctattctgttgtccactgcagtgaactagacttcacttgtgatggggtcaggatggtcaccccaagaagatcatgtaaaatccaacacttaacatagactacaaagccaagtaaatgttccaataaatatcttggttcaaatcaagataaatatcaagaatagagtttcttgtcaggcattggataaggtgcttaatacgtgttatcttttttttgaattctcacaacaaatctctatcttatgtagaggaaatttggggcacagagcagttcaatgacttgttcaaggtcacatgcca

SEQ ID NO: 111347 - DNA, 1395 bp, Homo sapiens
tcccttcaatttacagataagaaatctagccaaaaggagaacgagtaagtttgataaatccattgatccctgaggcttccttcccaaaatattacattgcatataattttggtctgggtcgtcaaacctcctttgactctcctgagcagctgggcagtttatgtagtgtagggttgagttggctaacagatatgattcaactgtagactagctgagcttcagctggctttggtttcttacaagtcctattgcactttggttattttttaggtgctactggcattgaagaccgtctgcaggagggagtccctgaatctatagaagctcttcacaaagcgggcatcaagatctggatgctgacaggggacaagcaggagacagctgtcaacatagcttatgcatgcaaactactggagccagatgacaagctttttatcctcaatacccaaagtaaagtgcgtatattgagattaaatctgttcttctgtattttcaaaggcattggaacatttgagatttgatgtatgcaaggattaaaaaaaaaacaaaacagcaaccgttagctttttttgttgtttgtttgtttgttttggtttttttgagacggaatcttgctctgtcacccaggctggagtgcagtggtgcaatatcttggctcactgcaacctccacctcccagattcaagcaattctgcttcagcctctcaagtagctgggattacaggcatctgccaccacgcctggctaatttttgtatttttagtagagacggggtttcaccttgttggccaggctgatcttgaactcttgacctcaagtgatccgccagctttggcctcccaaagtgctgggattacggggtgagccactgtgccctggccagcaaccattagcttcttgataattttttctatccagaaacctaccttgtgcttggaaggatgtctattcttctaaaggcctgatggaaaattataatgattcagaggaatcattgctgaataaaggcattagaagaaagttttttttttttatttgctttcccccctccacactggattaccagggatctgacaggacttagcccaaaatgagaaaatatatcaagtcctggtacaggaatctacctcccttttaagataagaaaaagtgatagtttttattgaaatcaggtgaataaattattaaatattttatggcaattctaaaaatagactcagggaaatcgtgccctcttgtggtaattcctaggtagtgctcccgagaatatcataagtttgaagaactgtttaagggaagaggaaaatgtcattttttaaaaaagaaggaaatttaggaggcttagactcagcccagttttttctatttttgcctcccgctaatctctaacaccaa

SEQ ID NO: 111348 - DNA, 1036 bp, Homo sapiens
acacatcacagccttttttgcttggaaacactgcagcccatgattgggagtcattttaaacagcaaaatcactgacaaaaagcagaaagatgcaaaaaatatggcaccaaatagcccatgaaaagaagactttgctacagtttgagaactggcaaaagaaggcatcatggtgttcagcttcagctgggaatgggcatatcacatgacttaaatgtcactctatgcatgtgacactcaaatgtcactctatgacatgtaaccacaaaaacatctcaagtattgtgaaattacagataaattttatcaagtaggagaattcacaaatgtggaatccacagataatgaagattagctgtgtgtgtgtatgcatacttctgttatttttataatgaaaaaaatagttaatttgtaaaacctaaacacatactcaaataaatagaagagtacaaaaccctttataatcaatttataatcataaaactacaatttaaaatcatattttggagaatatccacacagactgtattctgtatactgtaagcatattggtgccacaaagactatatttatgttattgtatggtattgcagctgtattctttcaattacaataccttaaacacaatctgatgttaatgttttcaatgattgcgaggcatgttactttctaaatgtgccattttaatttaaccaaactccaaaagagttttaaaaataatttttactatgatgtaatgagctgtatgagcatatctgattcatctttgtatactttgccttaagggctttggaggtgtatgggatcaaattcattcctaaaatggagccctgtgaacactccacaagagtgtttatagtttttgtgctgtttcatgtgcacatgtccatatctacttcttccttgcttttcttattttgttgtaggttgagaaatgcttgataaaacagcatttaaaatcaaagcaaacaagctttgagtgagagctctttcacgaataaactatttcagacttagtgtataaactaaacttaaattc

SEQ ID NO: 111349 - DNA, 1079 bp, Homo sapiens
cagtggggatagtgctctgtgctctcaagtagggcagaccacaggaaaggacattggtcttagatagagggagttttgtttcaagaggatttcatataaattttgggattaacattcagttgattacacttaattaaattaacattcagttaattacacttaatttcctgacctgtaaaatggcaacaacaatgtaattcccaggttgttatgatgattaaatgaattattcctaaagcacttagaacaatgctagcaccacataataagtggggtgtgagtgtgtgtacatacatgtgtgcactttaatttaataaaatatttaccaaaaaaagctgcaaggtaaattgtggtcctatcttatataagaaaactacagagaggctgaggtcacccagctcaaaatggcagcatttggaatgtgtaatcatagcacacattactgattctaagatctgaatgtccttctttgtgtctctaggcctatgtgaacctccttttctggtaccagttcttttgtggattttcaggaacatccatgactgattactgggttttgatcttcttcaacctcctcttcacatctgcccctcctgtcatttatggtgttttggagaaagatgtgtctgcagagaccctcatgcaactgcctgaactttacagaagtggtcagaaatcagaggtaggtgttaaagcaagagtgcttggatggatgcatatccattgtcaaagccagtgtgttttcttagttagcaaaatattgcagtctactcagaactgtttgaaatatctgattgttttaaaagatctctacttatgtggcagatattcacttacttaactttgaggtaaatacagattaatctatgaagggccttatgtacttagaagaagaaatctaaagtttgaatcttacaaccaataatatctaacatttactaaaccccattgccatctattgtgctaactacttaacatcccccgtctgatttatcttcatgaaaacacgttgagacagaacctagtgttggtcccattctaagatgaagaatctgaacctcaaaggggttaagtaattt

SEQ ID NO: 111350 - DNA, 1078 bp, Homo sapiens
gagtcatttagtgtccttacactacctagaacaaccaacagagaaatcacagattcagctttcaggaaagaaggggtccttataatcctctaatatcatccaatccattcagaccaaggaactacatgggttttcctaaaggagtccagtctgacttaaagttcaagccaggatgcaagaacatgtggttgatgtcagagaagtttgtcccacgccccaggcataattgaaattccaaatccacttcggaaaggagggttgagggagattttcagtcaaagtttttatagcctgtgttttaaaagcccatttgtatggactaaagattgttatttgtccttatccttgggagacgtgagatcattgtttcctgttgttgaatcctctcaccaatccttgtacacgctgttctagtgagctggccagttatataaaacatgatcacagcaggcagattttcccagcatgtagctattgataaaaggtaactgatttcattgactttaccttctaaaatttgtcctttctttgaacttggcctccaacaaaattatgttttatgcttgggtcgttttcctgtgttcagtgtcatgaaatatactctccagagctacagaatctctctcctctaaagatgagtctggaagtctgcagtcagaagcttcccttccacgaagcctcacccccatctctcatcacccacaatcttcttttttggctttggcttcatgtccagactttcccctttcaggttccagtggaccccgtgagttaatccctccagcctctcatttatcttaatcatgatccttctctctttacttttgtaagtcctattcctcatgtgactgtgggaaattgtatttctttccttttactctaggttctttgagcaacctctctctccccagatgcatgaagttatattttaacttatccctaagtggttctctcttgtccagtggcattttgcttgcccctttgtctctggcacattctcttccaccattggattgggcttctgctgagattttatggaagaaaggcaggcagaatatccttcatatccaatgaggaa

SEQ ID NO: 111351 - DNA, 1064 bp, Homo sapiens
aaaccatctggctgattttggaagattggattgagaataggggaggaagcaaagagggcagttagatggctatccagccattcatagagacaattgatggtgaattggaatgaagggagtaatttagagaaagagaaatggatagagttggagaagttttgaaacagtactttctgatcagtaggaaaggagaagttagtactaccggctgtatttcagctagatttaaaatttatcctgtaataaaggcaacatgagttgaataaatgttccttcaaggatttttttcatcatgtttacttgtgaacccatcacattcagttacccttatctttacctctgttgacaaataccacttgaagaaatggagctttctctcagagaaacaaatgtaagtactggcttgtgttgtttcttttcttggacccttgttaatcttactacctccccgttatctgcttcatttctaggcatacttaccccataccttctggatcaccttattggatgctttttatcaaagcctggtctgcttctttgtgccttattttgtgagtctttgttcactcagtatatttgttattaatgaatcaatgatgcttctttgtactttgccaccaatttcagcataaaggagggcagattgctcatataatcaggttgattattaactgactaaattataatctccccaaaaatatatgttaggtaatggattaaatttagatagacatacatagtttgagtcctcttaggcctcttgttaactctgtactgcttaaaaatttttatcaatgacttgaacaaaattggatgtctggctatataattagattagtcaaaaatcagacaggctgggcacagtggctcacacctgtaatctcagcattttgggaggctgaggcagttggattgcttgagttgaggagtttgaaaccagcttgcacaacatagtgaggccaccatctctacaaaaaatttaaaaattagctgagtgtagtggtgtggacctgtggccccagctatttgggaggctgaggtaggaggattgcttgagcccagga

SEQ ID NO: 111352 - DNA, 1725 bp, Homo sapiens
ttccataagggacatgagcattttactaggcttggaagagctgacatgatgagcattattgtatgtttgtatatacatttgtgatagagggctagagtttgacctagagagagtttaaggaagtgaaatatttaattcagaaccaaatgcttttgtaaaactttttggattttgtaaaagcattttcattctcttagaaattcaagtattttcaaggggagtcatttgagatatatttattttactaggagatcttatattctagggaaatgctttaaatggtcaggctccagtcggaatttttttaagaaaaaagtagtttttaatacattggttaggactcagaggaaatacggaaaaaacattgtagatggttaatttacagataaaatcccaagagccttttaaacaacaaggtacctaaaatagggtataattatactgcttaaaatacagttagtgcctattaatagctttttatttcctatgggaagatgcttttggtcttctggctgaagatgtaggcatacctctcactcatttcaatgttttcctgaggtggagccttcattggaaaggggaaagagggattctagggtttcatcagggaccaggaatgcattcctctgtcaggttccaatcaagagaagaccttttatgagatctgcctctgtatagatgttgtcagttaggaaactgaagccataggtcaggcagacatcagctcagcctgtggcccattgggtgatttcctgtattttaaaactgacagtagcctgatcaaagtgatacaatcaatttcaaaacaatcttccagagaccacttgaaggttcatagtttttacaataccctgagacttttcaggtgttggagcctctaaaatatgagatataaacagaaactaatacaagttgttctctggaggtttctatgaggttcttagaaaaatttggttttaaaatcatttgaggacaggaatgtctatagcaagtttactcctattgcgaatcatgtatgctggctttagttgtaacaaacgattttattctaagtaaggccaggtgctactataaaatcatatattcctgttgaagttcttttgaagtcctatctctatttattatatttgaaagttgtcagccaccagtcatccagaatttccttcctgaatctccatgctcatatgcaatgtctacatcaaggtcttcttaatgactattattctcagggtttagttttctaccttctgcctactattttggtctgacatttttgtagccttctgttattattggaaatagtctcttacataagctgatttcgagaactttcaaaatctcacatagctaatggaagttgctttctgctttcttatgactgtttttataaataaactgtttcataaataatgtatactggaaaattgtcatcactcttgtaaacatttgccaaatccaactgtaattagtaccagaacttagaaggaaagtcacaaagcatgccttttaccagaatattgctttgccttttcttatatggaaaatcactgatgtcatatcatttattatcctcacagcagctggcattcattccctgaaatcgtcgtctcctgataaacaataatttagagatatgttcacttgtaaataaaaaggttagaatctaaggacaaagaatgatccaaaaatactaaggaaaaagaacaattttcaattttcagaaat

SEQ ID NO: 111353 - DNA, 1049 bp, Homo sapiens
gttcacgccattctcctgccttagcctcccgagtagctgggactacaggcacccgccaccatgcccggctaattttttgtatttttagtatagatggggtttcaccatgttagccaggatggtcttgatttcctcaccttgtgacccgcctgcctcagcctcccaaagtgctgggattacaggcgtgagccaccgtgcccggcctaatcagacattttaatatttagtatcatagtcagccctacagtttgaaatattctcttctgttatctcccagtctcctttctgcttacctaaaccctgaatttgttgaatacaatcagtagtggagagtagtgttttaaaaaatcaaatcaatatattgactatatatcattactattaaaacattacccaaattgatttttatgtaaatggaaactttcaaatcaatgtatgcattgaatttaattaaaatgatgctgtttttatttaggctgaactagaagcttttgaaaacagactgaagggtcgtcggaagaagaacaggaaaagagatgaagtggcagttgagctatcactatggcaaaaacataaatattatctcatttcagtgtgtggagttgtggttgtagtgtttgcctggtacatcacccatgatgtcaattaaaaaaagttttgatcttttaatgtaactcagattggatttagataagttgttaaatttgaaatattagaaaatgtatattatagaacatgatatatatttacattcatctctgtattctctcagctgttgttagaaggacagaatgttaaactttatcttaattagtatactagaaagggcagtataatactgttttaaagtgaaggcatgactgaaactaaaatatttcataaggcttagctagaggcagagtaacgtgtttttgttcattgggcttccttgtacttagttttttcatttaataattcaaaccaacacttttaaaaaaataattcagatgagactgagccatatctgcagtaagagaaatatttcttaatgttttggttacttatgatag

SEQ ID NO: 111354 - DNA, 1069 bp, Homo sapiens
aaacaagtaaaaaaaaaaaaaaataaataatacgcattttaaaatacagtgtaacacctatttacatagcatttacattgttattaggtgttataggaaatctagagtgatttaaagtatacaagaagatgtttgtgtgttatttgcaaatcctccactatttatgtagagacttgatcatcctcaggtttttatatccaaggggatcctagaaccaatttcctacagatactgagggatcactgtatacagcacataatatatacttggtgactgtgagtcaccatttaactgtcagttattttactgtgtctgtagtcctcaagtttgcctgcttttaagatattttgacgttttttatatgtcagaaactaaccacttgggagtagtctgacattttggctcattgaagaatgccactttgtattaaactaagtttattattagatctttttcaagtgtggtttatgaccacagtaatggatatgtgaactaaagtttacatttcctcctattaaataaccatttacaaagttttaggtggatattattaaatacatatatattttaactattgtcttaattacctatgcactatagcatattatattacattattatgtgtaaaagtttaataagtacttagcagtaggataaaaatccccatttgatattgaatgcaattcagttatcgtcttttagtactagtttaaaatttttatgtctaaaatagtcattttgattttaaagcatgaagaattttttcctttgaagaatttttactatttttaaaaaatgtatttggtagagaagaatcgagttctggcagcttttttctctttactcacttgaatttctttcttaaaagccactaatgtttattgcatgcattgtaaacaactagaattataggtatcttcattctcactaggcatcacagcacttgctagaagctttatagaatgctggttctataataattgggttgaagtataatggtgtcaatgtataagaccagtgtctatattttagagcatcctgatttaataagacgttttattttatttat

SEQ ID NO: 111355 - DNA, 1033 bp, Homo sapiens
atttctgtaggcatgcagtagtgtaattgcttggtcatagggaatgtttaatttcaactttaataatatcaaattgatttccaaaatggttgtatcaatttataatcagtaacttttccagttactgaaaagtatcagaaagtttttcaacttcccattgatgaaagttcttcctctttcgcatccctgccaacattttgtgtggtcagcattttttatttttgccagtctttttgcatctcattgtggttttaatttacattctctgattactggtgagtttgaatacgttttcaggattagaggtgttacttttgcctgtgggacatatgttggataccagcacagtgtacacctagatgagtttcagttttcctagttgcaaattgcagaatcaattttggcttacttatgggaaaaaaaggagagagaagacgttgtggggagtatatggaagacattggggagcaattcacagattctgaaggaaatgctatacagtcaagctttgggaaaggcaggatctctgcatcctaagggggctttacagtgagatgactacttaaaccaccatctcgctcttttaagtttttagattcccgagagagaaaacctaatagactcaccatggatccaagggctccttttggcacaggcagccacagtcagggaactagaacaggtagcatagccatggctgtggctactgggggaattatggtgaaccaggcagccatcccaatgtatgtcttctacaaattttaccagtatgtggcagggtcaaatgaagggtttagagaaaaaaagatacatttattgaaggcagaagacctagccagagaaaagacagactttgaagtcgtcaatgaaattgtgaagatgagtatgaggtcttttaggaggcagaaagatataacatcaagaccagtgatttttaacttttcatcaacccccagcgcaacagaatactgattaaagtgaaaggcgacactatagccatgatcctatgtattttcaaaaggtcttcctttat

SEQ ID NO: 111356 - DNA, 1008 bp, Homo sapiens
gtcttgggaaacatgaggtaagttacaggcacaatttttaagtaaagcttataatctatactgttacatactagtataactttactagagttgttagaaataacaaagtcaaagtattgttattttactgttataaagagtacaagagtttatctactaatttaaaaaatatgtagtgcctttatttgagaattagcctgtggatatgcattcactacagaatcatattgaattttccttttaggaggagaacattttgcttcttggcattcattactttgaaatattttgacaggttactttgattttgatattattattattcgtgcaaacttatacctttctgaaacttgttctcaaatgatagcagagtaattttggaaacatataatatgtccagaaacgtttgagtaatgtgtgctgtgctgatttcctttattttttaaggtgagtccactaccatgccatgctgtaggaccctactcttgtaaaagagtttgtggaagaatcttggattgtcagaatcacacatgtatgaaagaatgccacaaagtaaccaaaactgatggctgcactggaaaaaacaaggtaatgttcttagattgaatgtatatctgcccatagtattcttgaaacgttttttcaacagttataccataaatatttttctgttttgctttagcttcctgtctctttttttgccctcatcccttctccttcttttcctttcctaagacagctggccttagacagcttggtgtgtatagttctgtgtctttattccagctcataataatgtgccttttaatgtggaaccctttacatactgtacctgtgttaatacataggatatggttttatgataaaaatacataggttatgtatcttcttagatagtaagtaagagtatcacctccatttctctctgttcatatctgagtttagagcatttactctaagttagttttcaaacctgacacacaggatggatgatgttcataattttaa

SEQ ID NO: 111357 - DNA, 1034 bp, Homo sapiens
ttttgagactggatctcagttctgtcacccaggcttttcatggagaaggagtgcagttgcttcatcacagcccactgcagcctgcacctcctgggctcaaatgatccttcaacctcagctctacccccaaccccctagtacctgggactaggcgtgcactattatgttcagctaattttttttaattttaattttttgtagagacagggattcattatgttgctcaggctgggcttgaaactcctgtgctcaggtgatcctcctgtctcagcctcctaaagtgtagggattacaggtgtgagccactgcacccagcctttgtggcttttcattctctaaatgttcttttcagagctgtaatttttagtataatgacgtctatcatccatttttatttcatggattgtgcttttggtgttgtatctaaaagtcataattaaacccaaattacccagattgtctgtgttttatagttttgcattttacatttagagctgtgattcattttgagttaactgttgtgaaaggcttagggtctgcctaggttttttttgcaagcaggtgtctatttgttccagcatgaatcatttattgaaaagaatttcctttcttcattcaattacctttgctcttttgccaaagatcagtagactatgatttgtgtggttccatttctggtctctctgttctcttccattcatttatttgcctattctttaatcagtaccattctgtcttgatcactgtagctttatagtaattcttgaagttgggtggtgtcagtctttggactttgctttcttttgtattgtgttggctgttctgggtctgttatctttctatatagactttagaatcagtttgttgatatatacaaaataacttgctgggattttgattggaatcatgttgaatctggatcaaattggaaataaactacatcttaataattttgagccttcataactgtgaacatggaatattgcttcatttatttaaatctttgatttctttcatcagtattttgtagttgt

SEQ ID NO: 111358 - DNA, 1050 bp, Homo sapiens
taaatatttttaagccttattctggggcaaagttaagttactcaaaaactgtttgttctttcagaggcttgatatttttaagtgtgaccggaacactcttttgtttagggctaatttggccccattactgaggcagtaagtcttctaagtactctacttgatgcccaggtattagaaggtccttctattctggctgtaaggaacacagactttttcccagccttgtgtgatctcttgaaattattctgccttctccttccagtggttctttctcagcttttggattgtttcctctcacacacatacagaccagtactcagccaaagacccaagaagttctttctggagttcttcagagctttttctgtactgctgccttctctgcacaaattctagccacactggcctctctgaactacgaattttgcctactcaactttatgagacagccagattctgcttatgatcttcctccttgtgctatagccagaagtcttcatgtgtaagctgatagcattgcaagacttacctagtttgtttcccttctgttagggactgccatctgtgctgcctcattatctaatacctgaaaactgtagcttcatatcttttatgtggttttctagtggtttgagacaggagtgtaaatctggttgttgttactccatcataactcaaaacagaagtgtctattggcttattcaagtcatggaccacataatcttttcccccactggcaaagtgataggataggcacatagtattactcaataaacacttgtctaattgaataaactatattgcctctttttttttttttgagacggagtcttactctatcgtccaggctggagtgcagtggtgtgatctcggctcactgcaacctctgcctcccatgttcaagcaattctcctgcctcagcctccgcaagtagctgggactacaggcacgcactaccatgcctggctaatttttgagaataaactgtattgacttaattgctttttaataatgtacattttgtttttagctatttttatataatgaaac

SEQ ID NO: 111359 - DNA, 1051 bp, Homo sapiens
tttatttgtgattgaaaaatggattgtgtcttgtatgaagtctttttttgttaacttttaaatccttcattagtgtttattgcattttattttaggtatgtggaaaaacactgccatgtggtaatcacacatgtgagcaagtttgccatgttggtgcttgtggagaatgtcctcgatctgggaaaaggttctgtccatgtcagaaatcaagtaagacttgtttttttttatatttatataggaaatgatctgtcaagccatgaaaagacattcaaaagacgtcctccaggaaacttaagtgcatattactaaatgaaagaagccagtctgaaaaagctacaaaatttaagcccccaactatatgacattctggaaaggtccaaactgtggtgatcaatggcatccaggggttggggagagagagagagatgaataggagagacatagaagattttcagggcagggaaactcctccgtgtgatactataatggtggatatatgtcattatacatttgtccaaacctataaaatatacaacaccatgagtgaacctttatataaactatgacctttgggtgattatgatgtgtcaatgtaagtacatcagttataacaaatgtaccagtctggtggggtttgacaataggggaggctgtgctattgtcattattatgtaataggttataggtgagtttattttaggctgctttgagataaaggcatagtaggatggcactttgagtaagcttttttgactctccacaaataacagcatcatatgtataagactacttctaatacttgtcacaatatgtttatgttacaggtgaattttataattttgtagttgttacagttttttaagagaggtggttttatcctgtcgcccaggctggagtgcagtggtgtgatcctagctcactgcagcctcagactcctgggctcaagtgatcctcctgcctcagccgtctcagtagctgggaatacaggcacctgtcaccatgcctggctcatttaaaaaaattttttgtagagatgggctctccctat

SEQ ID NO: 111360 - DNA, 2362 bp, Homo sapiens
cacttatgtattttaatgatggaagtttaaagtctttcatggtatttgaacttttctttgacttaggcacattcgaattatatctttttttgggctgggcacagtggctcacgcctgtaatcccagcactttgggaggccaaggctggtgaatcacttgaggtcaggagttaagaccagcctggccaacatggcaaaaccccggatctactaaaaatacaaaaaattagctggacgtggtggcgtgcacctgtattcgcagctacttgggacactgaggcacgagaatttcttgtacctaggaggcagaggttgcagtgagccgagattgcgccactatactccagcctgggtgacagagtgagactttttctcaaaaaagaaaaaaaaaagaattatatgtctttttgtgctagatgttgagaattatgaaattctttattttcaagtttattcccccttaattctaaattgtagtcatgtttcttgcggtattgcatgtctataccctgacttctctcttctgtttgttgttgctaatatattttgtttatttgtaaaccacaaaacaaaacttaaaaagttgagctttgtgaaaagcagagtgaattcctcaataaagttcaggtggttagtagaaaactaatgttactttctttttgtagctgtattctagatatgtgctgtttaattcatggtaactagccacatgtagctgtttcagtatttagaaattataagaaatttgattccttcctcagttgtaagcactagccacgtttcaagtgctcacagtatgtggctaattgctactgtattggacaatcccagtataaaactgttccatcatctcagcacattgtattgtgcagtgctgttttatatggttgaaatagattttaataagatcttgttttttcactaacacaaagatggagcagagttccttaacataaaactaatttaacagaatatactctgttaagtatatttctgtctctcatgttgcttttaaaggtgaagttagctttaataattttcttcttctttgtagtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtgagttatatattgcattttaaattgtttgtgggtgattatttcttcttatattgaggcaaaaaaaaaaattgtaaaagttgaattcacagtttagtttgccatgagaaaatattgaaagttattgccttttgtaaagtgtcagtaaagaaagttctagaaattattgataggtgtagaaattgaaagttttagtttctgactttagattttttttttttttttttttttgcttttactgaattctaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcaggtaaaaggccatacccattagatttttctgactttaagcaaaagtcaaagcaatctttattgcttttatgtttctgtgctaatttatcattctggttttaggaagctgtcagccttgtccaagagttagtagacaaaagtgtgtctgtggcaaaaaagtagctgaaagaagttgtgcaagtccactatggcactgtgatcaagtaagtttatatgcattttgaggggtgggtattaaagagtacagaaagcatagacaacctagaaagcagcaaggctaatcaggtttagttggataaaaggcaaggaagaatagcaactcagatgaattatatcatgttttaagaaactacttttaaatttaatatcatttttaattattagaggaaaaatttttttcaaagtaacagctatttgttgagttttggattcactacatttgtactctttcttgctagctcttgtccccttcttctctttcccctctcttcaaccagcacgcctccctgcttcttgaattaatccaattgaggaagtaagattgattttataggttgcttgtcctagaattggcatggttttaatgccacttagaactccttggtgaatggccatatggagctgcatgtagtttttttctgtattgtacttttaaaatatactttttggtgcataggaaatatatgtgtgtgtatacatatgtatatatgtatctatata

SEQ ID NO: 111361 - DNA, 1074 bp, Homo sapiens
ttattttaattttaattttttttgagacagagttttgctgtattgcccaggctggagtgcagtggtgcgctcttggctcgctgtagccactgcttgtcgggttcaagcgattctcccgtctcagcctccagagtaggtgggattacaggtgcctgccaccatgcctggctaagttttgtatttttagtagagatggggtttcaccatgttggccaggctggtcttgaacttctggcctcaagtgatccacccaccttggcccctcaaagtgctgagattacaggcatgagccactgcgtctggccagtggtgtagtttttaaaaacatttagatgtgctagttacttttagaagagtatgtaaaaataattctcagcaatctgtgagagattttattctcctgttaccagtggggatattgaagttaattgaagggaaatgacttctgactcctcactcttaagtagtggagccaaaatttgaaacctaggatttcttacttttaaattcagtgctttttctattcttccacctgagttatctcttatgacctggcttttagaaatattatttttcttttcattgaatacacactttttggaaactgtttaacatttcaaagtatatttgttttgctcctgcatattatttactggtggtggaggaattttagtgtctaataggtacggaattaagccaggttttagtttagagatttaaaccttatgtatatatttttttaccctcgctcttctcacttctgttttaagtagtcgttttgccacagaggaggaaaggatcagttaaaaaaaatgtactgttaacttctaatttaaaaggaacaacagtttaatcagctgtgccatatactttgcattccatatttcatatttttttaagaaaataaatgaccattctggttaagaacccattttgtttaatcctcatcaagatggagctagaacttggtaaaatgttaataattttaagttattttatggaaataaaaaatttaaaatataggtttctactaagatactgctttttaatgaagaagatctagcataattacat

SEQ ID NO: 111362 - DNA, 1247 bp, Homo sapiens
aagattttgaaggaaaacagggaaaaatacttgcaaatacgtttataacatacactactcagacaggtactgatcttttaaattttgacttttgacgtcaatgaaactgtattcctgacatttttttggtaatgcctttgttctatatggaatagattttatatcttaagatgagcactgtatgttatagagttgaatttttgtacactttggtatttgagttatatattgtgtaacactaatttttctataaagcaaatagaatggcagtggctcttttatagccttaggaggcctttgtgtgtatttaattggcatttcagtagaatgcttggatggggctgctaaagctcctgagcggtggactggggcaagttttttctggttgtgatgatttgattgaactagagtactttgtgtactcctttcaatctattcattttttttcatcatgttaaatgcgtcttgaagtctttttaattctttatttccttattttatatcttatttacaacatctgattttcatgtatttatttttagagttggggtcttgttctgttgcccaggctggagcgcagtggtacgtagtggtgcgtagttcactgcagtcttcaactcctgggcttaagtgatcctcctgcctcagcttcctgagtagctgagactacaggcatgtgcactgcacctagccgtactttttttaaaaaacctaaatttcctcaggtttgacatgtacattcgtgttatctgtggtttatatctgattgctcttaaagccacgtttgtttatgtgagagagggccaaagtgatgttgctgtgtaccactttagtattaagtgtaaaaatagattattttaaatgtaaatattattaaactttctgccttttatactttaaaattattattagaaatattcttgtatgtaggccaggcatagtggctcacgcctataaccccagcactttgggaggccgaggccgggggatcacttgaggtcaggagtttgagaccagcctggccaacatggtgaaaccccgtctctactaaaaatacaaaaaaattagctgggcatggtggcacacacctgtaatcccagctactcaggaggctgaggcaggagaattgcttgaacttgggaggtgaaggttgccgtgagctgagattgcgccactgcactccagcctgggagacagagcaagactccgtctcaattaaaaaaaaaaaaagaaagaaagaaatattt

SEQ ID NO: 111363 - DNA, 1128 bp, Homo sapiens
aaaataagcattatcatgttaacatctaaaataaatcaaagcccttcctggttctcactagctttattggctacaagaacgtgagtaaggatggaggtaagaaagcaagcttccaacttaattgtctttgttgcttctggcaaaagcctttaaaacagcaaattagattatttccaacttgatggaattgaaaaagaacaacaacaaaaaaaaaacctgagaaggaagagtggtaaagaaggaagtatttgtttgacaaaagtacctttaactttcaggctatattattattagcttgttatgcagaattgtcttgccttcttcatttcacgttggttagaagggattcatccttcccacctttggcagttcagatgcaggtttcaagtctgttctgtgttttaccaggaattattacagtgttatcctgtaattttgaggttgatcttggttgtaggttctttttccccctctctgattcatgctacattttcctttttaaatatgaacactttcactttctgtcctgcagagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgtaagttgctatcatctttctggctcatctttttgtattaagaagtggccccttaccaaaaacttggtagtttcttttcctatagtaactatatatatgtcttccttcccaggaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggtaaccctagccacccatattcccactcattggctgaattcctttgtaacactggctcagcaaatgtgcaatgatgtattaatagccaatttttg

SEQ ID NO: 111364 - DNA, 1083 bp, Homo sapiens
tcttattaaacaaaaattatgggaggccattgttttggactgagctcctgtactaggccccaacaaaccagaccaaacagaaatggagtcacccatgctaaatgctgcataatcaaactgaagctttaagggagcaggtagatccccaaatagaccattttcccccctgaaaacagaagattacagtctacgtgaatcagtttaataaggaagtcccctctgttttaatctttaccaaaaaaagtaacctgaagtaacttgatgttactaatcagctttttttttttcctattattctgtttccttgttcccaccttataaaatccatggttctgccctggcccagtgggagctctcattctattttacagagtagaggctaccctgactcatgaattgtgagtaaaagtcacttttactaaatttgttgtcattttgtctcttgacagtctctaaacatgctttacattgctacttcttgctttttcaattgtagatattatttattggtttcctccttcttctcctctgctaccttttcctccttctcctcctactaccatggaggaaatagctctctttcataaagtactcccccacccacacgggagcatacttcctgctctcacacccaatgtatttatattggtagtaagattatcactattgtttacctgattatgacggtgtagttgttatttgtagcagaactctgtagcatacctgtgattatttttccttttctaaacaattttttgttttcctttggaattattttgttttttaaaattggctaaattttactaacttattataaatcttctccccatacattcagttttgtttcctagaagaattctttggaagaacctccttacttgatccaatccggactggttgtactcttggccagctgctcagtgtcattcattttgggatttcccttcatcatctattgggggagggggtccctttacctctttcttatgttggaatgtttgtttcctaaattcttgtggtttttgcttttttggtttcctgctttgttttggtattttggctacatccccaagtagctttttg

SEQ ID NO: 111365 - DNA, 1027 bp, Homo sapiens
tgtaagttatcacttaccctgcttttcttatgtgggctggacttcaaggtacctagtggttgatgagggaaagttctttatagaacaattacagttaataaatgcagaaagaatgataaattagaaaatgactatttttgaaatattttacaaaatgatgaatctaagtaaaaatcatcagtggtttctaaaaccattaggtgaaagatagataaggatccttaatactatatctattgatgaatcaggtcaaccacatttgaaccacatttaattgatggataaccagacattacgtgcctcttgctgtgatacaataggaagtatagagcatcatatatagagtatccttgcctaaataaataaatcttaaaaactgaatcaaaaacaaacctctaaatcttactgtcagtttgtaggaaatactattctgtactcgctaaaatgagaaagtgagtctgaccttagcaagcttagtgaagatgtagaaccctggaaactctcacaatctgctgccaggaatgcaaattggcccacgcagtttgaatttgacaacacacacaaaatggggaaaatcacctccttgccactagatggtgcttattggcttttgagtagtttgttgtattgttttctgttacattgctgcattcctctttttacttctgatggatcactggaggaacggactgggcactagggactagagcctcaccagaatgttgtcactgggatcccaaaagccgtatctgctgcggaactatgttgcccctggggacacatctctgagagttgctgcttgccctagccacttacattattcagttccttaacaatatctgtctctatactgtgtcgagggtatttttctgaagaatatatttttcaatacagtcttattatttttaattatttcacataatatctgtgctctctatttaacttttttaagataactttgaaattataaaatatggtacaagaaaatccttcatacacttcatctaggccccaggttcaccactta

SEQ ID NO: 111366 - DNA, 1872 bp, Homo sapiens
ctccggcgcggcgtctcctcggggcttccccttgggcctcagcgccaagtcgggcggcgggcccgggtcgggcccgaggcggacgagtagcgaagagctgcgggacgccacctccttgctagcggcgggcgagggcggcttgctggacgaggtggagccgctgcggcccgacgagctggagcgcctgtcaggctgggaggaggaggaggagagctggtgagcgcgaggcgccgggcaggagctgggcggggacgggcccgggggcggagagcgtcctctgagggtccctctggtcgggcgcctcgctttgtgtagccgggtccgctctcctgtggcgacttgtggttttcttgctttggcagagggaacgtcagctggagttgggggttcgaggcgtgcgcaagtaacagggttgtagctcgttgtcctttggattgtggaccttctgagtgctggaccctattggggtctgtgggttggggcagcttgagaagggctgttcgcctggggaggagtcggaggtgggaaactgctttgtaggcagggatcctgctttgtgtaagatactggctttcggatggtggccctgggcattctggatgtaggagaggggtctgcttgatgaggtatcaccaggtgtgggggtcaggggcagaccagagtcgtctacgtctatgcagcggttggtgtttgggacccatttctggcggggatggggagaccgtatgaatcagcactcccctttgggtagtggggtaaaccttgctttgtgtgaagagagggcagaggatggtgctgcttttttttttttttttttttttttgttactctgtgtgaagagtcaagggtggaacgagccctggctcttattttctaaaacaagaattgagtctggcgttttgcagagctctgaattgacagttatcacatccatctttcatttccacgtccttctaggggcagagaaaaagagtcctatttaaaaatttaaaccaaagctatattgtcataagccacttcttgatgaaattgtggcccccccaccttaatatcactttcataaataggacatgggaggcttttcctctcgttttattataaagatgtgtgtgggcaattatttgtcttaattcatttttcttaaagttttaacttttagctaaaatgtctctgctctattgaaattaaaacttctaacagtgaaatcgaaatcattcatagactctggtattgcagggctggaactttgcagtgttctgaggtagttaagagctttcctgggttcgcccctggttttgccacttactagcagtatgaccttgagcaagttactctgaggctcactttcttcttgtatttgatggagaaaataatagcacttacctctatagagttatgaaaatttagtaagataattatgtatgcatttagcgctggatctggcacatagtaaactgtctaaaacaagctgctatttgttactcttaagcctagttacttaaatcaagaaacagttcttatatgatgttgtaggagattctggtgattcttaagtgttgatccctgttcataaggcagttatagtcttgttgagaactaagttttgtgcagttaaataaactagaaagtgtacagtgaattacccaaagagtgatagaacaaagagtactgacagtgctcagtaactgggaaaaaaatagtagtccaaagtagttgggccagactttgaggaggaggtggcttggagtctgaaagtgaggaaagagcgggaagggcattttatgctcttgacagctacaagagcagagtcagaggtatttgtaactctcaggaagatttgagtaacagaattactcttgagtatatgatgac

SEQ ID NO: 111367 - DNA, 1209 bp, Homo sapiens
cacattgcatgtgactcctgttgggctaattttcagtagcaaaaatgaatttgtaaaataatgtaggttttaaggctttggtaataataagttcttatttcacctctttcatttactcaaaattacgtcttctgagatcttttgggatcgaagttatggaggaaatgaacaactttaggacaaactagcttatttaagaggaaggctttaaactaggtctttaggagtggctcagaaattgcagaacagtttactttgatctgggaaaggtctcacattctggaataaaatagaaattagagactttagagaaaaaaatattgattctatctccttgaaatatgaagaataatagatgcaatataatgtagtaccacggtatcagatatgaaattcttgaaagtatttggaaagataagacaaaggaagttgtatttagttaaaaatcaggtttataattcatgaggatgaatcaaatcatctcccacttctgcagtgtactagactgaaactcctcccccacacatccctctcctactccattcaggagcttctgctcctctctctgtgagacagtaagaaagtacccaattatgtgtggctcttgaggcttattttgtttgaaaagtgtgaatgagaaccaggagtgggccaagctagtctgtaagtgacccttgactccaataagcttgaggaatgggatttaataggtactctcaagttaggtttttagtatgcatttaatacctaatcggtactatattctatagtgataatcagactaaattgtgtgtttttgctaatacctatttagtagatacagaaagagtactttagtaattttaggctttgaatgcttatatcttttgagtgggcctgctcatttctcctctgagtgggagataatgaatcttgtgttgacctgtcacagtgaaactcttatttgccattggttatacttaggactgatggtggagtggattaagaagcaaaacccaaaaaactgatgaatcctagaaacctgaatctagaggtttggaacttgatgagcaggcacggtaagtcttgatggtagtgcagcctgcgagtgaaagaggctaacaacctttatgtgaggtgtaataatctagttatatcttaattcatcttcacatttctgtctaacgccatgtctggccagtggtaactgctgtataaatatttgtttaa

SEQ ID NO: 111368 - DNA, 1032 bp, Homo sapiens
ttatatttttctcattcttacctggtttatattttcacaaagttggtaaaatattttaattttattataactcaaaataattttagaatctataggaatactacagatagaaaattctgagatgacaattttttaatctttactgtgttaataaacctttgttatcagtgttttgtgggttcgaactttatgtttctgtatcttttccaagataatttatttgtagatgctttatcaacagtatgaaaaagtgttaattttttaaacctaaatcattaagttgacaaactattaaaagtcattatagcagtatgcattatcatcttggatttgaagaatatatcatttgctgaaaatatgacgttttagccaggaactaacatgttctatgggtaagatcctgttttagccactaaaaagcaaagtactctaaaataaactgcatggattatgcatgtttgtaatgtttatatgtatatattatatatgcacatatccatacatatacccatgtgtgttttctatggactaaaaacttcttgtgttagtaattgctatctatatatgcagttgtagctgaaaagatctgtactagtagctgaaaagatctgtactagtagctgaaaagatctgtactagtagctgaaaagatatgtactagtagctgaaaagatctgtactagtagctgaaaagatacgtgctagtatacataaagactgtattgcagctattgccacaatttgcaagtctggaatagtttgagactccctgtcttcctgatgtcttctctcaaaaagaagcaactcagtttctgattgatgcagtctaggttggtctcactgtaactagtgtttcccagcattcccaggtgcatagttatggttcagcactagaagtttgttttttaaagacttaattctgaacctcaagtttagtgacacttcaaggaatatcaaaattgttttgattctcttaaaattaaaaaaaccatgccatactggaatgggaataaagtgagtcatgaaatgaaa

SEQ ID NO: 111369 - DNA, 1025 bp, Homo sapiens
ggaaaacttaagactagaaatttaaataatgaggaatgtttagcatatagataataattgatgtatgattgagattccttaggagaaagaatatggcatagactgagaagataaaaaggcttagaacttggaatgctagtgattaataactaagtaaaagagaataaactccagaggagatggaggaggaggaaaaaggtagaatttagcaactgtatttctgcacaggttgatagttccaagatcatgccacatactgcatactaaatatatataaaatattgttttatcttgcatcttgtctcatggtgaatatgtacaaaactacatggtccaaattactgcactgtctaactaaacagaaaacatatgttcctcctccccaaaaccactactaccagtaggcaaaccagacatttcattcagctgatttcttttctttaacaatcctttccagtttttaatatctatcctttttttcttttttttccttttttctagtcaccgtgtactacctagttcagtctaacttattaaacatcaagatttctgtcattttttctccttacactgatcagatcatatcatatgcttgatcaaaatcacagatagttttatcactgctactaaataggcttagtggcctactaaataggtttagaaacctactaactaggtttcagacttctgagcgtagtgtctcaggccttccatgacctggctccagctggttttatctgttttgtccctgccctgtgctttatcacacttacctgagcatgctctgcatttccgagacactgcttttgttcatcttataaatactgagtaaagcacatactttccccatcctgtcaagttactactcatcctctcaagactgcttcaatgcctctccttccaaaaagccttacccagtttctctcagttgtaatgaattactcctaactcttcctttccattgccctttgcacctttatgatagtactcatttcattttgccttgcaatgtttgttgactctgc

SEQ ID NO: 111370 - DNA, 1012 bp, Homo sapiens
ctcaaccccagtgcgacctcctatagtcaaacagcttatacttcctggaaattcaggtaaggagaaaatgatatggagctattaaggaatgttttttagcttactgcactgtatcagaaaataacattcatctgcagttcgagttcattttatttatgaaacttttaactggttaaagaaaatatcgttgaggagcaacttagcaccaggtactatattaggcaccaggggtataaacataagccagtgtgctaaatacataaaattttctttagcaagtacctaaaagtttgtaagtctggcttaattaaatgggttacaaatgtgattcttttaatcaatagatccttattgaacagcctacttgggttgtaaaaactacagagttaaaacctctttataggaattttaataaactttgatactgcagctaaataatagtatgaggttagaggtgaatgtaccagcagagtgagggggcagtaaatgatgtgggaaagccagattgctataaaccagggaaagaatgttctgctctgagactgttattgtgtagcttactcttcacgaattcacaattcacccatttatttactcttattgtcgctgaagctgttgttatgactgattattataacttccttaaaaattaaggttaaccacctcaaattttgacctgtgcactccctagtctaatgatcctattctttgtgtagtatataggttgttacttgctacttacttcacctatgatgataccatgttaaaaagtttaagctgcaatatttgtttaaaataggtaatttcgttcaggcattatttgagcctgaccttgtagtacttttcctatcatgtgcactctgctcttttttcattaatagtataaagattaattattttgtactcttcttgctctccttacatgcttttcatgttggagctgactgttatggtgaagaattctggaaaacaagtgtttcagataaatctgtaatagaaatattagtgacag

SEQ ID NO: 111371 - DNA, 1026 bp, Homo sapiens
tatccttcttatgctttcatgtatcagttatttaaagagaagtgaaaattttagatatttgttttatgctgaaaaaccgttttttatgctgaaaaaccgttttaaaccatagctatagtaaaatttagtgtttattagttgctggatgataatcaaagttatattacaatttaaaattttctatgtaggatacttgattctgccagtacatctgtctatacaaaactctggtctctccagaattttaaaataagcaaaatgtaactattaaaaaagtaggtgtagcttttgcttatagatactagaattagaaataaaaaccagtagagcatccaaaaatatatgtcccttagtacgtaaattttctttaataacctccactttaaaaatacctaaaagtttgattattacataattttagaatcatactcaaaataatccattgttcaaacctgcaatatattaaatctgttatcaaagttgaattgttgaagttcttttctttccaaaacaaaagtataccaggagaactcttggatgatctcattttatttctgcatctgttgagataagatttctggttttgatttgattttctgtgtttgttaaggctattttaatgaaaaaatacaatattgaatcaatatgtatgccaaattaattcatagtcctaatcctacttatagattaaaatttgagataaattgccagaaaccatcactttttaagaattgatcaggacttgtctctttaaattatctttcagaaaacaaattcttagagttaaagctaaactcttaaacagagaaggtgaattttagaagtatagtagaaagaacacatgtagattataatttttaataagttttggtcattgggtggttactaacccatgaatgtgacagtatttgtattcaactattatttgtaatagatacttgagtttttattttgtggcaagtagtatgttaaatcaatacaggcatttctactatagcacaaaatatgcactccttaaaaacctca

SEQ ID NO: 111372 - DNA, 1108 bp, Homo sapiens
gaggtcatggatacatgtcaatttcttagtttcatcaattaaaggaaggaatgttcgtgagagagtttttcaaaaggctaatgccttgctttctaagactgttaaagcacaggtttagcagaaagtttagtttccagaaagtcataggaataattggttgagaaataagggaagggagaaaaacccaacacaatctactgatttaaaaaatgatacccaaattttatttgtttgtaaatgtttaagtgtattatttcatttaaacatcagaaatcatttatttttatagaaagggaacagagatccatataaattaaatgaattgtacaaggccatataactagggaagtggtaaaagcaaggccagatttctccctcttcccagctcctccctgagtctcctattttcctcttcctcattgtttggatgagatcatgctgacctaattacaaatgagtgcatcttggaaaacattcttgaatgactgtcagaccatgatttgagattaactgtaagtattttgtgaattaccacagacgagtaaaataatttagtgagatattatccatttgcttacatttagccaaacaaaagaatatttttgcatggaatacagagtataccccagagaaaatgcatatagcatcaacattgtacttggacctcttactgaagagagaaggacgactgtccagggcagttgtcagcttatgcatagccatcctgttatgagaccagtgaggaaggaattcccatccagatttcacttactaccaaaacactagtagattacacttgaaatatacataattttgaaacacaaattgaaataaataagtcatgattaatatgtgtaatgtgctaatctaagaatgaatgaaacatttatagaacatctatttaagtagtacagtgatgttggctcagttatctaatcacaaggacactttataaaggtagtttttctggcctttaccgctggaaattttgattgaatgcccttgggatagggacccagattgtgtattttagaagcatctcagttgattctggagcacgttcaagtttgagaaccagtgggttaaaccctgactttggtggaccttg

SEQ ID NO: 111373 - DNA, 1060 bp, Homo sapiens
tggccaatatggtgaaaccccgtctctactaaaaatacaaaaattaatacaaaaattaaggcagagccttgcttcatcgactatgctgaatggagtgcagtggtgcagtcacagctcactgcagccataacctcctgggctcaagcactcctcccacctcagcctcctgaatagctgggaccacagacacaccaccatgtctggcttgtgtgtgtgtgtgtgtgtgtgtgtgtgtgtgtgtgtagacagagtctccctgtgctgcccaggctgatctcaaactcctgggctcaagcaaatcttcctgccctggcctcccaaaggcctgtaagtgctgggattataggcatgaaccacctcacttggccaagaaatcttaattctttctgataatatatcaagtatccctttatcagcccaataacatttatgcagcctagctaggtttagagtgacaagagctctctttttttgcacataaacactaaaggtatatgaagtctgactttcaaatcagcagagtaactaaaatattttagagctgcttaaatacactggtaggtgtgagagtcatcagtctgtcagagccatagtaactgtatattggggaaattggaaccacttttatcttggatggccctgagctgctgcttacctgttaattttgagtttcagtgcagttaatagattaggagtttggaaaaaagcttagctttcctcatggaaaactttaaaaggtagagatggtctgactcctccaaacccctcaacccacaccagcattacatagcatgctccccacttgcatacgtatgtgcacagcttagatatccaaagtctgaggtaaaaaattagttgtactctacaagatgatattgaacatattaaagttactagattgtgactcgccaaggacctgctgggttctgagttttcttctcctttttgagtatgcagattatggtttcacattagggcaattcatctaacaataaccgctttgccaaaatctgctttttttgcgttgaacaagtgctgcacttcatactgtgtgcttgtg

SEQ ID NO: 111374 - DNA, 1048 bp, Homo sapiens
aactacagcctcttactcagtttaaaatttcagcaaatgatctagttaaatcttaagccatttggcatactgagtcagtggtgtctgtaaggcacattttagtcttattttaaagaataataaaataatgaggatttattctgttatttggataaatccagaagaaacattttctacagaggtatgtattgggttgcttttctgaaaggagtaaatgatatatagagaatatatttttcttacccacttaaaatgaaagggcatcatttcaactttttgccaactgaacttcataagtgctttaaaatgaaccaaatgtcagacattctgtatgttgatgttttttcctcagacttcaatttttacttttacttacctgtgtaaaatgggaacacttccacattagaaggtagttgaagttaaatcacaagttgtggttgattgataggtctggaatgtttatggagtggtagctttcataataatagttgaagaaatatatgaaggtcggacatcaaagctgtccaatattggttccaagacactgaatgtatgggcagctagatggaagtagaattaagagaaaacagtgggattggatagaccaacagtaataaaaacaaacagaggcctcaaaggaaatggtatgaaacaaagaggaaaagtatttttcctatccagaacatgtaggttttctgatagctttagatctcactaaacaaccaaaatatgtaacagagataaagcactaaagaaaattacgcaggaagaagaaattagattttttttgaaaaaaaaaaggaaaagaaaaaatttggttacgtttacaaaagtgctataatagaagttttggcaaatttattactgcaaatgtttttgcactgatttcttggattgagtataatttaaggaaatagttttagataataggatttgaaggtaagtcaaataggcaaataaaaaagcagaatgtatgaatgtttgtattttgaatatcagaagttgaccatgggcctccaatatgaatgttttttggtgccatggtcag

SEQ ID NO: 111375 - DNA, 2504 bp, Homo sapiens
cctaatggatgccaaagagaaatgcccatttgtaaatgagaaaaatgcccatttgtgcacaagaaaatggtgaattcaggctatccaaaacttcacattcaacctaatttactgtataaatagtatcaataaatatttgtgttaatgagaactaatattctgactaattatctaaagtgtttcactagtacaccaggaaactacagattgagattagggggtgggaggaaagaaacctgggctagagattaaaacattcctaaatttagcagaatttcagaaatgatttttgcagattcattagaaaagaaaaattgtcatttaatcttaagttttggatgtagctcacatgtcaccaccaccagatagtgttacagcatgtatccatcatgttgcattgacacatcaaacttgtgtgtgtttgttttgattgccaaaagggcttaatatcagttgtacaatctttctgaactttatagttcctggctcaggaaagatggcctttgctattgaagccaacttcttcacatgctgttatctttacagaactaagagatcttgtttctattagcaggttttcatgataggaaagaacaagtagtgtgtgtctttattcttgatacaacaccacctcggtgcttgcaacctggaacaaaaccataccatgagagagagggggaaaaaaatctatgcacttaacctacaaaatctctggtgatgacagttgtattgttgctattacatggcataacggtctattatgtggtaggaaaatatagcctgctaaatcctacttaagttgatccactttaaactgagtaactgtataaaacatctattgaaaattcttttccttttgacttagattctgccttacatcaatttttgcatttttggtaaaaaaaaaaccctactacgtatgactctaacctgatacttgctctctaatggctcttaatatatccttgaaatcggctatttcaattttatcagacttttaccagagtaaaacttgcttctgtagcaggcctctcattttttattatgaggtctgtttttaaatacttaatttgaacagctctaagatattgtcacttaggtcatctaaaagcttttagagatttgaacataagttcatttcctgttaatcaaagacattccgtaagttggcaaaagaaattgggagagagaaatagaaggcttgatattctggacagcattaaggttgataggttgatgataaaaacttaaaaccaggacctccattctgtcatgactgacaccatggtagtctgtcagcttgaccagtggagagtcattcatttagcacaagcagctggagatttaaactgccagtactatgtatttggtgtataatgcaaggaagaaactttatccttgaatttgagggtgatggggtgggtcaggaaaggatggcgccagaattctacatgataatgaactaaaaaatgttgcttttcagaggaagataaagcatcttcttttgggaggggggtatctcatgtctaagtaagtaaaagaaagaagtagctactgtctcttttaaaaaccacgtacaaaacagaacaagtctcagttttcagtgcaacatttcaaaaaatatatatgctgcaatctaataattaaaaggaattttacctattatgaaacatattacattttttaagttagataatcagtttcaaaaggagtattcaggttatttaactttgtttttaaatggctgcatcagaaaaaaatgtctatttttttttattaaaatatttcatcacttgttaaaacatatttttgatctgagtttggtaaagtattattttacctgctgttgtactaccacagactgttgacttttagtttcttaaagagaaaaattgcctttttactagaaagcctttgtatattgcaatttttctgtttgggaaaatctaaggatttactgtggttagtcttacagaagaaatgtggatttgataaactagtgcctatgattttaacttatgtttgatatatagtagtaagggttttatgaatgttgattattttgtgccaacagcccagaattgtcacttatatgtaagcagaaaacaatgagctctgcttccaaagttatttaattttctcagtgtttgaatgttattttttgtaagtgtgttaataaaagtgtaaagaattggaaaaaatataaatattcttaactcaagcatttgctggatcatttttctacaaaacttgtttgtacaatataaaacactctctgaagagttgactttttttcagtttcgtatcctggaaatcacattttgtaaaactggggaccattcataattgtcagatactttttaaaattatctcaatacatcacttttataaaaaaaaaaagtttttttgaaagaaaattagatacatatgtggccccagatgtttgtataactctagaatgatctagactatgtatgtttaaattaactttttattgaatgtac

SEQ ID NO: 111376 - DNA, 1024 bp, Homo sapiens
ccgaaaacgaagaaattgacatttccaaagctgcacaaactactatagaaactgccattcattctttaattgaaactttgaaaaataaagaatttatatcagctgtagcacaagtcaaagctttcaggtaaaacgtgacgggatttaaaggtgatgcctttaaattagacaggaagtttagtaatactaggttttcattttcaatttgctgtttccatatcatgtctttgtgaaagaaaaacatgagtatttttaacagttgccactgaaatgataccaattttagatttcttttcactttcagatggtactttgaaagtgaattcaggtggtactttgagtaatatttgctcaaatattaaaacagatcatgttattcacaaggaaatgttgttgttacaggtatttaacttaaattgagttagtcttaactattgcctaagtctcagaactgaaaaactattgtgtattttcagatctctctggcccagtgatatctttggcagttgtgaagatgaccctgtacagacactgttacatatatatttccatcatcagacgctgggccagacaggaagctttgcagttataggctctaacctggacatgtcagaagccaactacaaactgatggaacttaatctggaaataagagagtctctacgcatggtgcaatcataccaacttctagcacaggccaaaccaatgggaaatatggtgagcactggattctgagacacttcaggcctttaggaaagaaactaaactgaagatgatgaagaatattaaccaagcaccttttatggacccttgcattcactgataactttctggcagcatctactttttagtgtaactaatgtcaaactgtatcatcaaaaacaaagatctgaaagaaaaaaacatctgatattttaacagctgccaatatctcccacaataactgcgtgaagaaggaattttttaattacttaacctacgtgaaaagaaaagggctaaaagtgatgcctacaaatacattact

SEQ ID NO: 111377 - DNA, 1013 bp, Homo sapiens
gatttatttctaagcacacttctagattatatattaagatatttaaagaactaaggtttaaaaagcttcaaggttgatacctttgaggtatgtactggtctggcatgacgtctttgaaaacacttgaggatgtccttcctgaccctcctcaagtcccactgcactcctactctgttccagtgagagctcagctctaagtatgggacagagtagagttaagagaatatccaaaaaccaactaacagctattccatgactgaaaagtctcatgattttgtgagtctcatgatttcaatcagaaatggtaacctggatcaatacttctgatttgacagctgatgtcatgtggtttgctggaaacactcaagtttggtgttttggagttgcaagaacacctggatacatacaatgtgaaaagagaagccgctgagcaggtcagtctctttttaccatgtgcgaaaagtggtttgctcttgacactggaagggtaatcctggcagcagaatagcccagacagaaaagaagacctctcagcacctgcctcagggttttcctgagagcagcaggttctttgagctctctatccagcaaattcctacctttggcttttaaaaatcagtcctctaacagcacaatggaaaaccatagctttgtaaaaagcttctttgtggagactgtgtcactgctgtcaacattccaagtggggaaattgaagcagtatttctcagtgcattagagaattgtggtctaggaaatccacaacctctgacaaagctgtaatctttttcccatgatgtgtacatgtacatgggcaagcagtgggagaaaaaagcatgtagtgaattagacaattacctcctaagaaaggcttcttcaagtccaatctggcattgaaaacagagtagctctgttccttccctaagagtaaatccagcacattttcaattgggagggacagaagaacaaaaaataatttctctctttcacacaaactgcatacagtaggtaattat

SEQ ID NO: 111378 - DNA, 1019 bp, Homo sapiens
aggagatcgagaccatctggccaacatggtgaaactccgtctctactaaaaatacaaaaattagctgggtgtggtggtgcacacgtgtagtcccagctactcggaaggctgaggcaggagaatcacttgaacccgggaggcggaggttgcagtgagctgagatgtcaccattgcactctagcctggcaacagtgcgagactctgtcccaaagaaaaaaaaaagagcgagagagagattgagaccatcctggcgaacatggtgaaaccccgtctctactaaaaatacaaaaattagctgggcctggtggcatgcacctgtagtcccatctactcgggaggctgaggcaggagaatcacctgaatgtgggaggcggaggttacagggagccgagatcgcgccactgcagtccaacctggcaacagagtgagactccatctcaaaaataaaaaattaaaaaaaaaaaaaaaagaaattacatttcagtgtggaaaattcaataataggttcaaggctttatgaaaactgagaggaaagtgatcagctgtgcactgggagtgatggtaagaaaggacaggtttcatggtaactgggacattccaggcagagggacacaatgtagaaagggatggcagtgtgaaatagcatgatgtgtctagctaaaagcaggaaattgagtatttccagagagtaaaatgggaggagggagaggaagagcaataggagcaatgaatgggatccaagacaggagaagtcctatatgccacactacagacttagactttatcttgagataatagacaggagaagtcctatatgccacactgaagatttaagactttgtcttgagataacagaaagacattcaaatttttatcctttcaagagatacctattaagtaacaagcactgtaccagatgccaagatggaaccacatggcatgtgagcattcatttatgtgaccagtatctactgaggcgctacctcgtgctaggcactaggctaggcacggggcccgtg

SEQ ID NO: 111379 - DNA, 1025 bp, Homo sapiens
aagctaatgaatgtgctttctctctgtggtccagaatctggcctcccaaagaacccatcagtgagtaatcatgaagacctgtgtcaaggtcttaaagatcatgttattccttgaagaaatgatctgtctccttgcttgccttttctaatttaccttacttacggtattaactcagaatgaaaaaaagatttcttatctcttgtgacacctggcagccatgctaactatgtgttcaactagttaaacatgaagaccaaatttaagctgtgaattcattgaagaatgaggcctgcggtggctttggggtactgatacctcatacgcagagtgacaaatctgatggatggactttttttttttttttaatcgggcatcaggttgtattttcttctaatgaggatttggaagtcggtgaccaacagactagcctaatttctacaacagaagacataaatcaagaggaagaagtagctgtggaagataatagcagtgaacaacagtttggtgtttttaaggattttgactttttagatgttgaattggaagatgcagaggtaaggatgtgggctttctctgttaatatttatagaacagttgtatgagaattaaggatttgatcacaggatcattccttattgaggtcagtgtaaggtcaaaaaggtaaaaatctaaattaggaattaaatttgattaccacaattagtcaatagaataagtctgagataaaagagaaacattccatttttcatctttatctttaaaaatataaaattaaaaaatggcttccttcaaaattattttcagggtatgcttagacttaaatgttttgcatgatttgtcttacaaactaatatgcagccaaatggtaaaaatttatatgagaattgattaaggacaactttaaagagagttgcacttaccactaaattgcacattcatcaactctcatgtacatatacatatactactcatatacagctcatacacattcatcaattctcatgtacatatacatatactactca

SEQ ID NO: 111380 - DNA, 2380 bp, Homo sapiens
agtgtaaaagaagtttttataaaggtgggttttttttccatgtccagtgtttatatccttatttactgtccttaagtgacatgaaactcaaaataatatacactttacctaattaaaaatggaaaatgggtttttagtggtcctgatcctagagaatggttataatttttatttctacaaaattaggttttagcttagaaatcttttctagaataataattacagcatacaaaagtatttcttctggaaaagtttttagtttgatgatacatttgcttcctatctaaaatatgattttgagacagcaaaaaatggatgataaagtagccctagaacagcacaaaaagttaatatctatttgatgcctaagaagtaactttatacccagaaaagtaaattactaagtagataggcacaaagagaaagtcaaaagcaagagattcctagtcactaaaaatgtttgtcagtttataataaagtaatacctactaaattagttaaggaaataaaacaccatgatttagatgaaaagttatcgtctaattctcctttctgaaccaaggaaaaataacagtaatagactctgcctttcactttattagtctctagatttctaatccacataactataaactcataggctaaatctatgttttccaacctgtcaaatgtaaatattgagtttttattcaacctgattaaagtatactttaatattacttttaacattatttttagctgttagagaaaggattgtccagtatgcagcaatcattactacagattatttatagtctattgagtcatattgacctgtctgcagccccagccaagcagtttaatctggagatcataaagattattggcaaatatgtacaggtgagtgaccacaaaacttacatataacatttttcatctaaaaatgatttataatcacacaatattggaaatgccttaaatgtcgaagaatggggaagtggttcaaccataaatcgtgttttcaggatatttgcagtatggaaaatgttctcaatgtaagtgacaaaaaccagaatcagaattagtatgatttctacttttcgtattaacaatttctgtaatgttctgtaatgacaggaaggaatgcatatacacattgcagcagtcaaaactctggaaattaggactgtgactcattggttgtttttgtttttgttttgagaaggagtcttgctctgttgcccaggctggagtgcagtggcgcagtctcggctcactgcagcctctgcctcctggattcaagtgagtctcctgcctcagcctcctaagtagctgggattacaggcatgtaccaccacacccagctaatttttgtatttttagtagagataggtttcaccatgttggccaggctggtctcgaactcctgacctcaggtaatctgcccacctcagcctcccaaagtgctgggattacaggcgtgagccaccgtgcctggcctcattgttctttctttcttcgtacctttctgttttttaacgagattctacttagtgggcatacactacttttagaaacagaaaacctctttgaagagtttgcattttagagatttttttgtgtgtctgataaaaagtgccagatatttagaaagtggaaaattaaacttgatttaaatgtaaatgatgacaagtcggcctggtctttgctgaatttcacctttgaaattcagttaagctgtcggtttgagctaccagttaagaaagctttgcattgctgagcagatcagtaggatggatacaactcaccaaagagaacaagctcattaacaaccttaatagattaatatgttgtgtttatactccagttacgtttgcattcactagagcagaacttagaatgggaaatacttagctggcaaggaatttattctagttcatatctgaaagtaataaaactgtagtaaaatgttttcagtgattcagttatgtaatccacattacctcttacattcccttgaaaatcagtgattgcagatatcaaaaaaacgggagattttctggtggccctatttatcttgtgtcttatccttcagtgagtgaggctttaccagatagcagttatatctctttctaaagcacatttctcttttcttcttaagccttaaaaaaaaaaaacttataaaatatttgctatatttcacatagaaacatataccacattgaattcactaccttctgaaccataggtacatttcttatgttcagaaccacaagctcaacttgccagtggacaagcagataaccagaaggagcatagatttgtggctaagtgaactgcacactccccatctcaaaggagaaacacaacttagcttcctctggtggttttcatgttagaa

SEQ ID NO: 111381 - DNA, 1085 bp, Homo sapiens
caacaaagtcagatatactgaaaaatgatttttctggtaccagttactatttttcagtgttttcagaagtaaaattaatttagcaaaagaagtgactgggtatgcattcatctattctttcttttttttaagaacctcatatcatgatcctataatgggaaacaagtatgcagctaacaggaaaagcactggacaactcaatctaagcacaagtcccattaatagtagcagttatttgggatataacagtaatgcaagaagtaactctttgagattaagtttgattggtgaccgacgaggtgaccggcggcggagtaacacactggatataatggatggacggataaaccatagcagtagtttagcaaggactagaagcctttcctctctaagagagaaaggaatgtatgacgtgcagtccactactgagcctaccaacttgatggccaccattttttggatagcagcatctttattagaatcagattatgaatatgaatacctcctggctctcaggcttctcaacaaactgcttatccatttgcctttggataaatcagagagtcgagagaagattgaaaatgtacaaagcaaattgaaatggactaattttccaggacttcagcagctcttccttaagggttttacctcagcatctacacaagaaatgaccgtgcacctcctcagtaaactcatttctgtctccaaacatacattggtggatccttcccaattgtcaggtgatgttaatataattgcaccagcactttgcattttatgcagtaaaatgtaaactaatcatttgttttgaaatctactaatttctgctttttgcaaatagtcatagtttttatacgctaggtagcttaaattatttggtaaaagccaaaaaagaattagaagatcgaatatcccaggaaatgaaaagaaaatggtttctgtgaaccatctaaaaaaataactttaacttttaaaataatgtgcaataaaattggttattgtttgcttttttttgttttgataggctttcctcttaacatcctttgcttattgcctcacttaatccagcattttgacagcccaac

SEQ ID NO: 111382 - DNA, 1072 bp, Homo sapiens
taaaatcccattaggaagtccattgcagtttctttattccagagcataattaattaaaatctgcctttttccccccagggatttgtgattgagcttcttctcacattggaatctgcaattgatactttggctgaaaccatgaagcattatgatcttctttctgccctttctcagtaagaatttaaaccaggcaacctaatatagagagaacttgaatagctaactacatatagctataacttttaaaattctaatattgttagtaagcacaatactgcccaaattagatggattaccagtggggagatgggccgcagacagtgaggacttgtgaaaaatccaagtgctgattttagcagtgctgttcttcttctaatgtgctggttagagatctttctaatgcaccacttcattcctgccacattcaggattcagcatcctgtttctcccccagctgtctgggagccttaaggctctcccacctttcacatattgttccttctccctgcagcagcctctctccccactttttctaccttgcaagcccagaattgactagtccttcaagtcccatcccaaatgtcacttcctagctaagcatttctaactccttcagggtagtgctaattattccatcctttgggttctcatagtgattttttcatattgtaataatagcaattagcaggctataaatttatccatttacatatctatcccctctttcaaaagacttgtctaatattccttccttttctatacagctggcaaacataaaaagcattcagtcaatattttcttaataaaaattggatgtgaggaaggaggagaaatcgaaaatttttgagcttagttcttttgaaaagagtgtgtcattgacagaaatagggacatcaggaccatcaagtttgaggacaagacaaatgaagtcagctttggacataatgtatgcctaaatctcagagctgaacgttgttagcgattactatagcagaattttctcagcaagtagagcctcctttcaactcaaaggaaactgttagccacaagagaaaagatactgttgtacatt

SEQ ID NO: 111383 - DNA, 1020 bp, Homo sapiens
ggagtagctgggactacaggcacacgtcaccacgctcggctaatttttggtattttagtagacacggggtttcaccatgttggccaggatggtctcgatctcctgacctcatgatcctcctgccttggcctcccaaagtgctgggattacaggcttgaaccatggcgtccgtcctccttttttaaacagagaaagtgaaacataaagtataaataccattgcaccgtgaactgtgactaacttcagtgatcattcccatagctatgtgcacctggacatttacagtggactaaacagtcatttgaatcggcaacatcacagactagaatcccgatacagtagcagctctggaggatcttatgaagaagaaaaaagtaataaattccaaatgtttttaatataactataagggtgaggtgtattgttaattacattaatgttaataaatatatattttcagtaaattgtttttaaaaagcgtatttaactgccactagtggtgttccaacataatctgaaacatcttgattttaagaagcaacgtaattgggtgaaattttttttaaagcactggtttcctatagataaatcacaaggaacataagaactggttctcaggaagcatcatagaacaaatactggaaacaggctgattttttttagcaggattgctccttctgcatggattcactttttccttaaaagattctcccttggcaattgcaaagtgaataatctacccaagtttcactataacgttaaggcagggtatcatagaagcacaggctttcagactgggaagggacactgaagatgatctggtccaatctcctcattttgcacatgatggaactgaggtccagagaggttaagtgacttacccacgtcacacagaattcacatttcctgacattttttattgcaccccgcagccccactgtggtagagcagagttcctttcaagatggagctgtgttggccctatctcaggatatttagaactgaataacttaccagaag

SEQ ID NO: 111384 - DNA, 2258 bp, Homo sapiens
gcaaattactctgactccgcccacctcacaggtttgtcatgagcattaaaggatctgaatgtaaaagtaacaggcacatcataggcatctcccctatatagaaccaaaatttgtgaggttcctaatgggtcaatttaaaattaatctgtgtataaagatgttcttttatcttttgattacgtttttgttcattgtgataaaaaagcataaaatttgccatcttaatcattttcaagtatgcagttaagttccagaattgtttagtgtattcacattgttgtgaaatagacctctagaactttttcatcctgcagaactgaaaagtctatacccactaaacaacaatcctgcttttccctctgcccccaagctctggtaatcagaattctactttgtgtttctatggatttgactactttaggtactccatatatgtggaatcatacatatatgttgatttgtatttttgtttgtgattggcttatttcaggtaacataatgtcatcaagcttcagccccgttgtggcatatgacaggatttctttcctgttttcccttttttaagggtgcataatattccactatatgtatatacatttggtttattcattcatctgtcaatggacatttaggttgcttccacctacctcttggctattgtgaattgtgctgttaatgaacatggatgtacaaatatttgtttgagtttctgctttcaatttttttcaatgtatactcagaagtggggttgctggatcatatgatagttctatttttatttttttgaggaaccatcatactgtttcccagaaagtatgcaccattttacaatgccaccaacagtgcacaaacatttattttaactgccaaaagtattttgtataaaatgtatgtgatttatgttagctgttaattttatgatgtcgttgaggtgaaatttgctaaaaggaaaaacaatactcataattgttaagtgtaatgagtaaaatgaataaaatctggcttctgaaatctgttggaattaattacgggtcagaggaagctgaaattacatcagttatctttgacttgttttcaatttcagagataagccagagaatccagacagctcaccctgctgggcggcaggtgatgctgcactacctgctaccatggatgaacaacatcgagctggtggacttaaaacctctccccacagcaaggcgacatgatgaagatgaagatgattccttaaaagaccgagaacttatggtgactagtaggcgctggttacggggagaaggatggggatctccacaagccactgcaatggttttgaacaatctgatgtatatgacagcaaaggtaaaatgagttttgtatttataattgctgcacagaattattgagtgagtagatgtggttagaaacagatgaagaggttccataatcctgtgataaccaaacaaatatctttctttaaaaaagactcattagatatgaattttttttactaaaaccatatatgattaattatatttatgtttagatttgttggaagaaattattgtttctgtaaagtgtggaaacgattaaagctatctgtacaaaacattttttaatatttcatggtatgacaagtttggtttttataataggcagtcatgactgaagtatcttttgtgcatattgcatctagtatggcgatgaactggcctggtcggaggtggagaatgtgtggaccacacttgcagatggctggcccaaaaacctgaaaataattttgcactttttgatcagcatttgtggggtgaatagcgaaccaagcctcttgccttacgtatgtattcaagttcatttaattttaaaatatatgtatatatttactagtatcttgtgatgtcagagtatgggcagcagttgcccaggagaggcaaggcaaggcaagggccgggatgaagacagtcaggaaatagcacatggatttattcactgattcagttagcaaatgttatctatcattatgacaggccaggtgctcttctgggtattacaatctgatgggtaatacagaatttatttgttgaagctacatctgatttatttaatgaataaatcagtaagctaataaagtatagtgtgataaaggctataaaaaaattgcagagttctgagagtaaaaaacctaggaaccacagctgtctggaaggattcaagatgacacttgagagaaagtgatattgaagctgaaaccacacactggggatgtttctagtttc

SEQ ID NO: 111385 - DNA, 1636 bp, Homo sapiens
ttaccatatagccagtgatagcccagggagaaatggactcctggccccacctctgtgccagccttcatgtgccattgagcctgccatggaatttctgcttgcagagatgctctatgtcatgtaatgctgggacagggtgacacagactgcaactttgtttctgtgatttgcatatatataaatgatccctgctaccgcggaggtttttgatagtttaaaatgaaaacttctgctttcttttttacactattacacattcaataacatgttggtataaaagttaaagcaaaaagaaatggaaataaatgttttctatctttttttattcacagtgcaccagagaagaagtatttttcctcaacagagccttcgtcacagtctatttatgctgttcagtcactgggcaggtccttttagcatcatgtttacgcccttggacagatacagtgatagaaatatgcaaattaatagacatcaatactgtgcgttaaaggtatttacttagaaacctgatttcttttttcttaagagcagagttaagtatttttaagtctctcagtcactagtattaaaaagaggatctgagagtattaaaatgtttttctgccatattcaaaacttataccataagttatatttaaatacataaaatacaatgaaaaacagttccagaatctactcaaatttgatcaccattatcttaaagaacttaggattacttgaaagaaatgccttttttcccttacttaattactttttcttggtctttttatcttcccttccagtactgttcaaactccatgtctaatttggtatcatatttacttactcataataaatttctcagttttaaaaaataatttgtaaagaaaaaagattaaagtattgtgactagataagtattttgcctcttctcattaagcaaccaacatttaacctcttaaatttgttaaatgtaattctaatattattatttgaaggctatgtctgctgtactgtgttgtggccctgttgcagataatgtaggactttcatcagatggctatttgtacaaatggttggataacattttggattctctggacaaaaaggtaattatgacaatttccttaaaggttcataataagttgtcattgtattatttgcagttaatgtatgttgcactaaaaacaagtcttttaaaaaaataagataggttaggatcatatgcaaaaagcatattatataaagttaaataggatcccataatgtaaaaacgttccaattcttatgtatcattaatttgaataattttcatttccctttttatattataggattaatacagtggtatgtgtctctcaacagggttctaagtcaataaataaaataccagcatagaacatattgagctgcatgggaaaaatatgttatttgctatgtttcatttcgtttttttaaccactttccatttaatcattcctccttgccctccacactctgccttccttactctcatattgtacatatacagacttcacaatttaaaataggacttacattttttcccctcagaacagtttttctattgggttatcaaaaacaagaataaagcttgataaaaataattggagaggttaatgactcatttttctga

SEQ ID NO: 111386 - DNA, 1023 bp, Homo sapiens
tgctgaaggcacaatatgaatagacatggcagctatgaataaatagaactagtctttcctctttctacttttctaaactgatcctccccatttcatatgcctcctgtctctgtatttagaaatctgtgtgtttcacagagaggaaacaacatttagcactgagttgatttaagttagatatggagttgaataatataaattgcaatagcagttcctagattaagaagcaccatctattttcatattaaagtaagcaaaatcatattcatttaattttcatatattaagttgcgtgctgccatgagcatgcaaaattaacatgtattattctgattttgagtattaagaattttttatttaaatcataaagtcccatttacttcatcttttgttttcttcaatattttcagtgcaagtggtggccttgataatgaaacacattttctcaacaacactttattggaatatgtagatttaactagacaactcctggaagcagaaaatgaaaaagactctgacacactgaaggatatacgatgccattttagtgccttagtggcgaatattattcagaatgttccaggtattattttcagtttcttaaagcattattgagtattaaggaaccgtcatattttttctttccttgaggtttaataatctaagttgataaagtaacgtatgaacatactggaaaaatatgtcagcataacctggatggctggagtttgttttccctttgaattattgtcactgattagaaataaaaaagcaacccagcatagaatttcagtaataatcaggatactgacacaaaaacctggagaaatcaatagaataagctctttaggatagccttgttttagatgcaataagcagagtgcagtgtctcatgataattgagaataaaattaagaagatacttttgaataatgggaaaagagtataggccataaatacaaaatgtaacaaggataccgtgttactgatttaccagatatgttccaattattgagtagggtc

SEQ ID NO: 111387 - DNA, 1034 bp, Homo sapiens
atttttctgccatatttacatgttatatcaaaagttagaaattacgaagactatctagtgtattcttctttttaagatgcagacacttcccctccccgcagaagatcttatgcagaaacccattatgtaaaacggatgaaaaattgctttaacttaagtgagggcagaaaatagggtctagaatggagttggcaaactttttctgcaaaggaccggatggtaaatattttcggctttacaggccatactgtctctactcagccctgcctttgtagcatgaaagcgttcgtaaactacataaaaaaaggagtgtggctgtttgccagtaaaacagtaaaaaatttgcagcgacaggtagcagtgggccagatttggcccatgggatgtagtttcacaagactgagcctagattcccaaatctacaggttctgagcagctttcagaaactataggtccagtgggacagatggttatgaaaaccttaattctaacaatttattacgcactcaagtaaaatcatagagaagagattctaagaactacagagaagaaagcctgggactctggttgcagggtaaggaaggcattatagatgaagtgctgatatttcagatgaattttgaagcacgttcctcagtggacaaacaagggaaaaaggtattctaggcaaagaacagcatttgcaaactttacaaagaattttgaaattgcaaatttttctgtgtagttatattatgggggaagtgattgaatattaggctggatagcaagatgagaaatatctcatgaaaaactactagctttagctttaaccagtagaacagtagttcctgtgcctgtggcatctgagagttacctggggagcttgctaaaaattttagactcctgggtctattgaatgagaatccctggaatagggtccagaagtctgtttttgtaaagcatcttagatgagtctgctgtagaacattgtttgggaatcagtgctgttaatgttggggatgccctgaggaatttaagcaggagagggagat

SEQ ID NO: 111388 - DNA, 1050 bp, Homo sapiens
taatttttaatccattactttattcattgatatcagtccacaaaaacagtactagtaataaaaaccttatgctaaccatctctctaattagcattaggccaggcatggtggctcacccctgtaatcccagcactttggaaagccaaggcaggtagatcatctgagctcaggagttagagaccatcctgggcaacatgacgaaacctcatctctaccaaaaatacaaaacatttgctgggcgtgatggcacacacctgtagtcccagctactctggaggctgaggtgggaggatcacttgagcctgagaggtggggaggttgcagtgagccaagattatgccagttgcactccggcctgggtgacagagtgacactctgtctcaaaaaaaaaaaaaaagaaatttagcattagttaaaataaacttttaaaaacgtgttgtgttattcatatctgcctatttttctttttttttccttagtagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcggctatagcattgattctaaagtaagtttctcagatccactgttggatatatgaaatctgaatggccccataaaaataagattttaaaatttctttttatggacaataaagtaactcagttgaaaatgtgttacttacttgcaaaaaggaaaatacctcaagaaagcccatcattgcttttatggattcctagttggaatcaataatacgtacatagttttccattggaaagaaagacccgtgctcattcagtttatcatactcaacatttttaaagaaattgtcatacctattttcccatattctagtttttatagttctcacacttctcagaacccaaaaggaatcatttaaataattaaacgcctttctagaatttccctaaattacgtagtgatc

SEQ ID NO: 111389 - DNA, 1200 bp, Homo sapiens
aatttttggtagtcttccatttgggttatttgattgttttatccatgtcaccagtccctgtttcacatagacagtaactgtgctccttaaccataaaagatgctcaaatcattgatttatgataatgtgtaaatcatagaaccttgaaattttagacccgagccattgaagccaccctagcttctcaacctttaatgagcatgcaaatcaacagggccctaagaaagagtttcaggagtttcttagaagctctcaggtattgccaggctgctggtccacactctgagtgtgaaagatacactacaatcccctcattttccacatagaaatcagatgaagagcaactgtcagttccaaggttacaaaatagtcagagaatggtagaagttaggtacagaattcatatttagactgccagtgaaatgttttcactgtgcacactattccatttttataaaatacatgcgatttacattgcttgagctgaggcagaccggtagtcataatcactatgatttgctttattttttattaactgtttttcggaaatgtctgtgcatatatttttatattttgtttttaacttctgtttttcaagcatggtgtagctaatggagcttctcatccccctcctctggaaaggagcccatattccaatgtattccatgtggttgaaggctttgcgcttgtcattctctgtagcagtcgacctgccactaggagactagccgtcagtgtccttagagaaatacgggctttatttgcacttctggaaatacctaaggtaagatttaggtatttcattcagttatctattgaaagtacttaaaaaccatctctttgtccatccttatcccatgtaggtaggttactaccatgggtctaaactaacctaccgttctcaattgggaggccgagtcgggcggatcacgagatcaggagatcgagaccatcctggctaacacggtggtctctactaaaaatataaaaaaaaaattagccgggcgtggtggcgggcgcctgtagtccagctactcgggaggctgaggagaatggcgtgaacccaggaggcggagtttgcagtgagccgagatggcgctgctgcactccagcctgggtgacagagcgagactccgtctcaaaaaaaaaaaaaaaaaaatagtgctgaagtgaatttttagtgtttacttgggtttggct

SEQ ID NO: 111390 - DNA, 1050 bp, Homo sapiens
acctttgttagtggaagatactaagtgaaaacaatgtggctaattttataggcccctcaaaataaccagtatttagttatttaatgatatcagtgctatttattttaatattatttgtgggaggctaaatattaaatatttaatcttaaatattaataagattaattataaataatctgtttaaatatttgttatgtaataatggttgtaatgcttgttgtctagttactgaaaacctttttgtttgctggttttattttgaattatttctgtattcttttatccatatataggctaataattatctacaggatttatgtgcatttttaaaatattaaatacattgaactttaggggaggactcgcactttctgtagttatttttccaagtttgatttcattgtctagcatatgtaatatgtttcttattaaatcctgttgtatttttcaggggggaaagaaaacccaagattgatttgtttagaacttgtattgctgcgattccaaggttgattcctgacggtatgagcagaactgacctgattgaattgttagcaaggtaaatgagaattactgtttgctatattgttttatgtcttctgctcctttatatttctaatatacctttgttactgttatcactaaaaaggcgatgttaaagacatttctaatcctttatctgatttactttctaaacttccattttgtctttttttgttgttgttaaacacattttcctcactgatttttaacttctcaaattcttctagattccccccacaaatcctatctttcagttccctatttttccatctagtattctttcctgggatttctgtaacacattatcccttaacatatgggcattatcagtgtatgataattcccagttaggcaattaattattgtgtttactcttacagtcatttctttagtatctctagtggtaatcaggtctcatttgtgcttttttttccccctatggcagaactgtggcatttaagtttttctctctcttctattaggcatgtcatagctctgtaaaatgag

SEQ ID NO: 111391 - DNA, 1013 bp, Homo sapiens
tgagccctatttctggtatgagaaagtcaaacttatatttaatatgggtgtcaaagcaacataaaattataagaacacactacacagtgatgttactttttctttctttgtggtacttcctctttgttagccaataccctcttttgattatctatttctgtaaaatgtcatgtgggttatcctgggagaccaggaggcaacaccattgcacactttgctgtctgtgtatgaactgaataacagatgcaccttgaccaatcactgacagccttgatggaaaatgacagtgattatgatgtgcatggtgctttatggaccaaagagcgaaagcaaagtttgtttatgccattacttaatgtatggtagcttaaatttgaactgcctttttggggactggtattatttaactaaagtgtggtaactgaaattcatgcattttgaaaccatgtaaaaagaggactgactatatgaaatctctaggtagtgagtccattgccactataacaaatacccaaggccaggcgcggtgactcatgcctgtaatcccagcactttgggaggccgaggcgtatgtatcacctgaggtcaggagttcaagaccagcctgaccaacatggtgaaaccccatctgtactaaaaatacaaaaaattagctgggcgtggtggcaggcgcctgtaatcccagctactcgggaggctgaggcaggagaatcgcctgaacccgggaggcggaggttacagtgagctgagatcacgccattgcactccagtctgggcaacaagagcgaaactccatctcaaaaaaaaaataaaaaataaaaataaaacccaaaacactgagaatatccaaattcttttctacataaggattattttattaggccaactgaagaacaatttagatgaaagaaatttaaaaggcctcaccttcaaatacagaccagaataaaaaccagtatattaagaggttagacatttaaaataaataaaattattgaataactagaagaaaa

SEQ ID NO: 111392 - DNA, 1805 bp, Homo sapiens
ccccaagtgatttcactcgcctcagcctcccaaagtgctgggattacagacgtgagccaccatgctcagcccacagtgaatacgtttttttgataatagtcatgagtcttcatgttaagagttttccagttaaatctttatcacaggatcctattcactgcattctgtcctttcttcaacttagttttagtcctctgcataattttcacataatttctccaattagtccaatatactgaagctgatcatcagggagaagaatatgtcacagttgaaaccccttttgtggcaacaataagctaatcatttaaagattaataggcttttattacagaaagtaagtattctttatctaatttcagatattttataactgtgaagttttttcccctaggaatgtcagtttactatcctcaagtaagaaaagcattagatagcatcctcagacatttggacaaagaagttgggagaccaatgtgtatgaccagtgtgcagatgtctaataaggagcctgaagacatgattacgtatgtagtaaattatgtgccttcattgctatttcagttttcctaagacagtgtggatggttcttgcttacctgtctccttacttggtctttggagttcttccatgtttctatctgctgcagttttcaatacagtgattccttccacacactcagttttattccttaaagtgctgtcaaactggtatagatagcaaaactcactctagatcccagtctggtgtgttgtcaatgacaaggccctacacttactctgtgagcaaaatatgaatcctaggtaccccggatgtatgtgggcatgattggtttattatgtcaaataaatgctttcactgccaaagccctagtttaaaaaaaaaaaaaaaaaatcctgaaaatctgaactctgattatttttgactcctaggaactaaggggcatagagaggaataacatatgagcagtttttttcgaaacactacctcatcccaccccaccccaagggccttgtcattatttgtcatctctgcatctttttttcttattgttagggacttcctcctcaggaaactgtatgttatggcaatagcttactttatttgctagaaaacatctacatattctctgtaagggaggagattcttctggatattaatatttgcattataggtcttagaataccaaatttggtatttaatctcaatttatttaatatacaattattatgtactactatatgctaatatctctgagagtttctttaatgtgaagttttttgccaatgttacttcctctgggaaatcttgtttttcaccacaaccacttccctcatttagtaagtttttgctttcacccagttcctctgacacctatatagtgtatttcttctgtaactgcattaactttctattctatttcagtgtgctttaatttaggatctttgagatagagagcaccctctcggtgactaggagaaaagcaagatagcaataaagattttattacttacaggtgggtgggggacactgcacatgtggaggccacactcatggaggtcaggaagcatgtgtagagagagagagaaagaggcccatgggccaatgccttttttgggttgagggtgttttccaaacagttacctatggggaattctaattggtggattgaaagcaagcacgcatgagttcaggagatcatgctgtgcctgagaggtggtcactgcagcacatctgcatagtccatgtggggtacgcaggtcagtggggccagtcaagtagcctgcatctaggtatccatatgg

SEQ ID NO: 111393 - DNA, 1035 bp, Homo sapiens
tcagttctgctgggtttttttctgtgggggaggtggttgttatttattaggtttactttgttaggattatcttggatctgtattttcttttcttggatctgtattttcttttcaaggacttttgtaagagctcatgtagttaaagctagataaaattatccattagcccatttaatcaaatacatgcaaattgcaatacactgaaagaatgtataagtgaagctacattgtggagcttttctgcgtctttcaaggtgtcgtctttgactatgtgacatgtgactatctgatacttagactaagggagggcaccagtactatgtcgtatataaagaagagtgaagcttaaacttttaatcttacttagataaaatatatatatatatatatatatatatatatataagagctttattttcttcccgtattccattgaactaccttgcatacccactgggatgcgtgtaccccacttgagagaccactggtgtagatcagagataatgacagcttgggcttggattgtagtggtgcagatagaggagcattcactgagaaaaaaacattaagaaggaatcaaatctgggggcaaggtcatgcatttggtttgaacatgtctaacatgaggcatccaggtagaggcatccaagtaagagatgtcagatgggtctgagggtctgagttcagagagaggccaggcttaaaatttgtgggtgatctggtatgggtggtaaatgaagccatgtaagtatatgcagttgttttgggaggtaatacatgatgataggagaaggcagcccaggagaacgttgccttgaagcagtctaacatttaatacccaggtcagggaggccaaacctgaaatgcagataaagatgacacagccagaagtggaacatagataccaaaggaagggagtgtttcaggagggaaagggtgcttgaccttgtccatgttgctgggaaatcaagtagcatactataaataggcccactgttttgagcaatatggtaactgatgagtgagaatggcttc

SEQ ID NO: 111394 - DNA, 1426 bp, Homo sapiens
tggtcatttgagaactttattttttataacagctagaatgaagaaaaagtttgctgatcaaattgtaattgaaatggaataactgattctaaataataataatttaaataatgtccttattctaaataaaaattataacacttaatagtcaatgaacgtttaatacatgccaggtactgttccaagtgctttacagatattaactttacctctgaggtaggtaccatatgttctccattttagagatgaggaaattgtgactcagaatcatataacaatgcccaaggatggagcttggatttagtccctgtttttcccagttttagagtccacgctcttaactccctattcactcgtaaggatatacacttcataatattttgcattatttcgtaaatgcaaatgactgtaataccatttggtgttctgaattttaactatatatgggctacaaatgaattctgccaaaaatgagtgatcctttttcagtcattatgtcagtattggagtgtgaactgttcatcatcaagtaagtttgtttgtataattttagaattcttagaaatactagtataattttatttaataagtaaaatttagtaaataaaattttagcattttgaaagtgtaagaaagggctcaatttccaaatttatggttacttttgagccatatatttaccctataccaaatatgtacctggtatttaaacctattttagactgaatacaaaaaagattggcttttagttgttgacagagaatatgtttgctgttaagtgattgcaagtattataataagtttattctcttttgttttaaaacagaataaagatccgaaaatgtctcgagttgcactggaatctttgtatagattattgtgggtttatgtaattagaataaaatgtgaaagcaacactgtaactcaaaggtgagtatctttgctttaaagtgcattaaaaataaattcttgtttttaaaaaaacacactattgggaattttagtaaacattatactttgtgggtggaatatgaattctgtcaatatattatgaagaataggaagaattttttgctaatatgctgttgatgttatgatctcactatgactagatctttttccctgtagtcgtcttatgagcatagtgtcagcactttttccaaaaggctcacgaagtgtggttcctcgtgacacacctctcaatatatttgtgaagattattcagttcattgctcaggtgagtgcttcatctcatagtatgtatgtatataaattgttagagtaatctattgtaatcacttggagctttgaaattttttatgcatctaaaaacatagtaatacaacattgaataagtttatttcattaatctacacacttggaaagaaaacccacaggtggcagcactttgaattgaagagggata

SEQ ID NO: 111395 - DNA, 1064 bp, Homo sapiens
gctgttataaatgaaaatgttttaaaaatttccagtgaaattaaggagacagtagcttagattttgaatatagtttgttgttgttgttgctgttatttttaatttttgtgggtacatagtagatgtatatatttatgggatacatgagatgttttgatacaggcatgcactgtgaagtaagcacaccatggagaatgggtattcatcccctcaagcatttatcctttgagttacaaagaatccaagtctactctttaagttaatggaatacagtactgacaaattaatttttaaaagtttatcctattgatttgggtttgttttttgttttttgttttaattttttcagagagagggtctgactagcccaggctagactccaactcctgagttcaagctgagactacaggcatgcaccaccatgcctggctttactgattttggttttaaacaaatcatttttttagttcacagtagaaaaaaagagaagaaacattaaaatgattgttgccaaagactatatttgactgacataccaaaattttgttttatattaagttcattagatttttatttgtgtaattgttcaaattagattgaatatctttgtttaaagctcagataaatttaggatgattttattattcagacatatagcagcattgtagcagctgaaaaaataataattgatttttgtcacttctcaccttgcctttttggtcattgcgtgaatgccagctttgtttgaaaatcaagttttttcatgccagatacctcatcacttaagataatccaaatacttttatatttaatcattcatatgagaacagtttttatgtagaataggacttaaatatctttaatgtataatttttaataatattttgaaaatacaatttaacaatatgaaagtgttatttcatgtgtacctaaaaactaatgggacttatttaagactttattttttttagagcagttttaggttcacagtaaaattgagaggagggtaccgagatttcctgtgggtaaatttccctacccacactcatacctagcttcccccg

SEQ ID NO: 111396 - DNA, 1828 bp, Homo sapiens
agtctgaacaatatgagaaaaagctttgataatatcactaaaatcacatttaagtatgcccggccatatctaaaagttggtactggatctgcacagatgtaaaagctcctgaaatgattctgacttgaatgaaagggtacttgtcattaacactatttggcacatccatattcagcctctcttagtcctgaaaacaaaactgtgagagatagaaggatcattttcttcccaggatgctctgctagcaggatcctcttttcttctttgggtaggaacacaattctgacagtgtgggaatattcttcagctgcatgtcatgcgaatgcttgatttgaatattcttttgatatatacttagatgagcctatttgaatatttgcttgcaagttatagaaatattgcagacatgacattccatttcctggtattcctctaagttagacttgagactgaaaaccttatactttgaagataatggaaccgaggcagatagagaaagtgacttgtctctgggtatgcagctcgttgtgctattgtaggaataggactggatcttctttcatatttcaggaatgatccactggatgttatcctgtacgtctttttcatgattttatgtataattttcaaaactgcctcagtttcttaggtatacggaatatatactactttgagaaatgtttttgtctattttccttctagataaacgttgatattactcatgtttggatgagaatttatatgccttatttgactatttatgaaaattcccaggaccaaatcaaactgattgaactctttatgtcatgcaaccaggaaataaattttatttaattaattacattatacttatttctgttcttatttttggtaatttgtacagatatagggaccaaaagagaattgatcatttttctggatagtatgatttttcatacgttcattaaaatatttttaagatatgcatttaaatgtttctggaaggctgctttgtttcatgacagttcatacttttctgttgcttgttggaatttttatatatatacgtttcacctaacatatttgcaatacttcgcagtaccttaacttttttttgtcttaaggctttcatttaaatgctctgttttctttgaacccttacctcctgttaaatatttctggcatattgttcattttcattaatggctatgtcaatctgccaggctaaaggagataagagccacttagcatgagtatttggaatataattgtcttggccattaacccttaacttacattaaggctctattcagcagaaattttatgaattggctcctatttattaagtcttagataatgtggctgctctgcatagttgaggtaaggagttgagccttgaaggaaaaactatgctagttatctgttgtaacagttatttattttatgtatagggaaaattgatccaagataaaggccttacctaaactattttgagatccatttaatctcttgatactaaaaacctaaacaatttccttttattagacctatacctttttttttttgagatgaagtctcgctctgtcacccaggctggagtgcagtggaatgatctcggctcactgcaggcttcacctcccggactcaagcgattctcctgcctcaccctactgagtagctgggattacaggcatctgccaccaccgccggctgattttttatttttagtacagacggggtttcaccatattggccaggctggtctcaaactcctgacctcaagttattcacccgcctcagcctcccaaagtgctggaattacaggtgtgaaccactgctcccagcctag

SEQ ID NO: 111397 - DNA, 1072 bp, Homo sapiens
ttggcagtgtaatgatgtattgattttaagtgataattagtactgtatgattgattggcttatctctgtgaacaaatttatagtctccaatatgctctccatataactaattgcagactttatataaaaagagccttaaaagttggagacactgatttacatggtggcgttttgtgggttggttatttgatattattctattatggttattaattaaatggtaatggtggtgtcttgataatattataggaataaagaaatcctattatttctccttcagaaacttttaatttaattttaaaagaaatgaacagcaaatttagagtagcaatttttattttcctctgtgtgcctttctggcaattgtaatgaaggtagagaaaggagatgatatttaggtagcataccttttgatttttacccttaaatatcatgtggaaattagtgtttttaattcaaatcaaatgatgtctccacgtatattaaaggtttcaggctgtaaggaagaagtttgtgacagaattaaaagaactgcgacaaaaggaacaaagcccacatgtggtacaaagtgtcatcagcttaataatgggaatgaaattttttcgagtaaaaatgtatcctgtagaagattttgaagcatcatttcaatttatgcaggtgatataccttctaaatgacagtaaatagagcaagcctaacagtccttgctcttcatgactttttaaaagaaacaaaatacacgtaaattaatggcatcatttttagtctcttattccatgtgttaagttgttctaagtgtaaattaattttttttttttccttgagacagagtctcactctgtcacccaggctggagtgcagtggcatgatctcggctcactgcaacctccaccttcctgattgaagcgattctcctgcctcaggcacccgagtagttgggattacaggcgcctgccaccaggcccggctaattttttttttttttttttttttttttctttagtagagacgggatttcaccatgttggccaggctggtctccaactcctcacctcaggtgatctgcccgcct

SEQ ID NO: 111398 - DNA, 1010 bp, Homo sapiens
accagaaggttaaatatagtaaagtaaaattgaagatagaataaaattagtattgcttttatcatataaatgaatattcagagaaaattatacaatactctgataaggaattttcatatgtattaggaaagagagtttgtagaaaaatttaatgaaatgttatgtttgttcttttgttattttagatattcaggaaccaacactgggaatgtgcatattattgctgatttatatgcagaggtgataggggttcttgcccaatcaaagtaagttttgtaaatcacccatttagattttctttgcattttagaatgcttcattaccaatgaatacaatagatactgatagttcgaaatccaccattttccatagcactaagtcagctccaccttttattactttactgctctgtttctcagaagctctttaacactcatacctcaatttcaccacttgttttaattttatttggggttttctataaatgtctgaatcgaacaaatcagaaattgccaaccatatttaggacactatctttttccctatttttaacaattctgttagaatctttttaaagaactctttacagagctaataattattttccaagtgagaacttttattcctcagcaatgcagtgttttctaatcatatttgttttaatgctaaacagagtttgaattggtaagagacaccaaaaaggaaagatgaaagatactagattactcaattaaaactgttaattcattaagagttatacacattgagttgcactgaaccatcactttagtaaacagcaaaatatatttgttattagcaacttgtggttactgtaacaattatggaagattttggatttcctttgttactactgggaaatttataaggaaaaaagtatcaaattatattttcttagatgtgtttgaaagagtctttggccctgaaatcatcatataacaaacaacctttctaaattctaagaaggcaagtacaattattgttaatgttta

SEQ ID NO: 111399 - DNA, 1050 bp, Homo sapiens
agtaacaactttccatcctcaggccccaacttttacctctttttctaactatcaaatttctctccccactggtaaacacatggttcttttacatatacatacagaatatagttttacatacatataaaaggtattttatattactagccaatgtaagtgaatgtgtatatacaatatattatacccaaagtatttctttgtttttttttaacttatatttctcttacgagtgaggttaagtattgaacagatatttaaaagctataagcttttaaacagaataggcatattgctgataccagtatttgacaaccgccttgttttttcagataagaaaactgaagcacagagaccataaggcatcagcctatggtcattcacttcgtggtagtcaggtcggaggtcacaccaaggccctctggctactgataatctctgtactaggctgcttttcagtaaactcttgaatgaatgaaagaaagaacacatactgttgacttttgaacttgaatctaaacaaaacctatgttgaactttaagtctgtaatctaagaactatcaaacttaaacttgttacaaaaggagatgatgagcacaaccactttctttggtatggagagtatcacagtgagagccttgcctctggagccacacttaaattaaccatgtgaccttgggcaaagaggaggcttatctttctttaaaacaatctagtaacaagtgaaaacgagcaaaaccaaacgcacaaatctaaactgtttattatgtagaagatttctaatgttttatatttgtgctttatttttatttttaatgtttgttttttttaatcataggagaagctattgtccagatctcttcagaggggtgaagatcttcagtttgatcaggtatgacaattttgggagaatttttttttcccctggaaatagtgttcatcctaatagtctggcccaaatgtattcaatattaaggaattccttaatttctatatatccttgtatgcttaattcattctagatttgatagtttttttaaataagtagtata

SEQ ID NO: 111400 - DNA, 1442 bp, Homo sapiens
tgggtactcagtagagggtttttgttaaatattagtattttaatgaatgtagccttaagaagtattgctgtggtgtgtgccttttgtttttctaataataataataataataatgttttcattctagccagagcttccgatagttctttcagaatagcctgatgctattcatttatcttattagttaattcatttatttaatagttaattttagaggcatctgctatgtaatctgagattataaaattatgattaatagtggtaaggatttcatcagaacgtagatgtttctactctgccatcacaaatagaagaggcatcactgcttactcttcctgacacaccaggaaaacccccaaatcaccatcatattttacagattttaccccttacactcctatataccaagataatttcttcttatctagagcagagtgccagctttgtttttatttatgtccaagtctgggtaagttgggaatccatagcttcaagattagataatgaaaatacatttaatctaatattgtcacagtttttacaatatagcttcaaatgcttttattggaatttcatttattttgaaatttattctgtacccttttaggtaataatcatctaagatgactctctgggttcagagtcactttaaagaaaatagcatccagggcttgtcagatacaaggaggctggccttgctcatggtcagtcaggtagtaggtttcaaaaacacaaatgtgaatggcttttgctgaaagaatttaatctaccactaaaatgagagaattggctttttcattcttacattagaaaccataataaaagaagattaaggaagccaaaagactcgaagattagctgagttggatttttagccacaatttcattttcattttagaaggaagattcaagaagggcaattggtgattgaaatggcaacttgcaggctatgcaatccaataccttaggtccttttttcctaaaaggagatggatcaatcctcggtaataacctaggtatatccaagtttatctgttaatcttttagattgctggggactagaaaagaagatagaagaaaatccatttacctatcttcttctgatttagaccttatgttttgatttaggcccagcattttaaaaactctaaaattttcactattttttttgagagtataaatatatgtatgtgtcttaaagggtttcttctccctgtatggtcagtttcttccaaactgcatttttctgctggttttaccttctcctcacatgtttattttaacttgttatattttaagaatgaaacacagttgattggaagtccagtgtacacagaggagcctttttgactgtgatcttctgtgtattactgtcaatggaccatcagtgtcagatcttttttgggggacttgtcagagtccccaaagaaggttcctacagt

SEQ ID NO: 111401 - DNA, 1051 bp, Homo sapiens
atgaacattgagagaagtggttattggatttggaaataagcagaaataaaacagaacagttttaccttcttgatataattacaggaagtaactttgactctctgccaacttaaataggtgacagtttaggttactctttgggctggaaggaagtgggtatgtgatgtactaagaacacagtgtaggttcgatgtgggatgttgggaatggagaggaaggcgaaggatgttgtaacagctgaaactcactccttacacaactgaattagggatagctattcaccaccaatttcagattcagagggtttgtgacggcgcactgaggagttaggcacaataatatattggctttagaacctgtgtgcttactcagcctgttatagttccttagaaggatgagagaggaaaacaacagaagggaggacagggcaggaagaaagttgaaggaagtattgtcaatgctcttattttcttagtgaagtagccttgaaattgctgtgaaggtgagtttcttctcaatgattaagtagagaaaactactctgaggaaagcatctatgaaataatatgttccgggatctgatacataataatagccaaatgtatatttcaaaactgtgcagatgtttatattcagtttaaatcatcccatgattgctttccacatagcaaattgatttttatactaatgtatatatattttttgtgtatattgtataatgtatatatagtatatatatagacagcatatatattattaatataaagttctgttttagaagtaaggattacaaaagcctatagcataagttcatgattataagatttgattatagatatgcttaaactacaaaatgttagttttctttttcaatggtctctgaattacatgataaattactacactagtctacttaaacagcatacagtaagggaacaactctaaacaaattgaagaatttattatggaaaatgtcaaacatatataaaactaaagattatggtataatgaacacttaggacccatcacctggcctcagccattttcaagtc

SEQ ID NO: 111402 - DNA, 1058 bp, Homo sapiens
tttttcttgagctttataataagtgatatttctgtagtagacttcaagtaaaaaacattggacatatgccaaagatgtcataggacttctatgtttagaaactcttttcaataagaatagtttaggataaataaacattttagggacagctgtccaaagaacaagcagaagtaataatttttctgtccatcgaaatggaaccagaagcaaaaacattgaactggatagtgagggaaaatgatttcatttgcacaaaatagaaacataaagtatttgggaatagaattaataagaattagatctctcctctgaaggaaagtatacatttttttctctaggtacacaaaagaagacgagttaatggaggtgtgtcagatactagacaagaggttttataatataaagatgtcaagtttttttcaagtaagtttgtgaaggcatgcataagcttgaaagtatgagtgacaatagctgaagatggtgaatacataggaatatttgtctctacaaataataaaacctgttatacagctgtaacaataaaaagtctggtactaacacaaacacagatttttaatgagcataatagaaagcccagaaaagcatatttgagtatggatttagtttatgatagtgagtaaaatcagtgacagaatttcagtaaatgaacccaagagaattgattaaatattgaggaaaaaagataaaatctttatttcgtatcagtagctcaaataagttacaattggatgacaaatttaaatggaacaaataaagcgaacttaaaaagagttaaaatataggtaagtagttaatcaaaatggggaaacttttttgctctttttatgcaaatgaattagaagatataaccaaaatattagatttgggaaatatttattttaagcaaacagtatgataagaatttggacctttaaatgagagaaggatccatccgcatttggtaattatggaagaaataaagttattgatgggaaagttcttagcaaccaggatgcaagtttgtgttccagtgctgccactcccacatgacagtagct

SEQ ID NO: 111403 - DNA, 1057 bp, Homo sapiens
ttctttgtattttttaaagtaatttttttggcttttcttgagtgtttattcttccatgtatactgtaatatagatctatccaataaacctagacaaaacagtctcaaaattttagtgggctggccaggcgcggtggctcatgcctgtaatcccagcactttgggaggctgaggcaggcagatcacctgaggtcgggagttcgagatcagcctgaccaacacggggaaaccctatctctactaaaaatacaaaattagccagcatggtggcgcatgcctgtaatcccagctacttgggaggctgaggcagaagaatcgcttgatcctgggaggcagaggttgcagtgagccgagatcgtgctattgcactccagcctggacaataagagcgcaactccatgtcaaaaaaaaaaaattttagttggagctgtgctaattaatatattaattttatgaaaattgacacttatgataaatccttccatctatgactatgtctttccacatgttcagatcttcttttatatcttcttttatattaggaagcgcttgtcctttcctctgtatgaagtcctatgcttttcttattaaatttatttctaccaattttatttttgcgaatagaaggtcttttaaaatcattttctatttctaggtgattgttgctagttaataaagtttcgtatcttttttaatatttgtaacgatttaattttttaatattattgcatttacttatcatctccaggatggtgttgaatagcaaggcaaaaatcagcacttcagtttctgtttttaatcgaaataggtttgttttgcagcctatattatttgctgctgatgtttgttaaatattttatttgttttctttgtctctggctgctggatacctttaggtatacagttatattactttgtttgctacttgagtgtaggtcagactgctaccgtcttttaagaagtaatcccaagagtgatggaagggaaagcagcctaagttagcagcagttaacagcctgttaagatagtaggagggagcccctttccttcttgtcttt

SEQ ID NO: 111404 - DNA, 1111 bp, Homo sapiens
catagcctgtgccagagtctcaaatcactgggttctggcctattccactactggtcaaactcttagtcttcttttctggaagtaactgtttgcagttgcattgtcacattgataagacaagtttgctagccttttgcaggatgagaatgggtcatgtctttttggttattcttcctagtctgttgatgtgtgataccacaggacattgcctgtttgatggcatttttgacgattttagatctattagttggttttcattaagcatgctattttccaatttttaaaattttgctaaatgattaaagttttaagggtttttacagaaagataattaaagagaaattcatttgaatagggaaggctgtcgaagagaatttccaaattgtcagacctgttcttcccagaaggtaatgacttgtaaatgtcatagaaaatcttgtgaattgttttataagctgtattttcagttacattattgatatatgatacagaaagtagttagtcaaggcattcataaaaaatgaggaatgaattattaatatccattatcatgcaatatagtaacgatataacaaatacagacttacatttgatacattaagtcgatccttttttctttaaaataagctttacatgattttggaacaatatctgaatgagtaaattttattatagggagactatatggaagaaaataagaagatgattccagtaacatagccttagtaatatcgttgaagataaggttagtagtgtgtttttacgtagagtgcaagggcattgtattgccatgatttgaagtgtagggcttttgtatggttggaatagaactacttgatggctattatttgtggtattataattacaggtttccttatttatggtgcttttgaaactttttaatgatcacaatcaactttaagtaaaattattgtatagagccaactgttccattttagaagaatagggtaaggcaatagttcacaaccctggctgcatattagaatcagcctggggagctttcaaaaacatacacatacctgggccccattccaaagattttgattctgacttaaggtatggccagagatggccagcaaagttcagggtc

SEQ ID NO: 111405 - DNA, 1050 bp, Homo sapiens
cttagcatgctttttctttgggtagttgtttacttttgcttgagatttttggatttgtgggtttagccagtcaattttagaaattttttgatcattattttttcgaataatattttattttctaaatttactttatttaaaaaatattattgttattgttattttttttagagacagggtctcgctctgttgcccaggctgcaggtagtagctcacagtaacgtcaaactcctaggctcaaatggtcctcctgccttagcctcctgactagctagggctacaggtcctaatttttaaatttgtttatagagacaaagtctcactatgttgcccaggctggccgtgaactcttggcttcaagcagtgttcccgccttggcttcctgaagtgttggggattacacgtgtcagccactgtgcctgtcctcaattaatattttccattcactccttctgagattccaattccatatatattagaccatttgctgctgttccataaatcactgagtctaggttcatttttgtttgtttgtttcattatgtttagttgtcagtgcttcactttggagagtttctatatccatttctccaagtttactgattttttctttggcagcatcttatcctctgttagttctacatagtgaatttattgttttagatactgtgtttttctttctccattttatttgagtcttttattttctatttcttcttcattgtatttattttttcctttacatcctggaacttatttataattgccgtttaaagaacctatcaattctgtcatctctgtcatttctaggtctactctattgactggttttataggacacattttcctactccttgacacatttaatacatttcaattggatgttgccatttgtgacatcgctgagtgctggattttgtcacattattttaaagagtgttgtttgttttggaaggcagttacttgcagatcagcttgatcctttgcagcttggtttagaggattgttttggagtctttgaaactactttaaggagtgcttagatagttg

SEQ ID NO: 111406 - DNA, 1049 bp, Homo sapiens
atagtgggttgaggactgagttggtctgacttttgtgggtaccccagagcttagcccagtggcaagcacttcttaagcagttagtaaacctttgttaaataaatgttaagagtcctctagctttcatgtaccagagcaagtttttacttgttaacaagaagtgctgtcagttgccatatttagctcactgacttgtccttcaaaaccatctagcacattgctcagtaggcaatggttccctaggcaaaaccagtcttagtttctttctttctttttttttttttttttaattttttgagatggagtgttgctctgtcacctaggctggagtgcagtgatgcgatctccagccttagtttcaaaatggaaagagaaaaacaaaaaaaccacctcaaattaagcaaacgatgatcaatctagaacagcagttagtaaaccttttctgtaaagggccagatagtaaatattttaggctttgcaggccacaggtctttgtcgcaggtacttagctctggctttgtagagccaaagtggttctagatgatatgcgagtgaatgtgtgtggctgcattttactacaactttatttaaaaaaacagctgttgggccagatttggccttgggggtcagttttccaacccctaagctagaccacagaaaagaatattggtaacatcagagagctacatacaagtaacttacctgggaaatagagaatggaggctttggccggacgctgtggctctcgcctgtaatcacagcactttgggaagccagggtgggtggatcacctgaggccaggagtttgagaccagcatggccaacatggtgaaatcctgtctctactaaaaatataaaaattagccagctgtagtggtgtgcacctgtaatcccaggtactggggaggctgaggcaagagaattgcttgaacctgggaggcggaggttacagtgaactgagatcgcaccactgcactccagtctgggagacagagcaagatcctgtctccaaaaaaaaagaatggaagctttgaagaaagggtccaata

SEQ ID NO: 111407 - DNA, 1341 bp, Homo sapiens
gtgcagaagctctttaattagatcccatttgtcaattttggcttttgttgctattgcttttggagttttagtcatgaagtctttgcccatgcctgtgtcctgaatggtattgcctgggttttcttctagggtttttatgcttttaggtcttagatttaagtctttaatccatctagagttaattttttcaaccattttttcctgatttctatgtagaccatttgtggttcatcttttgaaatactatgcaaatcattttcttcatgttgagcattggaagaatgagattgtattgtgtttcactaagtgaatcagattttttaaattattatgtgtcattcagagttatagatatgattgcttaggggttttaccctgttacctttgtgttttcatttccttcttgctcacttaacaaccccacaagagggcaggcaaaggaagggagagaactttcagttttcaaagtcttttgtaggtattcctttattgtactctcttgttatacttctgaattacatcaaagcagtaggattggctacttttgctatttccaaatattttgtagggtgctcagttattttgaaaaacatataatgttgatgactgtgtttattgaatttaagaatttatactttcagtacttcagctttatgtttttagatccatatatttaaaattatcaatttttttggttattcatgctgaagttttcaccattactattgataagtatcattgattgtaatagggagtttttttggtgtttaaaagtaactttagaatgtttgtaatatagaataaagttttaaatgactccttttcatgttttataaaagttgacattcctgaggtctgttagtgaattttcaaaatgataagaattatcttttgaatacaagttgctgttttacacgtcagctctaagtttatttaaaaggaagacacacctcaggccaaagtaaatttctctttacatgatcacagtgaaagttttcaaaatctaaatgttaaactagatggacgctcaatattttatggtctcagtattgtcgttaacacccattgtacatgtacgcgtacatgaagggcagtttcatggtctatagctgtttggtttgttatcagcacaaacagtaatgtcctgaaaatcagcttcaaaacagctggcaattgactgactggggtttagcaccgcctaaattcatatgacgtttatttgctctttgacacaaatagtgtacctgaacttctcatcaaggaagttggtataggcacctttctgtgtgcttgtgggcctagtaatgtagaagaaccttaaaatggattttttaaagagag

SEQ ID NO: 111408 - DNA, 1045 bp, Homo sapiens
tctgttacagaagtcaggcttctctaagcttgctggaggcagtgaacacagagaaaaagaggaaagacaaactttggagattaaattgtagctacttacttgctttatgaccttgagcagctatttattcatttttctcttctagttaacatttttattaacttagaaaccttttcattgcaattgttttatataaacatgtaaaatatagctatcatctatacacattttctctgatgtttgatcttataggaccttagggtcataattagatagcataagttccattgtataattaaaaaaactatacatataaaaggttaacacattgattacagatgaccctagaaagcattttagatgttgcatctttaaattaaaaagaatttttctaaggggtcacatgttcccttcctctgacaagcaagaacagaaaattttggatgaattaattgaaatttttgttaaatagttaaagatttattgtgtgtttctcgtgggcgtatcatcttccagagactttgtaggcaacttctggagactttaattataggtttgggtggtagggagaagagcattttaacttaagggagtccagagaatcattaatgaaatcagtaaagaaagtctccatatgaagccactgaatacattagggttggttattctaggaaaaccatgttgataatgggtaatctgatagtccagaaattcatgagcagtacaaatggaataaacagaaaacattctattgagggttgaaggctgtaattggtttaatggaaaaaaaagaagtactactttttactacgaatagtaaaattgtaaaacaatctactggccgggcgcggtggctcacgcctgaaatcccagcactttgggaggccgaggcaggcagatcacgaggtcaggagatcgagatcatcctggctaacacagtgaaaccccatctctactaaaaatacaaaaaaaaaaaaaaattagctgggcacggtggcgggcacctgtagtcccagctagtcgggaggctgaggcaggagaatgg

SEQ ID NO: 111409 - DNA, 1098 bp, Homo sapiens
agagtgcagtgaaccaattctgaattctaccctcctatatttgttacttgtttagactgacttaaccactgtggagaataaagcctatttgtgggggttggggtgggggtggtgcctactgactcttatatgcatgttttttcagagttacaggatgtgtactggaatgtgaaggattaagctttgtggtggcatgttctatatggtcatccatagtgaccaaactaatttggaatgttgttttgttactaacttggaaatgtgttattttctctacagaggatgttgatctgaataaactgcttattatgctttatacatttctagagcgagaggaactgtcaatcagtgtaaatctcacccagcacagtattttctttcacaaacatggggaggaggcaataccaagataaccacttttgggacagagccaggagctgttgtgtaactcagagggtgtgtgatagcatccagctttggagcccatcacgtcacattgagaaattgtggcagggaggcttacaggaaaaacatcttgtttattaacacctgaatatgttacttatgtagctttttaaaagtcatcagttagctagcttctcaaagagaggcaagaacccattcgcgtagttacagattgtggctatagtaagtcttctggtaacaggagctgtgagcaccacttcttcagtgaagtctttcctgttcccttctccactcaggttgatgactgtctcctttgtacctggttgcagcttgaacatatttaggtaacttctctcaaagcacttgaaacatgctactgcccatgtctcctttccagcttgtctgtaaactccttgatggtagcagctgtgtgtgtaagtgccactgagtatagattcctggagcttaggttgatccccagtaaatgttaaatgcaggtctccctgtgcctgtggaaatgcctcaacatcaattggttcaattgtatccttcaacttgatcactaacaggtctttaatgaaaagtctccagagatgctattcccattctgtactatcctcatcattaccattcttatttcttctttgccaatgcaaattctctatttcattt

SEQ ID NO: 111410 - DNA, 1026 bp, Homo sapiens
ataaaagaaggaagtctcaagtataattttataaaattttgaatagaacttttgggagtaacctcatttagaaacagaagaatgttacttgctgtttgaagcagcttttatagttcagtgcacatcaaataatgcttatattctgtatattgggttgacaaaaatatgtttataagacagtatgacgatattagagttcttatgacttactgggggtaatggcatattcagggcattaaatatttgatcgccaggtagcagaaaatggtcaataaaataatgaatgtgtaggtatttgaatgcacctctgcttttatctgagatacctttggactcattgtccgcttagctgacttcttagcgtgtatctttctagagtaaatgtaatagtctgtctattgacaaggattagtttacttgattctcatacttgattttgttaatagatcagcgccagccagcatgtttcttttgtaaagggaagggtactaatattatttactgcctacaacttgcaaaatgatttcatatactctctttttaaaaatccttacaggtttccttctgtctctctcttattcaatttttccttcactcccttctttttcctctccttttcttcctataaatgaggttaagtgattttgtgtgggtaactgtggcttagtattgtgtaactatactgcatacattgtgttgccttctcatatgaaatcatttctctgaaattacattggaaatggggtttttacagatttgttgtggatatgactttacagatattaatctaacttttagtttctttggatcacctcttgaattaaatagttgtttttgtctcctaatacatattgatgcaataaaagagttgggcgatgataataattttggtcctatactgaatttttgttatctgaaatatagtagaaactaaaccttttaaacccatttaaaagtcaattttctaaagtcacatttaacagttttggtgtttcaataatattaactaatgaaaactattttggt

SEQ ID NO: 111411 - DNA, 1034 bp, Homo sapiens
acatttttttccttgtcatttataatgcctgttagtttcacaggctgactggctttctttccttcttttcttcctctctccttcccctccttcaacaatatataatagctttattaagctgtaattcatataccataaaattcacctttgcaaagtatacaatccagtggattttagtatttttacagagttgtgtaactatcaccaatgtctaattttagaccatttatatcacccccaaaaagaaatttcttacccattagcaatcacccccctcccctactaattcgtactatttctatatatttggtcacaggctttcttaacattcttagtaaatacatttactgacctattaattacagaaattcatctagatgctcacataggttgtgttagggttctgcagagaaacagaaccaaaaatgtgtatgtgtgcagtgcacacacatgtacacatgtatatgggggtggtgggaagacagggaaagggagagttgttaaattgttaaatttttaaaaattggcccaagtgatagtggaggcttgacaagtcaaaaatctgcggggtaggctggagacccagggaagagttgtaattcagtcagctagcagaattcccccttctgaaaaggtcagtctttctccatcagggccttcaactgattggatgaaacccacccttttggagagtaatctgctttactcagagtctactgatttaagtgttaatctcatataaaaaatatctggacagaaacatctagaataatgtttgaccaaacatgtgggtaccatggactagccaagttgacacataaaattaatcacacaagtattcactgagatgtttaaaggtagaaaagtagaaagagcattgaattagggaacaggagaattactttctggtcttggtattaccagtgagagctttatccatgggcaaacatttctgggctgtaagtttccctatctgttaaacaagaggttcaacttgatcaggtttcctttcttgaattattatatggaagctt

SEQ ID NO: 111412 - DNA, 1467 bp, Homo sapiens
acaatatctgacagtgttgtgagagtgatttgagtgaggaatgtgctcttaaaggaattacagaaattggttttaataaaatctacattattggaaacaaaagtttaccaattaaattgtattttgggaaacacatgggggaaccttttttttttttttttgagacaaagtcttgctctgttgcctaggttggagtgtggtggtgcaatcttggctcactgcagccttgacctcccagctcaaccaattcttcccgcctcggcctcctgagcacctgggactacaggcatgtgccaccacgcatggctaatttttcattttttatagagatgaggtctccctgtgttgcccaggctgttttcaaattcctgggctcaagcagttctcttccctcggcctcccaaagttctgggatttggtggcataagccaccaaacctggcctcttttttttttttaattgaatttttgatgttgaggacagacttgtagaatttaaacaaattataaacttaagttgcaataaattgacacatttgtcttgatagtctcaagtagaatgcatgagatagttccttgtgttgccttgagtgatacatactgttttttttattttaatgttggaataaaaatctcagtatgttttgaagcctagtatgatctaatctaaggtcattgtgctttatgtaccaaaaacattggctttgattacatttttaaagaaaagtatcacatggcctcaataaagacaattaggttagccttgtttttagagaggattattagagtgtgggtcaggagaacatataaggtacagtataactggatttcagctggagattttgcaacgtttctctctgacaagggggataatgtcagctgaataatgttggctggatgaccatacaattaggtagaaatgtgattggttgaggcatacctcaaaagttaatgagtaatgaattggtgacaactggagagaaatttctagtggcatgtggaaattcactgtctattttttgtaatgatgtgaatgaaaatgttgaggctatgtgtatcaaatttctggaagaaatgaattttctagggttaacttaatggaaatagtatttctgagtgaaatagtgggccatggctaatgggataacttagtgtggagctggatgtgaagtttcatacatgggttaaaaaaccaactgcacagttacaagggtgagggagatgtgactgaatataaacaacgtcaatattttaattaataaactcaatttggatataacatgtgactaccagatggcttcacagaatcatagtctagactaatagaaggaggaggttgagaagagggagagtgctagtcttacattattctgcaatgtacacagttctgtacacaatgctacacccagggtattgtgttcagttccagttgtcacaattgaaaacgattcagggccgggtgcagtgg

SEQ ID NO: 111413 - DNA, 1383 bp, Homo sapiens
tacttgggcagttttaatagcccaccagtattctagaaaatcacttactgtaaagaagtttaaatttagttttatttgggtttggaaagtgtgtatttatgtttaaaggagaaaaagtttttgcttatcaaagtttcacatgcttgttgtaaaatattaatatgaaagaaatgcataatttcaaaattaaaagtggctgggtatggtggctcatgcctgtaatcccaggactttgggaggctgaggcgggaagatggcttgagcccaggagttaaagagcagtatgggcaacaaagggagactctgactctatttaaaaaaaaaaaaaagaaacgaaaagtgtcacataacactgctcctatcacattgtaacattgttagtggttgtttattctttcaggttttttttttcctttttttctttttctttttttttttaacctctgtataggactgtcttaaactgtctctcatgcttgcaaattttagttagtaaattacatttattgggagtggggaaaactaatcattttttatatacttatctttaaaaataatttctccaggcctagtaattctggcaattctggttccttttaccttttcttaggatacaaagctgccactagtatgtttgtgttcaaaatgtagacttcatactctgcaaaaattgatcaaaacctgtgtgcctgaacagtttatctgcctttaccccagaatatttttggagtacatactttaatttcttcttatttcttgattattcttctcaagagagagaggattaaaaattgctttgagactcccagcgggcactcctcatagtagcccaaggagaaatgtagatttgttcatggtggaatcactcaaacgttaagttgctaattataaaaagggggctacagtttaggctggtgaagtaggtgagaagagtctgttgttccacgtccttctttaagctaccccagagggcagaaagggtttccaaaggatcctaaatagaaaacccagctgtaagcagccaggcggcctaatcagctgaaaaaaaaatctttcatttagcagacttttgagaactgcatctatagtgtgtaccatgctaggcattgagggtaagattaagtttgtatctgtcacaagttatgagctcctctgagcaggaaccttaaatagaccagtgcagagtggaacatgtggattaaaggtagcttagatgaagtgcaccctttggtgaacttattattcactcatttgtttatttttcggcatagcctcttccaaaatagcctagcacacaaacctgggcttccacaggaggtgggttaaggtccatggaacctcttgaattaaacttgttagcttagagttgttttttgggattgc

SEQ ID NO: 111414 - DNA, 1036 bp, Homo sapiens
aaaatgctgtgctgcctaggagatatcgtctgtaaagttgattctgctactgaatttacagccattataattagtaccaacagcttttactattgataaaaactagtataagacgtcttttcatcttgagcattatcactctgcttaatctgtcaatacttgccgaggaaatcagagatagcacattccttgttagaggccttagtgaagaatgttttcataagcattcatttttgacagtttcttcttgtgcaatactttatgtagagtacttgcatgtgcaagttacaaccgtataaacaaagtagcagtgggtgtgttattctctggtcttttttctgctactcattatcaaaaatagcattccatcgtgtcttgtcttccactctgaattattttgtaaaattagttctctaaaagagggaattctgttggaacatgtgacccagttttttttttttttattaaagcagtccaactttttaaagcgttcatcgattaatttattgtctagtaacttcggagtggtgtggaacattgtaaattcacaggctcagcagtaacaatagagaaactacttgggaaattggaagccaatatcagataatgtttgaaataaaaatctattcttctcacagaatttaggaaataaagacacacaaaaacaaattctttgggttcaagtgatcctcccaccccaggctccgtagtagccgggactacaggtgggcacgactgcgcctagctaaaatttttattttttgtagagatggtggtctcactttttaatttttcgtatagacggctggtctccaactcctggcctcaagcgatccttctgctttggcctctcaaagtgctgggattacagactgagccaccgtgcttggccgtttgtagtaatcttgatggtatctggcattgtttcacctaatatttcttcttttttgtttttttctttgatccatttctgtgataaggatgtcaggcaagcagctaggcataatcttccttcccatctcataataaaaggaga

SEQ ID NO: 111415 - DNA, 1032 bp, Homo sapiens
caagagggtgtgacaaataaccaggtatgcatgcttaaaaattactttctactacttagcctacaggctcaaagaatgaaattatctcataaaagagataatttataaagtcgctctcaaaagagggacaacagagggttccggaacgttcccgccagccgccacgagaagaccagagaggtgcatcacaacagcccaaagtcaagcctactcccaacccccttccccgccatccagggaaggggcggggcagggttcttggtccgccgctgtcgcctgcgcagtcgcagtgcggctcgtggccgcagctgcctgaaagggcaaagggacgagtatacgcatgcgtctattcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcggtaatcagcggttgtaggccgcttaggctttaatccagcgttgttttgtgtaaagaacttaaaatggtattgtcttaagcgccgtgtcagccctgacagtcttcctggtgtttctaggaaggatgccgttatgggaaataagagggtttc

SEQ ID NO: 111416 - DNA, 1850 bp, Homo sapiens
tattccataattttggagtgctcctttgtgggagaggttgaatgtttctgatgattatttcattttttaatatggaagctcagaaatgacttgaaattttttttctcttctattttggggaattatcctaatcattgggcatagattcgagaaacgaccaaaacataggatgtgaaagaacccacttccaggaggaaaaaatatgtctgttattttattgatatcttgatagtaaaaaaaattataaacttataaaacgcatatgctttttcaattaagggacttaacctgaatagtgagttccaaattaatcagtaggtctgttactttttcatctagctatttacatgtggagtacgtaagatatagtagtgtttaataaatatttgttgattgattgctgtgtagactagtagttttactatatcatacgtcttgatttactttgacctatctagtgatagtttctaatacttaatatgtaatgtttttgatacaggaaagatgaatgggagggctgattttcgagagccgaatgcagaggttccaagaccaattccccgtaactatctattaagtatttataattagaagcacttcctatgtaaaggaattttcactgccttgagtaacagtggcaggtgggctggcttcatgggcatgtgcagacagcgccccatacttggtttcatgttctagtcttgttatcttgaaattcataatcatttggataaggagtcccacgtttttattttgcactgggcccagcacattaggtagccagtcctgactagcagatagtagcattaattctatttgaagtcaaagtttgttgaaagtgtataagtggcctggctcggtggctcatgcctgtaatcccagcactttgggaggctgagatgggtggaacacctgaggtcaggagttcgagactagcctggctaacatggtgaaaccccgtatctactaaaatacaaaaaattagcctggcgtggtgatgggtgcctgtaatcccagctactcggaaggctgaggcaggagaatcgcttgaaccccgggaggtggaggttgcagtgagccgagatcgcgccattgcactccagcctgggcaacaagagtgaaacactgtctcaaaaaacaaaaaaagtgcataagccagttgttttattatttgagtttaaaaaatgggtgcctcttgttaatgtttaggctaagataatttttcagacctagttttattatggataatttaatgttttctgattttccctggtaaaaagacatagggcctgattacattccaacagaggaagaaaggagagtcttcgcagaatgcaatgatgaaagcttctggttcagatgtgagttcaattttctaattaatataatttgatccaaaatttgtacctgaaattttgacttgaatttgaacctgaaattataataactccgtatagaacaaattggcaaactttttgcatagtgtggttgttgttaaaagagattaaggagataaaggaattgcacacattttaaagtaattatttccagatttttaacaaaaccatgaggtaattttgttgataatagtaatagttagcatttactgtgtgtacatagattatataaaaacaacccaataaggttgataactattattaccctcactttacaggtgaaggaattgaggtttagagatgttaaatggcaacacttagtgttacacaggtgataaattacgatgtttggagttgaaaacaggtctgtctgaaacagattttactcttaatgcttttaaccattatataatagcagattagttcccattttatcattgtgaaatgttgtta

SEQ ID NO: 111417 - DNA, 1044 bp, Homo sapiens
gaaaccccgtctctactaagaatacaaaaattagctgagcatggtggcaggtgcctgtaattccagctactcgagaggctgagacaggagaatcgcttgaacccgggaggcagaggttgcagcaagccaagatcgtgccactgcactccagcctgggcgacagagcgagactccatctcaaaaaaaaaaaaaaagacaaaaagcatgtgataaggacaggctgaaagacagcttgttaattttataccatatctacattactgagaaattacagcagccaaaaaattactgtattaataggtagcatttcactctcaaaacagataaccaaggtgttgttgcatattatagcatcaaacattgaaatgtagaagcttggttgtaaccaggtgataggaagttcaacgtataattatcagaaggatgataatcatacataggaaattttgtactttaacatttgtactttcgaattagatagtctatgctgtatgtgacatttatgtaaacaaataatggcatctgttactttggagagtatcaccttggattagaaaaaggtgataaaagcatttacgaatttataaaaaagcacttactaaggtaattttttatacattttttaggtctgttaaaatacttatcctcttctaaaattagacttgttgatctagggaccattctctttccttaagataactatgtttctatactgacctacattccattaatctgaaatataactatgaaggcatcttatttctaggtgcttaaaatcgtgaccctatgcactgacctaaaatcactatgtctgtgcccaaacacacaggtagtgaagaccctgtgcatatagggtcagtttattgcatattcatgttaaaatagttctcaaactccagaattactaaaaagatgtatcagttcatatttgtatcagctggagtctatgaataatatttcatatatgtgtactactagttttcaaatgatacagtataagagtgataagagtatgggccaggcatggtggctcacacctgtaat

SEQ ID NO: 111418 - DNA, 1149 bp, Homo sapiens
aggattgtgacattgcactccagcctgggtgacaaagcgagacttcatctcaaaaaaaaaaaaaaaagagtatggactctgaggcctgattggctggattcaaatcccagctccacacacagtagctgtgagattttggacaagttcctgaggtctgtgctatacttttcttatctataaaatggggataactgcctagctcatgaaattattatagggattaatgcaatttaattaagtgttggctatctttattaaatagctattagtgttattatgattaatgaaataaaaatttttattgactacagttaggaatatagagtagctttttgttactgtgaggggagaagagttcaaataattgtagggattcttgtatatattgaatatagtttgggactgtggtaataatgtgcactaggttttggtcagcagtattactgatttgcctatagagacagattatttaacaaaatagatattacatactgtagtggaaaaggccactgactagggagtcaggagacttgggttctgatctcagcattaccacaaactaaccagctgtgttgctttgagcaaatgacttgtcttttctggatattagtgtactcagattggaatgaggactagataatctctgaagcctctttcagtcttaccattgtctttttctgtgacataaagtagaatacctgagttggaatgagaccttaggtctaatccattattcctttatagcatgagaagaagctatgcaaagacattgtggtgaatggcagaactagtactagaatctcctcgaacagactattactctgcattaaatggggaaagcattatccattgtagaaatggccagctaactcattgccttttattcttatatgattcttcagtgcttcatgttgcaatccttgagtcaagctggagaaaaatgattgcaaattgtactggtgctgtaattaaaagggatttgtcctttgcaaaaccttaaatgataaatgataatgcatgaaggcattctaactagccaacattaaagaaaccatatttccagcaaaggtaaaatctgttagtaagtaggatagcatgaattcagaccttagcgtttgtgcaatttgtgtgtgatggcaaagttaatgc

SEQ ID NO: 111419 - DNA, 1928 bp, Homo sapiens
aaccacttgggaggctgaagcaggaggatcatctgagccggcaggttgaggctgcagtgagatgagattgtaccactgcattccagccttggtgatagagtgagactttgtctaaaaacataaaataagataaaatggttaagaaatcaaaggaaaagaatatttcattacgtgtgaaattacatgaaattcatatgtttgcatctaaaaataaagttttgttggaacacagctacgttcatgtgtttttggattgtctttcggtgcttttgctttaaaacggcaattgagtaactgggacagagattggcccacaaaacccaaaatatttaccatctggctcttcatagaacgtgtttgccaacctcaggtctggaacagcactgtccagtgtggcagccagtagtcacatgtagcaatttaactttaaaataacttgcagtgaaaggatataaagcaaaatcataaaaggaaagggagcatggggtgaagtccggcggaaaccaggtcccaagagttctcttcccagggagtgtaaatttctccaacagctagtcataacaatgtgtgaagttgtatctacccggggaactcattagagactcagtgcccacagtttttattgggggctggtcacttattcaccctctgcctaacaggtaccaaaattccagactcctagaatgaaagcagatgtttggcatgaactgtatttgtacaaacagtttgggcacagtgagccaattacgcatatcaatggggggaactgtttaccagtcaagtaccaagaccaaattgatcacagggttggtcactcaaagaccaacttccattatcataaaaaattctgttagacagtgctggtgtaaagaacagtgattcatagctgtttttaagttatagccccctttgagattatgagttttggatttttcactctcggttttaggcatatatatatatagatgtaatattttcatatagtttaaggagttcactagtttagaagaaagaacataagtgtttaaaatatgtgctttttaatttttgccccagccaccgtatgattacggtcaaatatgttttgtattttggtttagatggtatactagagcttaaaagcttgagatctggtatcagacagattttattagaatctgtaaccaaccattcaactagttgtttggccttgagcaaattacttaacatctctaagcttcagtttccttatctttaaaagggtggtaataacattatctaccttatagaaatatgataaaaagtataataaatgagataatgcacataaggcgcttagcatgatgcacagaatttagtcattactcagtagtggttcttacttgtaacttgtttcttacctctccttcattaactttttccccttctcttacttcagaagtaattttgagtcacttttactgtgttgtcttagttgatgctgttgatgaacagctggctatttggaacctaagcctagatggttcatgaattatattgtttaatattttgtgatgttttcttaaatttaaaatgctcctttaatttttccactatgtatacagtacagcttttaaaaatggaacagtcttttttaaaggtcttagttatgcaatataattcctagatggttttactgctattcatttatctaatgaactttagacaaaatcttttacttttgttgatgttaacaaggtctttttcttcctatagctgtgcctttggctgcaacaagtatgttgattactcaaggattaattagtaaaggtaaatatttaaaatttgaatttatttagcattttggataccatgtttgttttgtggtattttccaggtctttagaaaaagtaaagataacaatgtatcatattaaacactatgtagaaattcattgatgaatttaaacg

SEQ ID NO: 111420 - DNA, 3116 bp, Homo sapiens
tgttaatggatattaattgacccagcactatatttgaaaggactatgctgcagtgttgtctttgtcataaatcaagtgtgcaggtgtggatctgtttctggactcttagttttggtcagtttgcctattcttgtacttaataccagactgtcttaattactacagctttatcatgtagattttgctatctggtggtagtcagttctataatacgattcttcagtgttgccttggccctttgtgttccacatgactcttagaataagcttttcaatttttgtaaaactttgattttaattgggattgcattgtatttataggtgaagttatggagaattgccatctttagaatattgggtctttcaattctcagtaagttttataacttgtcagtgtagagatctttcatatctttcattagatttgttcctgggttttgagcgtttttttttttggtgctataattaattctgtcttctaaaaaatgtttgtttttttgtttgttgttggtataaacagtttttcatacacacacacatatatatttggtctattgaccttacatcaagtgatctttctaaatttacctgttctaatactttgtagagtcttttggattttcgtcatatttctcttgatactgaattcatttggttttccctattaaacagtctagggttctgtaggatcatggaaggagctaatgttgtaagattatatttaaagatagcctttactgatttttctttctgtaacagtgttactcagaaatacttaactcttttctttaggaatactttcaagtcatcccaaatatggttccatccctaaacttatacgtaagtatgaacaacattgtagttttcatagctttttaaaacttaaataaaattatttttatcaaatgttttatcatgtcttactcatattagttatgtggttacatgctctgataaatcagtttgttaaagcatttcattaagtggattacttggatattttattgttagcataaaaaatcatcagttgaaataggcatttttttgtgtctttataatgtaatagaacaattaatttaaaattattttgtaaggataaagtatttgaaaataaatttttggtctgtctatggggaaacaaagttatgaagatattctgattaatcaaaataaagtatatttaaaattaagcttaatttttaaaagaaatctctctaatttgtattttaaaatgtaaataagcataacttatttacacattgcaatatagttaatagaaaaagaagctacattgcccatcaatgatagactggattaagaaaatgtggcacatatacaccatggaatactatgcagccataaaaaaggatgagttcatgtcctctgtagggacatggatgaagctgggaaccattattatcagcaaactatcacaaggacagaaaaccaaacaccgcatgttctcactcataggtgggaatcgaacaatgagaacacgtggacacaggaaggggaacatcacacaccggggcctgttgtggggtgacgggagtggggagggatagaattaggagatatacctaatgtaaacgacgagttaatgggtgcagcacaccaacgtggcacatgtatacatatgtaacaaacctgcacattatgcacatgtaccctagaacttaaagtataataaaaaataagtaaataaataaataaataaaagaaaaagaagctacattgctcttcaaaagaagtacctgaggcttttcatgagtctttcaggttagcctttcttttctatttgaaactcatgtgatgcagtaagtgccacgtttaggttatggttcgtaatttattactttaagggatttgttgcacctaattttactttaaaacaatcttgtgaaaatggctgtgcatatgatattctgttttataggaaaataatggcctaaatccttgtgatctagttctgtttatttagaactagaaataaataaatgttttgatgcttttattccttatccattcctcttcccattatacctttactaaatctttcctgtatatattataaagtaattagtatactataattgatttatttatagcagctttattttggcacactttttttggaaactgaattatatccatagactctgtatatgaactctgatctgatttaattttgatttcttctaccattatttcaggaaatctcagtctttctaaaccaaagacttatttagaatcacactttaaaacaaatttttcttttagaaaatacttttgtctgaaaggcacattcagttacactttttgtttgattttacaaataagttgcttgtatcatgggatactttgctggaaaactttcttatgtgaaaacttgccaagagaaattcaagaaacttgaaaattccccccttggagaagctttacgatcaggacaagcacgacgatcttcaccacctgggtaggccagattctgatctttacttaagatttttaatttttaagaaacaactagatgttgctataactcatggctcaaaaacattgcctgaaggaccactggatacttgccatttgctgtaggctaaaagtaatttgcttcaaaaattggagcaagacttgccaccatttatttatttatgaatgaatgaatgaatgatgggatctccctctgttgcgcaggctggagtacaatggcatgatcctagctcactgcagcctcaaactcctgggttcacaaggccccactgcctcaagctctctgagtagctaggaatacaggtgtcagccactgcacccagctaattaaaaaaaaattttttttatggagatgggggtctcactatgttgcccaggctggtgttgaactagtgggctcaatcagtcctcctgctttggcttcccaaattgttgagattacaggtgtgaaccactgtgcctggttcttcatttttgttttgttttgttttgagacagagtttcactctggctcccaggctaggagtacagtggcgtgatctcggctcactgcaacctctgcctcctgggctcaagtgatcctcctccctcagcctctggagtagctgagaccacaggcataca

SEQ ID NO: 111421 - DNA, 3231 bp, Homo sapiens
atttactgtagtatttttctaaaacctcagaaactttgaatagtgaaacatacctgaccccaaggtttggataagggattatggacctttgtagagtatactctttaaattttaaaagattagagggaaagaagttaaagggaggggagggtatacagtggaaagggagaagttgattataggtcagagaaggttctagagaatgcagaagggggttctaggtaggtcagagtagccgctagccatatgtggctatttaaattaattaaagttaaatgaaatttaaaattcaatttctcaattgctttggtagcatttcacttgctcaatagtcacatgtgctagtggctaccgtgttagtgccaatatagaacattttcatcattgcagaaagttatgttggacagcactacttaagagcaaaagtcggggcaaaggggtgagtattagccttgtataaaggaagagacaggaaagaatggaagttcagatgattaaagaatttggatgaaagttattgagagcttcttaatcctcaactctgatttttttatttttttctttaatggttggaagcaaaggcatcaaattagtcagaaaaggaaggaagggaatgggcagattaggagagaatggctaaagtcactatcttatctccaaaggcagctgtccttgttcctcactatgtctcatttaaccagtctgaagttcaaatccattcttcttgtacagtagtccccccttatccatgggggataagttcgaagacccctgtggatgcctgaaacctcagatattaccaaatcctttatgttctatgtttttttgatctagatggctactaagttactaacaggcatgtagtgtagacagtgtggatatgctggacaaagggatgattcaagtcctggatggaccagagcagaacctcacaagattttatcacactactcagaacagggtgtaatttaaaatttatgaactgtttatttctggaatgttccatgtaatattttcagaccatggttgactgcaggtaactgaaaccctggaaagcgaaaccacagataagggggcactactgtattctagacatgcactaactctttccttgtgatgacttgcatcttccccaccatttgcattaggaaattctgttatatagtttttttccatacaaaagccaacaaacaaaaagccctttggtatctacccacagactacttagcaaggccatgtcttaatattattttatgccttccacagcagccatccatccatccactgctctgccttctgacccccttctctaaatcaaagtggctacttttttactgctctccacatgggccagcagtggcctgcttttgctttgccccagatgctatcctcccctaccagggcatcttattctttggtttaagtcctactttagttctgctttcttttaccaggaattcagagagttattaatcttttaaaatagcaagcactccttcagagctgttaggagacttagagtttattacagttagatttaaatcagtgccactttacatttttttattccttccagttctttataaccttcccaaaatagtaaatcatgttctctccatagtgtgggaaattctccccagtcttcttctgtctgatgtatattttcattatttgttccagaattttataatggtaaaatattttttataagaaaaagtattagacctggaaggaacttcagagatcatctgctcaaactaccatatttcgcaattgagaaaaccaggattcaaagaagcttagtgatttgcccaaggacatttcctaattgtcagcagagtggggttaagaacccaaggttcctgaagtacacacgatttccttcagaatttttaatataacatatatggtgaagggaaatgagttcagtaattacttattactaatgaaatgcaaagtgttttaatcccaatataaggttataatatttttctttacattctttttttagtaagaaaaatgtagttttgaaccatcatataatactagaactaattaggagaaatttaaatcctctttgctttatataagtatagtatatatttatttagcagaataaatgtttatggttgaaaatggctgggtgcagtggctcatgcctgtaatcccagcactttgggaggccgaggcgggtggatcacctgaggtcagagttcaagaccagcctgaccaatatggcgaaaccctgtctctactaaaaatgcaaaattagctgggcatagtggcacatgcctataatcccagctacttgggaggctcaggcaggacaatcactggaacctggcagggggaggtttcagtgagtcgagattgtgcccctgtgctccagcctgggtaacagagtgagactctgtctcaaaaaaaaaaaaaaaagtttatggttgaaaacattatttaatgtatagttatgttgcttagaaaattctgattattcactgggatcctacctttgagttctaaataagtatcacaaaaattattttttaaaaagttaatattaaaagtatatgcccaatttgtatgtcttattgaaaacatctttgaaaaacagtacttttggtgtggtatgtggtaggtaagactttgtaagttaagtagttgttcactgaatgttagcatcttttttttttaatgttcatatggccttttttgctgtttataaattgtataaactatgttcactatttgatcctgtcaaccaatattaggagtaaccactgcattatatttacatttgactctatgataatatgtaatattcacattttgactctctttgggagaaataaagaataaatgttagttcccaggccaaaataacagttgatactttcttctgcatcaacattgcatctgttagactggaatgaaaacaacacatattctgattaaaggctatgttttatacttttcaagtaattattttcaactttttttcctttttttttgagacagagttttgctcttgttgcccaggctggagtgcaatggcgcgatctcagctcactgcaacctccgcctcctgggttcaagcgattctgcctcagcctccttagtagttaggattacaggtgtgtgccaccacgcccaactaattttgtgtttttagtagagatgaggtttcttgttggccaggctggtcttgaactcctgacctcaggtgatccgccc

SEQ ID NO: 111422 - DNA, 1065 bp, Homo sapiens
tgatttttgaaaatagctggagttgttttcatagagtctgtggttataggactatttaactatatattgagtaaaatctatgctatgtcaagttttattcagttgtccctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaagcttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaactgtttgttgttttaggacctgatcccaaccttgaagaaagtcctaaaagaaaaaatattacatatgaggaattaaggaataagaacagagagtcatatgaagtatctttaacacaaaagactgacccctcagtcaggcctatgcatgaaagagtgccaaaaaaagaaggtatgatagtttagtctgaatcactttactgttgaggattggaaactaaaacattactttaaaacaatactataaaaaattaattaatatgtgatttaactcttcaagcaattaaccaaagtaaaatatttttaaaatagtactttacagttatcagttctttttttttttttgagacggagtcttgctccgtcgccaggctggagtgcagtggcacgatcttggctcactgcagcctctgcctcctggattcaagcaatcctcctgcctcagcctcccaaatagctaggactacaggcccccacgcccagctaattttttgtatttttagtagagatggggtttcatcatgttggccaggatggtctcgatcttttgaccttgtgatccgcctgcctcagtctctgagagtgctaggattacaggc

SEQ ID NO: 111423 - DNA, 1040 bp, Homo sapiens
aggcagggtcccttgaaggggggagtccaagcttcggggtgcggagagaggagggggcggggctgaggtggaggagacggggtaagtgccctaaggttggaactggccgtggttccccccggacggcgggaagcgaggtcagcgctggcgcgggctccggcagcgggactaggaggcggggcaggggtgcgggctgcggggtttcagcagcgggagccggaggggtcgggccctgatggccgggtcgggggcttggcgccggggaggtgtcggggtccctggcagtccgtgggtttgatagtctgtgacgcagttgtctaatttctggctatcaggtgtgggggttggtgccatggaacccgcttccttagagggatggccgggccctaggccgcgccccacgcccggggggcgcgacttctcccaggcgtgctgggagggcgcttgaggggtttcctttagggtttgtctccagtcaacgggtatgaaggggaaaggcggtcccgccgaattctgggacttgtagtcgcggccgcgcccggccgcggttgggttgggtgcacgtgggtaactgtggaaacgggtcccggcatgcagcgcgcccttggagccttcctgctcggccaactcgtgctttattccccggccagctcctgcgcgctctcgggaggcggttgagttcccagggacggagcgactccccagcccttctcccttgggagagggagagcccacgccaggcgcagccctcttcacgcttaggttcttggtccccaagtgaatttccccctgcattttgtggccttacttgtggaataaatgcttggtcttgtaccatcatgcgcacgggttgtgggaaaacatttaagaagcaacacaatgtaaagcagcctttagaatggtgtatttaattttggcatccagtgtgtgtaagcactgggttccagcattcccttgcataaatatgagaacacagtggaggtacacgtaacccttgtaacgataatataaactatgtgttggtatttcttggggtgttt

SEQ ID NO: 111424 - DNA, 1188 bp, Homo sapiens
cttctcatagcttgctttttttcttttgaaatttacattaggagaagtacctcttgagaagtattctaagcagaacatgtattttaaaatgtgttttaagaaggaaaacattgaaatgcattctaaatagaattaggtattttaacaatcattgtgtgacagttttagatgtagcaaagtatctgctacttcaggtttgaattgcttttaatcagaaaatgctgttaatgagttatgttcaatctaggaagataggcttgtcatttgtaactaatgtactgaaaaaaacactagatatgaaaaagacccctgccctcttcaaatagcattacctgtggtatgatttattttagttctgccttcgaggatttttttttccttgtgaaattttttgctggcctgtatcagtagatttgcagagacggggagtaatccatttgtgcttctccccctgccccacgaccacaattgttggcttttaacatatgtcatcttaggcctcctccatattagtttatgattagtgtctgtaatggacactgtcagtccattgactcttggtctgattggagaattcttaccctggcaggcagatcttctcagacacactcgcctgagactgtgaacctgaggctggaggcaaggaaagaagagtagcccatgtggccattttctggggggatgcacagtggtggctgctgtgctgcttctagaggcaaggtctagttgttgctgcaatgatgatgcagtctgctgtgtccccttaggcattgttatggccagggggagattctgtgaactgtctaatagccgcctcccctttttttaaatcacttttctgtttaaattacctagaattagtttctgatgctctcaactaagaattctgatacttcagcatccagacttgtcactgtcgctggtcagatacgtggtagaagcccttgtgaagagcagtgatgtatctttttcatcctggctgcctgtacattctggtcagaggtgacccagaggactggaggaggacacagtcgatatcagctgtgggtcgtgggagctgtgtttgctggtggtcaggcaggactcccgaaccacacactagcccagcccactgggtctcatcatgtgccactctttactgctgctttttcctaattctttgtcccccaaaagttgggatgcctagga

SEQ ID NO: 111425 - DNA, 1070 bp, Homo sapiens
tgcaaaggcgctgaggtgggagtgttcttggagtgttaatggagcagtaggaagctcactgtggctgagtagaatgaacaaggggaagatgagtagaagatgagattggagagattagcagatgcagggtgtacaaggccctgagcccatgataagttttcttttgctttgaacagcttccccttccatctgtaactattgggtgaggtggaattaattttaatttgttctacatgctgaccagttgcccctctgtttactgaattattatgtcttctccattgagtttgaaatgccatttaattatatgttgtgtatgtgtatttatacgtatatgtttatcagctctctgtcattgatttttcttcttgcacacatagtataacattttaattactgtacctttataccaggtcttggcaaacaatggcccatggggcaaatccagccctaccacctggtttttataaataaagctttattggaaagcagccatacttacgtattgtttatggctgcttttgagctactatggcagtgtagttgcaacagagactgtatgggccagaaatccagaaatatttacaatctggcccttcatacagagtttaccaggctctgctttatactgtgtattgatatctgatagggcaagttcatcctcattctttttcaacaatttcttggcaggcctaacatgtttatttctccagatgaactttagaatcaatctgccaagcttgcctgacttccttcttttccccacctctttttggggtggagaactggggagccagcagaataggaattttgattgcattaatttgtggtttagtgaagggagaagtgattgctttacaacgttgggtctttctattccagaaatatctctttacgtgtatatctttcagtaaactttaattgttcattctgaacaataaaatcatacatattggagtttattcctatatgtattgttgctttttgttgccattataattgcgttcttgtcccagttatattttgcaagtgactatggtataaagggaagtttttgctttttatgtatt

SEQ ID NO: 111426 - DNA, 2175 bp, Homo sapiens
ctaatcttggagaaatagcacaaaataggagtgaattttaaagagcccaatcaggctgggtgtggtggctcacgcctgtaatcctaggactttgggaggctgagaccagtggatcacgaggtcaggagttcaagaccagcctgggcaacatggtgaaaccccgtctctactaaaaatacaaaaattagctgggcatggtggtgcatgcctataatctcagctactcgggaggctgaggcaggagaattgcttgaatctggacccggggggccgaggttgcagtgagctgagctcatgccactgcactgtagcctaggctacagagggagactccatctcaaaaaaaaaaaaaaaaaaaaaagtcaatcagagaggaccaaaaataaaaaaaataaaaaaaaatgagtagggatgatgatgatagatgtcagaagtatttagagagaggaaaaaattcttttgtccttagcagttcaatgatctgttcaagaaaatgaaataaaaatattagctactggtaagatatcttaagcggcaagctatttatgaacttaagttactgtatctttgtgacaatgttcaatgaaaagtgaggtgaaatagctatataaaaagtactgaagtggcagaatgagctccgtaaaatgttagtaagtgaaacaaggctgtgatacaatcagctcactaaaatgaaacatgagacagtgagatttttgtattggcacatctatttgtattaagtttggagaagtaaaatatattctctaattttgtaaacctcttgtactcttttttacttgaggaccacaaagcagaaagattaaaaaaaaaggaagtgaagcacatacttaggcactatttgttaagaataatgtgctacgtaattaaattattatgaaaatagcaagctggatagatgataaagggcctttagtctgaaccaggtgaactcaagttgccctttaaaatggactttctgtcataaatattaggatagacctgttgaaaaaatgttggcagtatttctgattaatgtgggaagaaaagctctattcattgactgatttatttgaaatcagatggggtcagttaaaaaatatttaatttgttctcttgaaacactgaacccaaaagaaatgaatctgaacttaaataataatctttgggcaaaaattgcacacaattttgattgctttcctaagtgtcatgtaaacaccaaaacattaagaaagagcttctaatgataggaggattgatttccgattcactaaaacgtcagccttaatatcttgcttctacctctgatgccagatgttcgtacctaattaagtactttaaaatggttaaaatagctcattttctgaagcagataaatattccgtaacattcttgtttatattatttgtatttttttttgtagtttaaagataaacttgtaaagtcaagtaatacaactcatacaagttgtaagtcggtgaagtctaaatttaatgatacaaataaatacaaatttgtagaaattatttatatttaagtatttttatcataaaaaaatcacagttattttaagaagcaagcattccttgaatatgtcttctaaaaaaatcctatctgccaagaaacttaaagttaactgtttgttttagtgacaaatggggaaaaaatctgaaatgatggtgttttatttactcataggtgttttaagtctctggaaatgtactttttttttttttagaagaatctgatttatacatgttttaggagcatttattcaacaaatatttactgagagtctaccgtatgactcagtaatggatgtatcttattattactgtaataagatactgtattagctgctgagtatgcacaagtgaaccaaacaggaccccgcaaagcagtatgtgcctttgcacgtgcacttgagaaatcctagttgttgctcttgcttagttgggatccctgcaaccattgggggagcaggtttggggtaaacagacttgaattgggtgttctctgtgcattttgtttatttagttcatgttggcaaattactattttaagtaaagttgtttccctaagcattaaaaagttgttttttttttgtagcctgaatgggttccagggtggctctgccttgaccagctgtgctgtgtggtcctaagtcaattcccttcc

SEQ ID NO: 111427 - DNA, 1057 bp, Homo sapiens
aaattaggtaatttgaattcttagaagttaaagttttatcttaatccattgatcgcccaaaactggtgcagagttgatttctttcctttcaaagccttgctgtctgtgcctgctgaggaccacagaattggtgtcttgttctttaagcaggtctcactcattcacttcaaccacagagctggagagatcttcctgtacttaatggtctgtgcccgcccagaatatcagccaagctgaggtttattctcacatgggtgagaattcgatagaactgtgaaaaacaaggctctttaaatcgcttctctttcagataagtgaacttgttaattttggtaactccaagggcctgttagattcgtttatttcaaacatctttattgtttcaccctgagtttagtaagtagttttttcttccttgtttcagaaacaacaaacgaacatcattgtctagtcttttctacctttctccatctttccccattctggctttgtgggtcatatcactaatgggccagaatttccacatgtattaatccagggaatttaagtgagatttttctgtttctttcttgctgtgactcagaggaataagaaagactctgaaaatgtaaaaataatgtcattgtttatatctcaaatgaatagaaaatattatctgaaagaagatagtagtgatttagaaaataatcaccagcaatctttaggccagtgatttttcaactttacaaaggcaggctactttgatacttttttggtggtgtggacgttattatcagaattgttaaattctaacaatcacataacattttgtgactttgtagcgcttagtattttctcaccacagtctaataaaatatagtatgataaagccagatttgaaactggcagtgtagttgcagtttctgagtttcattcttggcctttcttttttaaacaactttatttacataccataaagttcatccattttaagtgtacagtttagtgatttttattaagttaactgagttgtacacaccatcactacaaaccagttatagaacatttctattatccc

SEQ ID NO: 111428 - DNA, 1364 bp, Homo sapiens
tgtgataaaatgctaaatgtcgtatttgagtcaagaatgagataagaatgtccactctcactactcttacttgccattgttttggaagctactaggcactgctgttagacaagagaaagaaacgaggagtgtaaatattggaaaggaggagacagaaatgatcattgcagatgaaatgattaaattattttacacttggaaggccaaagagaattgcctgggcaaacttagaaacactaaataaatatgtatatattccatgcatatacaattctatagatggcttattttgagaagtgttgttaaagaagctctttaataaatagttgtctctgcagagtagggaggagttagaggggacaacttcacttttggaacattttattttttattttcaaatgaaactttgtatcatgtttatgtattaatgtacaaaactaaaatagtatttggttttcttctgataatcaagataagaaaactaggaatatataaatatatatatttatatataaatttatatttttaaatttatgtttatacatttatataaaaaggggatagaaggggacaaaaccccagaaaaaagtaacagatttgaatatatgaagtaaaatattgtgtaatgaagtagaacatttgtgattaaaaggaaaataatggcaacaagaaaaaagtatttgctttggccagattatgaggaagggcctgagtttgaactttagggggagccaaggatttgaagcagaaaaatgacgtaagacttcccagcaggagctccgggtgactttagtgttcctcctttgttaagaacagccaccttatactttgtgttagtgaaagtcttgttgttactttgtattgaggttactcctgtactttgtctcccttcatggagggcagggactgtttgcaccctaggcaactactgcagtgcatagctccaggatgtgtctaacaaatgttatgggaatgaaatggatacatactaagaaggtgaattctgctggacttggtgacttgctaaatctagagggtataggaggattgtagagcgtttcctatattctggtattcagccattcatttagtccttcattcagtttttattggaccagctattctatgccagatagtatgctgagcttgtaagaagaataaaggaactcttgctcttgagtttagagggaaagacagatgagctgggactttgaatgcagtgtgctaaatgtgtgagaaccattcctagcattgcgaggggtcacagtactgcctgacccagcctctgcaggtggggagattgtgaggactactcctttgctctcagtcttaaaggttgaataagttagccaggggagttgggg

SEQ ID NO: 111429 - DNA, 1049 bp, Homo sapiens
gaacggaaaagggggccttactgtctttatcaagaacagagtgataacttgatttttttctatgtaaaagaaacatttatgttttttcttatttaattttatagagactattatgtggttctttgctatgtttccaaaaattattttatgtattgaaattattacccaagtaagagtagaacattaagctgttttaaagagcaggaattgaattcagccttaactttagacaaatggtatataccatattccaacgattgaaggacatggtgataagttgatttaaatgattgtacaaagtagagtcctttaaagatactgaaattcgagaatacttttcaacttagacttgatttttttttccaaaaggagttaatggcctttaagtcttacttgttgacagtataatactactacagtggtaatagtatggtgtgcatggtcagatttaatttacataagactgtatttcacaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtc

SEQ ID NO: 111430 - DNA, 1031 bp, Homo sapiens
ctttaaactttttattttacccttaccatttctgtgcttctgtcatctatcttggcccccagcagtgctttaaattttctaaagagcctttggaatgtctttcacttattacatagatttttatcttggttttttttttggttttttttttttttttaaatgtattccagttcaggtatttcaataaattacccaacttggcatgaaggtttggggacacctgggtcaatagtattttgccacagactgggccgtagacacaagaaaagaccattacattgaatttaagaaggaagttttctatgagaactgggccaagcttggcagagtgttttctaaacatgtagtcagagggctgagagtgagttgggcttgagaggggctccggaggttccacatggggtaccgtagtaagtatatgacagaggagtggcagcagggcctgggcttgaagttagaggctgagaagactgggagacaaagggcttgctggtatgtgagggattagctgagcatttagtctcagaggcagaaaagcctgtccaggatgggagagcactgacgttgactctaactgaagaagaaagggaggcacagctcttcaagtttcctcacccccaaataccagtactcaataaaagatagttattgtcattcttttttggcagttatgagtcctttagaactctatttctggcctggcatgatggctcacgcctgtaatcccagcactttgggaggccgagacaggcggatcacctgaggtcagcagttcgagaccagcctggccaataaggcgaaaccccgtctctattaaaaatacaaaaattagccaggtgtggctacttaggaggttgaggcaggagaatcgcttgaacccaggaggtggaggttgcagtgagcagagccgacatcatgccactgcactccagcctgggcaacagagcaggactccatctccaaaaaaaaaaaaaaaaaaactccatttctgtaggaatagaaatatccttaaaatttataatcatattaaa

SEQ ID NO: 111431 - DNA, 1041 bp, Homo sapiens
tttttgtatttttagtagagacggggtttcgccatgttggctaggctcgaactcctgacctcaagtgatctgcccgcctcagcctcccaaggtgttgggattacaggcgtaagccaccgtgcctgaccatcattgctgagtagagcagccgatggctgctttttaaagtgtccttgtgatgatgaaggcatgggcatatcaggattttatttcaagccttcagacgaggcaccatcaacattttcaggtccatttttatttgtcttaagaaggtgtgatacccagtttgtatagtactgagttctttacgaaagaatgtccctctacaaaagaatattacctgataccagaccttgcccatgtgttttgagggccctatctcctgggaagtgagaagcaatttcctggaagaggtctgcgtctgcgttctgagtccagggtactccttcaggctgtttgttgggaaccttgcttgccactttgtatgatgcaggtggtggcaggtgggttctcagggtgattgccacttgatccttgcaattcagggtttagtgacaagcctgatccactgtaaaggcatggaggaaccgcttgctttttgtggtatgaaactctgaagttgatgtcctcatcagtgaggtggagataattattcagaataacttttaaggttctttgtagtgtcctcatcagtgaggtggagataattattcagaataacttttaaggttctttgtagttcaaaaatagtccaacttcaagtttaagaacctctgcctaccctcccacccccaccttccaacctttctagattagtcatttgtttggcaaatgtttgaatgacagtgatgtgccaagtgtagtattccaggccctagggaatcaaaaaccatgagtaagataaagtccattaagaggaggggcttataaacaatattcagacaaaagatccagaagtcataaggtcacttgtctttatgccagtaaagtaactaaataagcattgtatttgtgaagtatgtgcacctagtacacaagaaa

SEQ ID NO: 111432 - DNA, 1027 bp, Homo sapiens
tctagagactaaggaaatatgacagctaaaagcagcgcatgatccttgattggatcctgattgaaaacagcagctataaaagaaattggggaataattgggaaatttgcaggtggttgtatatcagctaagaaagttaacattgatacagtagtaagattgttgatggtgttgaagtgcttagggatgaagtttcattatgtttgcaacttttaaatggtatagaaaaatgtatatgtatatgagagagagtacataaatataaaaaaggttaattgctggatcaaggggatggtatatgagtggttatttgctattctttcaacttttctgtacatttaaaattttttttaagtgtagaaaaaataggttatggatgtgtttcaacttcagggatttgttctttcctttggtattgtgtttatattactgcctctattaaaaaaataaataaatgaactcaggtcataatttgcctttattctgtttttctagatgtgatacaacagaaaaactcagaaatactttggattacttaagatcattcttaaatgattctacaaactttaaacttatttacagatatgcgtttgactttgcacgggtgagttctctggagcctatccagatgtttccctctcttccctcccctttttaaattgccttttgaggttagtttttacatgccacagcaaaaaaacttgaataagttaactcccaggatgctagttagtatttctttctacatgtatgcttttgaaaactaagtttgattctggtcaaacattctgtaggtcagcaaaaagctctagtggcagacgtttactggctcttggaattggcttaaaagtgacatgggcatgcaatacacactgtcttaaatgtctcttagataaggttggaaaagctttccttctcacagaacaacaaaccttctcctgttgagtttactagaataagctaatcatatctaattcagattcaccgtgggtgctattattgtatttggaaatcatgtgaattttaga

SEQ ID NO: 111433 - DNA, 1158 bp, Homo sapiens
gcttaattaccggatagattcagtttagctaaaatatgctctaagataaattttttaatgaatcctgttcttttttgctttgttttgttgagctgtatcttcacagattttgagatgttatattttcattttcatttagttaaaaatattttctagttcaccttgtgaattcttttttggcccattgattatttagaagtatgttattttccaggtatttaggattgtccagataatctttctattattgatagtttaattctgttgtggtcagggaacataccctgtataatttttatctatttgatttatggtccagaatatggtctgctgcggtgaatattttatgcgtactttaaaagaatgaatattctgctgttgtcagtggagtgttctataaatgtcaattaggtcaagttagctgatagtgtctttcaggtcttctgtattcttcctgatttctacttgttctgtcaattactgagagaggaatgttgaactctccacctgtatgtcttctgtcacctctgtcacttttttgctccacatgttttgaagcactgatactaggtttagtattgttatatcctcttgatgaattaagacgctttaccattatgtaatgtctctctttatctctagtaatattccttatattgaagtctacttcgtccaatacaaatgtattcactccaactttctttttattaaagtctgcatgctatatcttttttaaatcttttacttttaacctgtttgtttctttatgtttaaagtggatttcttatggatagcatgtggttggatctgacaatatgtgttttaactgggatgctgaaactattacatttaatgtaattattggtatggacaaaatttatatctcctcgcttgctattttttctctatgtatcccacctattttttgttccttttttcctcttttcatgccttctttttggatattttcactattgccttattaacttttttttcctagtagttgctctgggtgttccagtatacatctttaaatttcacagcctaccttcatataatgttatgccacttcatgtataatgcaagaatctttacaactgtgtactttcattttgccctctcatattttatgctgtttttgtcatttattttatttag

SEQ ID NO: 111434 - DNA, 1008 bp, Homo sapiens
catttttattactatgtcttccaatattaatcttttcttttgcagtgtttaatctgttcatctcaaccagtatatttttcatttcagatactatatttttcatctttaaaagttccatttgggtcttgtttatgtctccagtttctctccccatcatgataatatttttttctgcttcgttgaatttctagaacatgtttatagtaggtatttttataaccttgtcttctggttccatcatctgttaattctgtgtctctttctgttggtttatttttctcttggtaatgtgagttacttgcccagcttctttgcattgcttgtaatttttttttttaattggagctggatattatgaattttaggtatttggttgctgtgggttttgttgtattcctttagatagcgttgagtttgtttgttttttaagtgcataaattacctggaatcagcttgatcctttggaagggctgtccaaagcagtcttgatagggatgatttggccccactactaaggcaatattttttttgaggattctacccaatgccttgtgtgctatgagatctttccatgctgactggtgggattacaaactgtccccagccctgaataaaccctggggacttctgctcactcatttgcaatgtttcttttcagactcaggttgtttcttcacatgtgtatatggccaaagactgaaggagaccactctggagaccttcacatctctttgtgtagttcccacctcactagtatttggctgcataaattatagttatctttgccaccttgaactccaagctctgtcttttccaactcagcaagattgctaggctcagttttgggttccccctcctttgctatggcctagaaaccacctccacagagtaagctggtatcaacctgaggcttaccttatttattttctttttcttggggatcacagtcctgtgttgcctgtttttcatcatctgaagccatcatttcaccttttttgtccaatttcc

SEQ ID NO: 111435 - DNA, 1015 bp, Homo sapiens
ttacagccctctatttttatcttttggttacttaggttagctgggttaaggaggactgcattttctctatgtctgtttttcctgtggcctcaattggaacaccatgacacatgtaataggtcttcacttaaggccttttgatttcatgtaccaatttctgacttcaccatttatgtttggaattgtgatttgcctgtatattatttcttgattccagctagtctctcttgaaaatcttctgggttttaatttttcccgttgaatttttttctttgtaattttaataattcagggttcctcttttcctcttttcatatgtaagtcttaagctgtaaagtttggtataaattggaaatacatcttttgaaatagttaggggcctttgatttagcagatctggatactcagatgtttaaaggttcatttttgtaatatatttctatttacatgtttacagttaactattttgtttcagttgttaagtcatttgtgtcatctaagaaaaaaatgctcaattgtcaccttttagaggagaacctatactgaaacagtagtatgtgaacaaaggcactggttttttatttcatactagaactctaaatcagattgtaataaaatttcactgttctctacactagctcttagtctttagcttatggagtatatttattccatttataaaatataacgtagaatatttagagtaggatcctttggttttgcagctgtactatatcattctataacttctatttttaatctgcattaaggaagaccacaaagtagaatctagttgtatattgtgggggattggtatatctttcgtgtatagagcctgttcagtttgtattattatttgaaaaatgacacaaaattccgttgctttttatcttagtaaattaaagtttatgaaatacctacatacacattttgggtcaagaggtgggtagggagagatgttttcatttccttctcctttaaccttgatgggccttctggggatgctggttggctc

SEQ ID NO: 111436 - DNA, 1047 bp, Homo sapiens
tgaagtgtcattctgtgggacctggaagtatatgggatacaagtttgagttacttgggttgtcatatatggcatcctcctttccctcctgccccaagcccttctaaaaagtgtcctttgcttgcaaggatgagggtgttgggtctttgagaaaatgctgggccgtaagatgactctggcttcactcttgaataatctttctcacaacttactttatgtaatggtccagaatatttttaatatctgataggattctttgagaactgttattaaaaatttcttttaacattactaagtgggactcctcaaaaatttaaaaactagttttacgtaagtatctgtttacccaaaatagtccatgttgacatatggtctgttctaatttctctgacaatcccttgagatgagttagcattatttggaaaaataaatagaaatagttccctgttctcagagagtttagctggatttacacctgtgtgtaaagagtcttaagctggaagacctggcctggaggaaatctgactttgtgtaattccaggtgcatcatcaactgtttcaggactggtttttgcttttacctgcttagaaagttaaacttgtagtctgtgctttgttctctctcttacattagtttgcatttttctttaaaaaagacagtattcctctcatttcagcttttcttgtgtttgcatcctcaaaaccattgactcaactctctttgctttttatgtacttgtattgttttactatgtttctgattttagtggggaagatttaaaaatcattggttctggattttatttatgaatcttcatacagggatactgtatttttaaatagacacatggcaaatttctcgtctaagaggaatagaaaaacgatttcacagctattctagcttcttttatgatcagattcgagttttgaattattagaacagtaatttttttctgtgacaagaacacctaattttgagaccacttgcagcacttaccggatctcgtcaagtaacctgctgctgcatgtgctttaagccgaaggcttg

SEQ ID NO: 111437 - DNA, 1117 bp, Homo sapiens
cactgtgattatgtgtatattgctgtttaaattttgtatatgtgtataaaaggaaaaaggttcacctagagattatttctgaaaaatgtattgtaaaaataattttgtggcatttctagtccctttttttgaatgaaccaattatactttatttggtctcctatgtagcatttcagaaaacaagagaaaactgttaccatgaacaaacattgccagaattaaccttactgtttaagaggccaacttctggaaggaggtaggagtcataactttttagaggcatatgccaaatatcatttggtatacttaacaatattagtgttttaaaatgatgagttataattatttgaacatatagatatgtaacatgccacaaatcatttctaccatgcaaggtgtataagttgtttattttttagtgttaaaactataatagcttgaatataggtaccaatgaacaaattcaaattgcacctcttttcttaaaagaatgggatttaaactcttataaacattctttaacttttttgtttgtttgttctctttttttccttttgcattcttctagccagtgattgatctgctaatgctttctttgccactctaagtaaaatttatttcacctcctcaatgaaaacctcatggttttgctggctgtttataactgcatcgcacttctagttgtggcttgaattttcagttaagctttcatggtatgtaattttccagccttttgagaaaacaagcatactataagtgagagctgttttgttttccttgtttgtttgtttcatgctaggcttttcctggcagcatgtccattgcaggcagtggacaagaaaccaccagcattgagctaacccagtacatgctaggacctgtcctagaggggccacttttcattacctgagttatttgtacagaagggcaatagccattatttttgtggatgaggaaacaagaataaacagaatggtatttttaggtttgtattttatgtctttttttttttttttttttgccattcttgaggaaatatagagatgacatgttttcaccccaactatctggtgctattgaatgactaattcagtccctaaagttctgtgaaaacaca

SEQ ID NO: 111438 - DNA, 2450 bp, Homo sapiens
ttctttgcaaacagtgttcacattttcatattttttccctaactaaaccaccaaagaaagaaattttgtatgtatatacagtgtgtgtgtatacaaaatcatgatatagtagaatgcaactactttctttttctaccaaacgaaaggttttatttgctgtgaaataaaccagaagtttaaaaaaccctgtagtgattaagcatacttaaccactccttatttgtagattcactttcaaccttaaaaattaataccagtttgcataaaccaatatctgaaaagaacaggaaatgttaatggcaagcaacagctattaatactgatgtgatggatgcatttgttttgcagtggtgactggcctaggcaggtttggatctgtgaagaattgattcattttcaaaattattccataaagttaaaaagttacactttaaaggcaacaggtcatacagttctttaaatctgatcaactgtagctttatttaaagcaaatataaatcatagatgaagttattttaaacactatgttagaatatagagatttttaaaaaatgctgataagcacagttaattctaaaatgagaggattgttacaggagggagatgttacagttaatccacaatcaacattttgatggtagggaaaaaactgcgtaaaaactattgcattatgtatgataagaaagtaagtattccaaagggataatcttgcatattaagaaaactccaaataatctttaaactgccttgaaaaataaacctctttgactgctgagcggcagagtgcttacccttgattgtcttgattttatatatttatttctaaggggagaaaaaggggtcagacagagtaatatgatacattttcttaaaaacttctctaagttgcacaaaactgaacaatcatcaagcacttatttactggctaatgttgaataaattagggtgccttcatctgggttttctttagtacctaagtctacaaccctttctctttttctattgtgtttcgaactccacattgcaatactctgttgtcatggaatacaacctttagatgtttactgctgaagtaggtcagaaattgtattatttgatttgcctcaaacatccactgtaatgttacatgcaccttttttgaagcatgaactctgaattatgtttttataaatctgactaggcaaacctagattctggtttcacaatggatttattttctctctcagtctccattttaacagtgcttttgaagtttatacagaaagctttaaaagttagtttgtgcccttggtttttattcttaaaactgctaaaatacctctgtaagccttatcctttattctttcatatgttgtataataaatgtatagatttcattgaccaactaaaatgttgggtgtctgtaaatgagaccaaaacgtgggttgcttttttcataaaataatttctattgggggttactgttcaatgacagcaggtaacctataactgtgaatgcttcgtgtcgtcagtatttgcattacattcataaaagtgtgcaagtcctgtgactcccagcttaactgaaatactgttatgccacctaacttgagtacagcaaactggttttaggtttcaatgacattgatgtaaaatgatatcccatgaataaaaagtatttgtgtttggtttcagaacagatgtgtaaattttttcttctctcttctggctttcatttcaaaaaccatttaaggtagtctttaaagcattttttatccttttttgtttgttttttttccaacttcttctattgaaaatttccaaagctacaataatataatgaacaactgtgtacctgtcacttagattttccagttgttaacattttactgtatttcctgccttactcttgggctatacgtgtgtgtacttctcacattctgtaaatagattctgagagtaaattacattatgacacatcacacctgttaatttggaataagggcattcacctataaccatgataaaatgatcacactcaagaagtttaatggtggtactatactataataaacagtgcagatttaagtatctccatttgtgccagtcatgttcttgatagctattatctttttaatccagggataagcattgtatttagttgttacgcctctttagtctcttttaatctagaacactttcagatacagtattttaaatgttttgattaaagatagtgcagtcactcctcagccaaatagtgattttaaaaaaacccaccatgttttgtgtatttctacacattgagctaaagaattaagtacataatgtgggccacaagctaggcaggaatgaccactttactaccctcaaggctgccacgcaattagtctataagtgtgtgttagccctggctacccctttctaaaattgtcttacactatactagaatgtaagctttctgagggcag

SEQ ID NO: 111439 - DNA, 1075 bp, Homo sapiens
aaaaaaaaaatatatcaagcgaagaaataacacatcaagctttctggcccggtaaggcagaaggtaattcaaaatcgggcatgttcaccacttttggcacattcagcagaaaaatgtttagttttttctctgccagaatttgttcctagcatttatttccaattgccttaacgaaaataaaatcatcccatgtatagaagtacttgcttagaaatcatggtgaattagtacgtaggctatgctgagaataataattggaaactgaaaaacaaagattgactatagtaattaaatggaaactttaaaaaccatcatttaaaatgtaaatctcttctccaataagtgtattcggtcctttgaaagaaactcctttgcaatcactctctgaaaaatatagattgtaaagaatcctggctgtgagaaaggaagctgaaaagggtttgtttttccctctgacactttccagcagagacatctcagaattgcctaagtgtgaatatctaaaattacaaactagtgttctctagaaatcttaggatacatgtgtgatgataaagagagctacagctgtactcattaccagtgaaataactcatgaaaaagttttgggccaactttcgatagcatgttgaaagccactgcgttttctttgtctctacttgcttattgttcatttttgcttcattacctatggtggcttctctgtatcccatagtgagagtagggcctggacaaggtttgtaatcctatcacacttccaaaattattgaataaaataatagatgccttctagcaacctgttccatgtgtctgtgttctgtgtgtctcaaagtgctcataaatccttcaagtccttattttgcctacatcagggttgattttcagattctcaatataatcattgtatcaacaaactttaattgtgtgttaggccgaattcctatgtgaaattggtaacacaggcattaaagtttacaagagtgcatagaggaaactggaataatagaaaatcaacagactaaagaattaggaaagacctatgaatgggaggcctatgcccactgagtgtcagtgc

SEQ ID NO: 111440 - DNA, 1037 bp, Homo sapiens
atctctgctcactgcaagctccgcctcccgggttcacgccattctccttcctcagcctcccaagtagctgggactacaggtgcccaccaccacgtcccgctaagtttttgtatttttagtagagacgaggtttcaccgtgttagccaggatggtctcgatctcctgaacttgtgatccgcccacctcggcctcccaaagtgctgggattacaggcatgagccaccgcgcttggccaggaaaagtctttttgtactcatgatcacaaacttaccaatcagtacctttgttatagttctcttaggacttacaaatgaaaatgatctgaaactttatcaacatcaattttattatgaacttaggaattctgatgtaattttaactaacaatagaggaattatgttgcagatttatttacatatgttatggatatatgaagtgaagaagtcactcattgaatcctgatattttgttttttattgttgctgttgttgttttgtttgtgactttactctttcttactgcttgcttttctcattgatatttcaggaagttttgtttactgactttgttctgtaccccctcatggaggtaaataaatcatattactattctcctaataggaaaacagtatcatcctaaatggatctgtgatggtcagcaccacccgcctacccagttcctccagtggagaccagttgggtagtggtgactgggtacgctacaagctctgcatgtgtgctgatgggacgctcttcaaggtgcaagtaaccagccagaacatgggctgccaaatctcagacaacccctgtggaaacactcattaaaagaaccccagaggtcaccaacatgtttatatcttgacttgacttttttatgcatgcaaatcattgtttttacagagtttgtgataactcataattattttaatggcagagcactgctgtatctgttttatggtctacatagttaaaatcttctcagagagcctaaattctaatacattttattaatttatactaatcttcatatttactgt

SEQ ID NO: 111441 - DNA, 2012 bp, Homo sapiens
agaccagcatctgaaataggagggactgagtcattcacctgtagggcctgcacaggtagagtcggaattggttggaattgaacgctcagctggtgtccagagaatcagaaaataggttgttggtgtggaaaacccccataccttttgggtcagaagtgttgtgaggagatacagctcaacaataaacatttattatctcatcatttctgtgagaaaggaatttgggcgcagcttatctggttggttctggattggagtcttgccaagaggttgtaatcaagacgttgtcctgggctgcagtcatctgaaggtttgactgggcctggaagatttacgtccaaagtgactcactcatatgactgtctggtggttacaggtgtaggcaggaggcctcatatcaccagttgggcctctccagggcgctgctcagtccatgacagccggcttccctcccagcaagtgcccaagagagcaaagtaaaagctgtaatgtgttttattcctggcctcctaagtcacagcctgtcattttaacagtgtcctattggttacccaagtcagcccaactgattacagaagggaattaacaagaacatgaagaccaggaggtgaggctcttcaagggccatcttggaggctgccaacccacagggctcacatacacttttcaaataaatgaacaaaatatttaatcaactccaagtcctctgtattcagtccatttggatctaacatgagagataatggcttttgacgacatgcaactttttactggctttagcattttcactctggaagacctctgacaagtgatctactttcattgtgcctcaagtcttaaaacaagagctgtaagatcaccatgaaattaaataattttagtgccatggagaatgttcattaatgaaaccttcccacaggactggccccacgcaaaatcatgaagctaaagtagcttgctttttctaacccatctccacaaatctccccaatttcccccacccctgctccccgaccctacacatgcaatattcagtttaatgtacagaggcacgtattttgcaggatttgcttccacatgccttgaaaaagtgccagttggagataataattgtgtatacatgcatgtttcagtaaactcgataaggccaatttttcctgtagctttaaaacatgtcactgaatctcagttgaacacctgatgaaaatggcttacaaacagaagttgagatgtatgaaaatcctgaacactggagacatttgttgtggagagatcatcaaggagtgagatcttgctgaggggcagcggattcctacagctcatctcaggctcacctgaagggtacatgaattgagcggaaggatggatagagtttgcttgtttgttcatttaacacatattttccaagcacctactttgtgccaggcactgttctaggtgttaatctatgctcactttgggtttttgctcaaatatcatcatttcaagaaagcgtagcctgactgccatattttaaattgcaattttgattgcagtcttcccaatcccttattctgctctacattttcttgtttcataacatgtgttatgttttactacatactatgatttacttctctattgccttttgttgtctttcttcccccccccaactccatgccagaatttctgctccacaatggcaggaatctcaatctattttattcattgatacagtgcctgactcataataggaattgaattgaatgccccgctggtgtccagagaatcagaaaataggttattggtgtggaaaacctccatacctttgaggtcagaagtgttatgaggagatacaatacagctcaacagtacacatttattatctcatcatttctgtgagaaaagaatttgggagcagcttttctggttggttggttggtattgaatagttggtgaatgaactgatgagtgctggcagcataagaatgaataaaacataccaaattctctgtcttctacaaattcattca

SEQ ID NO: 111442 - DNA, 1011 bp, Homo sapiens
ctttgttattatgtatgtcttagtccattggggttgctgtaacaaagtatcattaaatgggtggcttataggcaacagacatttatttctcacagttctggagactgggaagtccaagatcaaggcatcagcagatttggtgcttagtgaggccctgtttctgtgttctcacgtggtggaaggagtgagtggtctctgtctgggtcttttatgagggtgctaatcccacccaagaggattcttctgcccttgtgatctaatcaatgcccaaagaccttgcttcctcataccatcaccttggcagttaggatttcaatgtacgaatttggggagacacattcaatctataacaatataatctacagaaacattaaaaataccctccctggaattcctttaaattcaaatgctttatttaatcagagaaatagaatagaagagtagaggcagaaatcaatttctttagattaaaaaagctttgcaatgcattaagagggaacaaaggaatttaataacacaaagataagtgacagtggcagacaatcccccaacactgactctcacacaaacagtacactttttcccaatgcaagaggggaaatgctactaatttttcactgaactattttctcttctccagtccaggctggacttgataaatagaaagtattcaaacaagaaatggctgagatattgtaaaataataattaaaccacatacacaattgctctagctgaaaaggtctctaagcatttttctgtggataagaaatgcacatgtttacctggaagcttctgtgtgttcataggatatggagagtgtgattaaactggaagataggtgaaacataaaagtaaactggattattctactaagaaaagttacctttttgttgaaaaatgaatgtactactaggtcttgcttttgtcccaaataagtgttcaaccaggagatttgaagcttccacaggataaaaaaggaaaatacgaacatgctatgcgtatggatttt

SEQ ID NO: 111443 - DNA, 1031 bp, Homo sapiens
tataagtctcttgtcctttttccatttccatttttatcactctgcaatctgggctatatggatatttaataatactccctactttgaaacgatgggaaaaatgaatggagaggaagagaaatctggttgagttttaactattaaaagctgtgagtcaaaactgggaaggggatgaggttaaattgagaatttgggattttctctagattgggttgtttttgaggtaactgggtgccaatgagtatacatgtccatgcaggactttaactgcagttatggtttttattgcagtcggtgattacctatacatgttcaaagttttatctactacatatttcatgcctaatatattgtttctgttttttgtttcaggttagtagcaaagatgaagattttcttgacctttctgttgatgtggagcagaatacatccattacccactgtctaaggtatatgaactctgaggcagtttgagcttttgatcaggcttgtaactaagtgggagagaaaatcctgtatttcttcaggacataatcttcccttctgttaaaccaatatgatcctattattttctatctctcctttcccaagagcgattatgtggtctggagaagagtcccactgagaaaaaagagcataaaatggaagtcattagtcaaaagggcaggtggcagtggctgtagatttgagatcagccaggtaaagtgttaagtgattggtgataatttcaacctttgggaaaccttgttataagaaatagaattgaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacaga

SEQ ID NO: 111444 - DNA, 1736 bp, Homo sapiens
cttgtttttgatattttgatacatataaatatgtatcctttgtgttttgccttttgctcagtatcccttgtgagattcatttgtgttgttgcatgatgctttagtttattcgtttttattgctgtatggtattctgttgcatgaatgtgccacagtttactaattcattttactgttgttggatatttggctattgccagtttggggcaatatgaacaatgcagctatgagcattttaatacatttactctagtgcacctgaacccattttctctaggatgtgcacatcaggtaaatctgttaggtcatatggtatgcttttcattaacatcattagaaagtgtcaaattcccaaaatggttataccactttacacactgagtatatgagcgagtgctttcatttctctacatcatctgtccctgctattctcatgtcttcacttttgctaatctagtggctttgtacagtattcttttattcagtaaatatgtggggtttttttcccacatttgctatgtaaaagcctgaagcactgagcgtacagtgagagccctgcctttctagaacttccagcatggagacagactttaatgacaaaatgaataattagttaagtaattataattgcaagatgccgtgaagaagaagaacagattacttcatgagtttatgatatggaaaccagaacaagggggcttcagttcctacatttgtagctagaaaacctgcaccagactctacagtaacactgttgctaaatccatctttactctatgtggattttcaggaagcctcagaagatgggctcagacacatctgtagttgttgttgttgttgttgtttttctatgaaaaggtcagctgaccccaataaatgcaaatattgcattgtcaagtatttatattgcaaaagcttttacctagcttgttatttcctggagggttatcttgagtgggaagcctgtgcccaaaaatgcctttgaaaattttggatgatactgtagtatttgttataatgggattccagctgtttatacttgctttgtagaagtagatgagtgtgcaggtatgtctttctggaaaatggggcaatctgaaaagcctacttttcttccccctgaaatgatgagatgattttaggcaagagtgttttttctctggagttacttggataattacctccattttcttagatccttcaactggatgggatcctagcagtcatttaatcttttttttctaccagtgctgagtcccttctatgatatcctagccagttggtcaacagcatctgatggaccccgtccagaggcagggaatcaatctcccaaggcgttgcattccatttttagaaagctctaattgttagaaagccctgtactttctaagaaaacacagagcctgcaggctttttctgttactataaagtgttgaggacttagtgtgcaagaagaccaaatgggaaagatttccttcacctggatgaaaaacagggagcctcttttgagtaacaccctttgcctagggcagacagcctttagatggtgcttcagtcagaattgccaagacccatgtttatgaagtctcactgtaggattaaatggcactagatcctgagcagcaaatttgcccctgggggcaccttgccattgttgctgcctcagctgctagttccttcaatcctggaaaacctttttgccagccttcatgctttcagaaaacaatgattttctt

SEQ ID NO: 111445 - DNA, 1154 bp, Homo sapiens
tggtgatatgttgctaactaaacaggtcaggcattcgtagccactctgggtaagtgcccggtggttaggtaatgtgtgacagccagcagccaaagtggacatactcagagacagttcctggctggctgcccaagccttacatctgtagctaaagaattactgaaaatgtgaatgaaaatatctcctctcctggcttgtggtccagagctcagactcaggaaccgaatttacataggtttgaatcccagatctgctcttattggctgagtgagcttgggcaggttccctacatttttttcatgtgtagaatggggatattaagagtaatctgccttggggtggcaggcaagattaaatgaatatgtagatgtgaagttctctgaatgagtggcacctactgctaacttttcccctgcttcccaagtttattcagtgagcaaatttatcaagtgccttctatacaaccagacattctactaggtgctggcaaatgaatcagacctaattgctgcccttataaagcttatggcatagtacaggggttggtaagcttttctgtaaatgtctggacagtaaatgctttagactttgtgggccgtagtgtctctatcacagctacgcaattctgctgttaatattgtgaaagtagttgccataagtaaatgaatgatcatggctgtgttgcagtaaaactttatttatgacaacaattggtgggtcatattctgcccataggctgtaatttgcagacctgtggtctagtgggaagacagttgttaaataattacaattatgatgttacagattgtgctaagggctgtggaggaacagacaggattctatgagtgggaagggtcagggaaggtagctttgaagaagtgacattgaaaccaaatgatgaggagaggcagccagaggaggagatggagggtgctccaggctggtctgtgggttcgtatcttttaaaggcataacagatattctgcagctttctttggattaaaataaataatttcgttcctctatttaattcatcgccagttttctcctcccctaccctctccctgcaataatccaagagataagctatgttaccaagagataagctacattaatatattaacacattttgttctgcatatgcactttctttc

SEQ ID NO: 111446 - DNA, 1136 bp, Homo sapiens
ataccttctttaaagctttttggggagcatcagaagagatcctgcccatggaagcactgtgtgagctatgatgccttcatgcttgttagttttcataattattctcactcttttagttcatcattattttccttctgtttgctcaaagtgcaaagctgttggtatttcaggatccagtgaaattctacttccattttgacctgctgtccacatttagtggggcactttgggaggagtgacattggggaaggaagttggcaaaagcagaggccaaattcacagcatggtttggttctgactgggtgctgtggtggtgagggggccctgtggccctgtttctgtggtattgggagacacgggtagagagaggcccacaggactcttctaatcattgctgtagtggatgacaggacaacaggaaactgtctaattgggttcccaagtcagatacttttcaaagagaaaagaatgctcagagtaattataaaatattaattgatctgtaggtgtaatctgagctattcagggcaaactagaggtaggtccctctaaggttaagctaccataggacactcctatttaaatgcagagtttcagtatgcttcaggaactgggtttccctgcctcatgaatcagagggtaatgtagtaatggagagaaggcaaatacaaataaataaataaaaaataacattcagaacgaatgcatattgtatggttggcagtgtaggggtggataacctattatttccaagcttttcttactctagagaaaaactgtgggatggatccagttgcttaggtcagtgatactcaaatgtcagtttgtcatcattgttcatggtttttgctacatctgtgtatcacttgaacttatttacttagttttccttaaatctgttcaccctaatttgaccttattctgaaacatctgcaaaatgatgggtttgatgagctaattttatgcttttctaatccttttcaaaaacattattgctacacttaaaactgttcatactggtgccacctaagagtaactcccctccctccaggattcatggcccatagtttgggtgacattggctcagataagaggttttttgtagtggctcaaataatcggctcttggaggagcac

SEQ ID NO: 111447 - DNA, 2710 bp, Homo sapiens
gacccaatctctaccaaaaagaaacaaacaaaatcatgtaaataaaaatgtatcatataaataaatgaagttatctggaaataaagggaaagtaaacattacaattttgaaacaaaactagagtatttttatagttttatcttgataagtcaactacttacctaaggcaagtattttgagaatggttggaaacaactttttaattattaaaaaatatgtccatcttgtgatttgggggaacagatatcttgccttttcctctgttactgttattcatgctttccattctcaaagatagttggcaattataagtttagttaatatatcagctaggtgtaaagtcatatgagggtctactctgatagttgctgggattagaaaatacagtctgaggtgaggtggattaatgtttaaagaaaagaaattctgtttttctggccccactggtctcatatgcagaggtttatattaggtcgggacctgacaattagttctgcggatttttctgtttttcttggactcctcagagaaaacaaagttgaatgctggtatttagttagaatgaaagattatgataccttttctgtataacaactttatgtgcttcagttcactcataccataaaatctgtttatttattcttcactaagtggaattttggtatgtttgggttataattgaaaggcattttcaattttgattctcttagcaattaagagaaatttctctagctcagatgtcttttttttccccctcctggtctttctagttagtgtgaatagattggggttccatgatggtattaaattctgtggtatcatcagaaaggtatttggtaaccacctatctctatctctagcttacccatgaagccacccaaagctaactaactggaagagatgtaaaagatggtgtcttttagtctagttaacttttctggtctaattattttaatgcagcttcttataacaaaccttcagttgtggtggaaccaaatgctgatctaagggtttgaaaggccttggtggtctttaagagaaaaggccacccaaaaatcaatcagcaaaatcttttttttttttttttttttttttgagatagagttttgttcttgttgcccaggctggagtgcgatggcttcactgcaacctctgcctcctggattcaagtgattctcctgcctcaatctcctgagcagctgggattacagttgcctgctaccatgcctggctaattttgcatttttagtagagatagggtttcaccatgttggccaggctggtctcaaactcctgacctcaggtgatccgcccgcctcagcctctcaaagtgctaggattataggtgtgaaccactgtgccctgccacgaaaacattcttgagacgaactctgtgttagcgaacaaccctaacagtaaagggtttttggaatatttctcttctgggactatggcttgaagtttgagggatgctgtaagtgctgtacatggaagtttaccccaattctcagaatgattctttgcaatggatagttttaagatcatggtgatgggactctgtggtcgccaaagcttcactttaccctcatagggccaaccttccttttcttcctcaagttccaatgtcacttttagaaccctcagatactttttaaattagctcagactttgcctttttttctgagtgatggtgaattttagacatacagaaatgtggaataatagagtgaatactcgtgtactccccacccagtgaagaaataaaatactatatatacatttaaaaccacctatgagtccttcctgatctcattgcctctccccacagagtgaccactattctgcatttagtgtttattgtatatttttatatttttactagatttgtatgcattcataaactagatatagtgtattttttcatgttttaaacatgctttataatattaaacattcctctcagtttgcttttattgtttaaattgtgattttgctatttatccattgagagacacataatcctagtttattttaactgctgtataacattccattatataaatatgctatgacacattcattttaatgttgtaagcaggtttacaaatttgtgagtgtgctgttttaatgcaatgaacagttgtgaactcatctccctgtgtatagtatacacagttgacagttgacagtttctctgtggtgtaaacctggaagggaattgctgggtcaaaggaatttgatcgtcttctttaataagttgcctgattgctctccaaagaagttatgccaatttgcattccaaccaagcagcgtttgggggttccagttgcttcacatgtttgcagatatttgatattgctagacttgatgttttgccagtctgatgggtgtgacattgtgcctttgtggtttaaaatttgcacttttcctgtttgctaggggaggttgaacatcttttcatgtgtttgttatgctggtttgttttcaactcaggggcctgagaacagttttccaggtcttgaaagtcaggattgtagttttggttttgtctgaaaacagggacaatgaagaagggacagtgaagaggaaaatcaaggagaccaaagcaaaagtcatgaaaggtagggatggattggaagatgcaggtgaaaaaaatgatgacaagataatcactgtggaggggtgaaaactagtaacaaaaagataatag

SEQ ID NO: 111448 - DNA, 1025 bp, Homo sapiens
gaaatgtcttctgttgataatcctctgatttttgtccagaccaatggatttaacttcctatatatttttatggccctgcaaatggaaagtttttgtttttgggttttttaagtttcctatttgaagagcttgagaaattttctaaaaaggaagcattagttagaagaaaccaaatgtgacataccaatgcaagttgcttcagatcatctaatcttatttcatttgttaataatgctgtaagatgtacctctgagaaaatgctgtgtatcaaatgattacgagttttgttccgataaatggccatctgttgaggacctgctatgttggtgttggcacagactatactcaagtgcttaataaatgaatgaggtgagtccctgtccccaaggggctcagctgttccttatcttgtgggtgttaacattggtaaagatgaaacaatttcaatacagtgttatatcagcacagatagaagttgaataaactcccagcagctgtacagtggaaagaccgattaacacaacaggacatttcaaaaatacattctcgtttgaccaaagttgtatacacattctgcttctggcttttattttatatgaggacatgattgtagtcaatgtgagttagaattgaaatctgcaccattgggtgtctctccagttaagcatgaatctaatggtgcttttgggcaaactgttgtatttccggagaccttagtttttctcatcttgtaaaactgattttctgtttttggtcatgaaaaacttcatggtagaattccttagataaaggctttatgaaaatctgcacctcttaattggttagcaaccacttcattacctaactaccttgtttaaaactgtattgaacttatgacatgttagcattttagcgtctgtagaacagcctcaggataatttttgacatcagtttgagtgccagattttagttcttttaaataaatgaggtaggctgggcatggtggctcactggtaataccagtactttgggaggccgaggcaaga

SEQ ID NO: 111449 - DNA, 1751 bp, Homo sapiens
caagagcaccaaaatcaccaacgccggggattggtaggtagcctgaaaaatctaattcagagaaggatgctccgcgcgcagacatggcttatccccgtgctactgcatgagccacacctaggccggccccggacaccgacagccaatggccgggcccgtcccgccccatccgggattggctgtgcgtgccgcggccctccaccccgccccgctcaggatcttcccgggattggctgagctacccgacctctccaggggatcggctgcgcgccccgcccttgcccagagtcttcccgggattggctgcgggcctcgcgaccctcctgcttccctccccgccccgcgccgcctctctggtttgtgcgcccgtcgcaggtcgcaggcctctttgtcagctggagttgcgcggtgagtgcatctccagtcttcggctttcggtctcccgcggggagggcgcccggccggcccgtgggtccgatcaggggctgggctcgcccggtgtccccacgagctttgcccgcctcgagctcctctgctcccggcggccagaacggaggggtagagcagccctcggcggcccggggggcgggcggcggtgcccgtcccggggctgcgcgaggcacaggcgccgcgcccagcggaacagccggaggttcccggcgcaggtctgggcaccgtaacaattttgcgctttgcttccccagggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggtatgttcctagccttgagcggggtgggggaaggaatgagtcagcctggagcacgtggccagtgggaccggagggttccccggcgtctgtttgtcgccaaggtccgaatccggctccccttaactggaaggaaacatccatgtaggggctcaccaaacaaaacagctgtgtttctagtgtggtttcagacttagagaagcagagatccacgaggtattgagagcaacgcggaaaatagtagtgaaccctgtaaaaatcaaagaaaaaaaatcacaaagcaccctttcctgtgcccttttaaggttgacccagtgctttaagaggctaacacagaagggtaaagtaagtctccataaaacccagagaagagactggaaagctcctctttggatcctgtctggagtcacaactgaaccagaaaaagtttcgttacaacttgagcgcctttgtgattttctttacagtttatagaacaagcaatacatttcagttttctttggttaaaacgtcattttaaaacttttctttctataggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgct

SEQ ID NO: 111450 - DNA, 1048 bp, Homo sapiens
aaagagaactagagcaaggtagtttcaaagctcaggtaggctttgaaaagctgctggtggtgagggggtaagttaaaagtctttccattggaagtaagatgccaacaaattgcaataacttaaagaaaggaaaatttattatgaggcccatgggatgtcctggggagcccaaggacagcaatgagagaggcctcagtaaggattgagactaagaactggaaagccatcaggaaaccaggcagttctgtgagacccattctgccctgcatgagaacagcgccctgcattttgtagatgctcaataaatagtataaatgaatggttgagtagctattgccacagctttgactgaaccttatctatcttaggtcaagcctgaattcccagggaagggcctctagttggcccaccctgggtcagggggccattccaggaccaatcaactgtggctgaaggacagggtcacattgtaactgcatggatgctaggagcctttcctatgaccatgtgggcaggggagattgttggcttgtggattggacagatacctgcagaggaatatacagcaggggtaaaggatgctttggaatgcagagcaaaaatgatgggctgtcagtaaagactgatgtcaggtccttggatggtgagagctgaacatgccttggaggtcatctagtcccattccacattgttcatataagaaaaacaagacagggtgcagtagtgctcctgtaattccggctgctggggaggctgaggcaggaggatcgcttgagcccaggagtttgaaactagcttgggcaacatagcaagatgaaagaaagaaagagagagagagagagaaagaagggaaagaaaagaaagaaagggagaggagaggagagaagaaaaagcaagattcagagggttgaactattggattaggtccattggacttaagggcatttccgacaagaggaaaatatctcagtgttcacgtttgttgattaaatgagtacaagtcctggaattcctctttgcaacactatttgaaaccattgtttatatt

SEQ ID NO: 111451 - DNA, 1023 bp, Homo sapiens
agcaaacgtgctcttcttcacagcagcatcagggataagtgctgagcaaaagggggaaaagctgcttgtaaaaccatcggatctcataagaactctcccactgtcatgagaacagcatgagtgtaaccgcccccatgactaaactacctcccaccaggtccctcctgctgcatgtggggattatgggagctacaattcaagatgagatttgggtagggacacagccaaaccatatcaggggtatattttcttctctcttaaatatgacagcctatgtgtatttctctgtgattctgctaatgagttttaatagactaataaaataaataactgtaagcttctggaaggaggaaatgtccttttatatctttatgttcccttcatgctttctatcagaatttcattcagttacaagtaacagagatctgaaaaacagtggcttaaacatacaaggttttatagtgacatgtaaagtaggtactaatttagcctgtccatgttatggtgatagtggctctataagtcatcacttaccaaggtttctccagctctctgcttcaccatctctaaggaatgtcctgtcttccaagatggctgctggagctccaggcttcacttctacattccagccagcagagaagaggaaaagagaaaagcatatccttccattttaaaaaggagacttctgaaattctcacattactctatttacatctcattgcccaaaccttaattacatggctatagtcagctgcaaggaaggctggagaatgtagtcttttagccagctggtaatgtgcatggctgaagattgaagtctattaccaaggaagaggtcaattattatttgatgatagtgccgataaggtatcagattattggccaaaggacttcttgtggaggagctttaaagagattgaagtttaagcgagtcaatgtccagaaaggctaaggtgatagaagagcattcagaacagtttactcagggaagagtatttgcaggatttgcaggattcagattcc

SEQ ID NO: 111452 - DNA, 1030 bp, Homo sapiens
tataatgttcattatctcatcttttctgttaatatctgtacctgtttttgtcagtgttcaagatttgtcatgttttgttttgtttgtagacttactcagcttctgttactattatagcattatgcatactgattgtttactaaataaaatgccactttgagcttgaaaaaaaaagaaaggtaatttattaaatcctatgacttaaaagtctagaggaggggcagcttcaagtggtgagaggccatcgccagggtgatggtggcaggaattgcaaataaacaggagaagcaagttcctgcctgttcttcctgccttctggtctccctcgagtgccccctatcggcagagtctaacagacctagctggcaaagcacagaagtggttttcagagtctcagcccagcatcacagaactgagtctagaagagagggtttggaattgagagacaatagcttgataactatcacattttcatagaaaatgttatttcaaaattgttgttatatgaaaagataatcagagagaatgcaaccaaaaaatgtaagaaatgaatatcaaagaggtaggtcaggcaattaataaaagcatttatgttcttttcctggattatgtgatgtgtttgctgttacttttctgtattttaaatcatagtttcttttctcctgctatataaatgtgcacctacataccttaaaaaaataaaaaacaaaaaagatttccaacattcccagtgtagcacagaacaatcacaaagtctcaagaatgaagaggttgagaaaacagcacttctaaaatctctgctcactacccccaaggagaacccagctcagtgagcattttctcctggatgtttcattccccaaaatttagtcaaaagtggagcaagggaaagagtgagagtgatcctagtgtccctacttaccccaatccctccataactcctgctttcccctgtctcccagtctacactgggtcacaggacccctgagaacaaatcctatcaccccagatacactgtgccttgcacaga

SEQ ID NO: 111453 - DNA, 1030 bp, Homo sapiens
atctttctcattcttgctgtcctgctttatggaaactattggtgggattcaagcaagtgagtttgatcataacagtctctcgtattttcctttgtgtctcctcatattttcccaaagtcgtgttccgaggattatgggccctaggagcttgctttctgtgaaatgtctgcagtctagggatggaagccagtggctgaaatcccaggcaattttgagttccacttctgtcaaaggcatttatactcaatttgcttcattgctcatggacgattgaaacagcccagttggtaaacagccagaggaaaacagggtaaaaaataacaataataataataataataaagaaaaaaaaaaacctcccaactacattacatcgagctcaagctgtcatgatgaaaacttaaagatttactcactcaagaaaatatctctggattttttcagactgggactcttcaattaatctgacatttcacaaatccaaaattgccgtggatgaactctttacttcacttcgggatattgctggagctcggagtctcctgaaacagtttaagtctgtatatgttcctggaaatcatacccaccaggcaagtatatacgttttaaagtaaccttctaatctgttgtacttctaggattcagagtctatagaagaaaaggttcccttttaaccttcctaaaaccaaaggtttgttctagatgatctccaagttctcttttagttcagagttttgggtcccacggaatctgaaagcctctcaattcatttatgccccaggcttgatatggtgggatgagcactgagttgggagtcagccatggctttctaactgtgggtttgtcgcagactgattctatagccttctgcaagtcccttctctcctctgggagccaatgactacaggtaccaaatgaggggctggccttagaggattcccaagtttctggatctaaccagtccgtaaacattttgaatgagcagaataatgaaaacacctgataatgttacgacaagggaaaaagtttg

SEQ ID NO: 111454 - DNA, 1096 bp, Homo sapiens
ttccagttccactgtcacattctcacctgggcccccatcatcacatgtctgcacactgtaagaacctccagctggtctttctcctcccaacagtagtagtgtatttatatttgataacacagaccagatcctagcatttccctgtgtgacatccttcaactgctgcccattcatcttggaatataatgtaaacccctggtagtggctctctaagccctgaccgtctctcctggctcaccctgtaccccttccaaattctttttgactcggggccttcctgtgtggtgttgcccctgcctgaaagctgtgtgatttcaggaagtcacttaaccttctgggccttgattttctcctctaaaataaggaccttgatcctttctagcaatgaccttcctgttttcttagaaaaaaaaatagcagttctcttgaatttatcttctaataaccctctactcagcactgaccctgacataatatgaaaggttagccacaggcccattggaaaatattttccaagtatagtatagaactataaaatgctttgaaactgagacatacatgttaaccagcaatgttttcaattaatagagggatgtgtataccctgtgagaatgcttaaagcctaaaattaaagcagggcaggagacttcatctttcttagaaagcaaatttactgttctctcactagtttctgtctgaatttaccagctccatgtgagtttgtatgttcattggcattctaaccatcctttattataagtgcattttcaaggtttatactattctcatcagcagcacactcttgtcaagtttttaatttcagattgtcagacatccaaactagaattgttccattgcctatagcagataataaataattagatgctcttaaatcagtggaccgcagaaaatgaaggtgaatttttaaaattcagtttatttataaactgagccaaccccatgccagttcaatccagttctgtgcattttgctgagtgtcttccagatgccaggcactacaccaatataggctatgtaataagcaaatgctgggcccagctctctaagaactcacagtccagcaggaagatctata

SEQ ID NO: 111455 - DNA, 1024 bp, Homo sapiens
agtagaatgaaagaaatgaaaacaggaatcaaggtgaatagaatccaatgccacagtgggaaacatacattattagatgatgtcgattttatgtaaacaagggagcaaaggttttgtctgatagaaatttctgaactcctttgaagtcactaccataagcattccacaggcattctattccttctttgcattgtatttaaaatgggcacactagggaaaattacagagtgtctttatcataagttgaactcctaagctatcacatttcaaatactgaaacactatcatataatattaaaggaaattatagtatgaatagagacaaaactgaagttattctgttaataagactatttccatcatctttccttaggatgctttatccatagtggcatgttggtcttataacatccctttaggagaaattgatgggcatagcatggtttttatttcaccaaacatggttaaaggactaataagataatccacaaattagtcacagaactagggacatcatccaagtttcttgttccatttgtacaatgattgcccactctgttcatcctacagaaacaaatgaaccagggattaaacacacccaggtgggagtctggactccctgatgttataactttataaactggagcaactctgatgttctttgttaggtttctctttctataaaatggagatactgccacttttttcccccaggattattataactattagggataaaatatataaagtgtttgaaacaggtagatagtcgacacattgtagcaattatcattttcatgcaacagcaaatagtcatacatatctttacagtaaaaaagaagtattaatatcattgtattcatcaaaaaggtgggggagacagcaagattaaattagagcaggaaaggaaaataatggaaaagcttgctagagtggttgtatcctatagtaaaatggaaatgtattcctgtattgcctctgagtcagtgtacctcagtgaaaacaagtacagaaatgaaataaa

SEQ ID NO: 111456 - DNA, 1110 bp, Homo sapiens
catagccattatttgtaagtaaattaatgtcctctccagcaacagatgttggttgctatcattaacatagtaggtgtttgcaaggctttttttttatgacgatgatgatggtaatgatgataaatatagtgtatgatattatgcagatgtagatactctcatttttttcctgttgttaatgagggaatgtttttgcattgcaaacagtgaggacagaaactatgtcagtgtctgtctaaattgctgcgtggagtctcacaacagacaggactttaatcgccaacagtgtggtatatctgtcgagtggagtagaggaagggctagagccctggagttcaagtgtaatccccacaccacctgagagtccaagggagcatgaggctatttgataccttggtttactcatctctaaaacaaggtccctgtgtcaaatgggccagatgatctccagatctctcactgaccagtggggcttgccgtccaccctctatttgacaggtgagggcaccgatggcactgacttgggcaatgtttaattgacttgctcaaggtcaagatcagcagagctagaagtagaatccagttctctggcaccaagtcccgtgctctttccacttccccgctcataatttcagggtggtccgaggcagtataagaggctagtgaaatgttagagttttgaagaaaactgaagtagtaaggcagtgttaagaaaaacagggaatcctctaggtttggtcagagttcatccaggacttgcccagaatgcttgagctccctcaggaacacctggctgtgatccacagccctccaggtgtcttttcatttctcccccaaccattcagaggaactgctggcctgaggatgccccaggaacagccccactcctggcctgtggggagttacccctgaacaggagcagctccaaacccagctgtctagagcgggaccagcctcagggctgggaggagggctggggcccaagcaatgcggtctgcgctttgtttcccttgccgtggcactgccaagacctgcagtacacgcccccagtcatcgttttgacaaccccaatatctcccacacttccctctgtctccagagcctttttct

SEQ ID NO: 111457 - DNA, 1049 bp, Homo sapiens
tggtttgttttgctaaatcattaccttgtaatgtctagtttttattcaaaacaactgctactaagtactacaccagtaaaacgttctagtggatattataaattcaaaaatatttctatgtacccttataacagggaatgctgagttaatgcgtttttcacaaaatagagattctctaaccattttttggttgtccccttaccgtctgtaccaaagcaagctatgtaggacactgtttttttcaaaaggtgcatttaagtatgttttaagaattgaggtatatcccaccaagctcgtgtatttattcaagaagcatttatctcctgttatatgcttggcattgtgctggagttctggaggtggctaagacagtccttcctggagctcacgggggagcccaaggagccctaatatcatgtgatctgtgctataacaaggactataaacacagagggctgaggcagcacttggagagggttgtgcctatgaggttcttgataaatgctgaataagctgaattcagggccttctcaaggtgagtgaatcacctttgtgtattgcaaaggaaaactaagaatagtgtcttggatgacagggaagaataactgtacaaataaatgttacataccacacttaaaaatgtcaacttggacaaggcaagtaaggaacacatggattttaggtgtggccagtgaaaatcagagactctgactataatccctttctaacctccccttcagtgcgtaactaacactgttttcacaaaaactctgaaactttcttttccaggcttttatacaagttgtttcttttgcctggaacaatcactgccactccatctccataccaactcctttcaccctggaggaagcctcctctgtctcatagcactctgcacttccacatcatagcgcctaccataccataatgtaaacaggtccacccatttacctccctgcatcccctgcacatggcaaagggtgtatgtctgtttttctccgggacccaacacatgctcagcacctcaggcttaataaagatgagttaac

SEQ ID NO: 111458 - DNA, 1111 bp, Homo sapiens
tgtgtcttattttgttgttgttgttgtttttctggtggtgatagcttacttttctggaaaattgtatgaaatttttcctgagaaggagaaagaaaaaaaaaatgaaaaaccgtagtcatttacatatccatgttcatgaaagtacataagaacataattcagtctaagtaaaaagatttcttgaaacttttaacatatgaaattatccctgtggaaatcaagtatgttagttttatacatgtatttaacagaggttacattttgacaaactattatttaaaaatccagtccataagatccatgaggtgactccagttaaataaatgttgtgtgtgtgctgtggtgcacagcagcaggccacaggggcctcgtcctccaggagctcacaatgtggtagtttttcccgcatcaattgaatagctttttcaaaatctctttttttaactcaaatttttagcatttataatggaaatattcagctcttggatagtcggtagatcacaacagaacatgctgagatggcataagagtgaaaaattagcataagagtcctacttggcagtgaaaaattgtgctttgataaactgatagagattgagaaataactatctgcctactgtgtgatctctaaattgtacttactaggcattctccatcagcagcatggagaatatatgttttctttgatgtgttttttggtttggaagtatctatgttgtttggcatcaattaaactaaaagatgttctcatagattaacaagaatgtttattttaatgttgattttctaatttcattgtaagaaggatatccctatctgtgcttcattcatgataacttggaaataaagatatttttatttgtataagtgtgatttgagagtttgaaaaactgaatgtggtattatatgaccaagtatagatttctgtttcagatgtggccacccagaagggctaagccaccttcccctctatttcttacccccttcttctgttcattccattcctttttttcgtaactatagtaatggaagctttcagcagagccacacagaggggccgtggagatgcccacaggttggattaatcacatgtgccctgtttatctgtgaa

SEQ ID NO: 111459 - DNA, 1019 bp, Homo sapiens
tccaggaagtccagtacatatttcctttttctctactggactgagaaaggcaaagaacatggtgtgttgaaccatgctaaattataccacagggaagggacacctttgctcagccttagctgattgcgtccctgtgggaatgaaggcccagtgttcttggatcttttgatgatatatatatatatatacacacacacacattttttagaagaagctttatactacttacatagaaataaatgtctataatagcagatggttgaaaacagtgaaatgattttacgcatttccggatttggattgaggaatagatagcaaatccaccaccgtggtgtatagagaatgagagaaaaccctgttgcagtctccaatgagaccagctttgtaaaccacattagagttgttgattactaaagggcccagaagtcagcagaagcattttacagctctgctgagagaagtgtatgtgtccctttgttagacccatgagaccaggtcctggctcttaggtatatttgagatatgttttattcttttgacatagcttatttgtccctcagcttgtcttaacaaagtggaacatttatgctccatgctgtcactactgaaaagaggatgaatataaaaataaggaaactcttgagggtagcaaatgatggaagaagtggatacactctgggaaacagagctatgctatggaatgcctgaaaagaataaaactcaagtattttaacaccaacaacaagtaattatattaccactgaaatagtgaagcatggtttttgaagcagtaatgtgtgaatttcctaagggctacatcaaaccatccttaaaccacatgtacaaggtgaacacttccattttcaaaggcattttgaagaaacaatgtggatcattctttctctcatcctttctctcatccttacccagtacttttacaaaactaaatttttacccttcccaaaagctggtaactggagtgcacagttaatcacttagttactctcattggacatctc

SEQ ID NO: 111460 - DNA, 1098 bp, Homo sapiens
ctcctgcttcagcttcccaagtagcagggattacaggcgcctaccaccttgcctggctaatttttgtatttttagtagagacggggttttgccctgttcgccagcctggtcttgaactcctgacctcaagtgatctgcccacctcaggctcccaaattgctgggattacaggtctgagccaccacacccggcctattattactattattatgttacatattatgttatataattacaataataattatatatattttaagtcacctaatagcatcttgttacctccctagactaaaggctgccatcacatctggatgtgataacatcaggccagctagctctctcaccctctgtctaatcgtggacttgggaaaaatcacttattgtttctcttgcaccagtttgtgtcctagtattacatttctttttcaggtgctgaaggaggactgattaaggcaatcagatttgcataatggaaatagggggacatattgccgttatgagaatttcttgtgacacaactccccagggaaaaagtcctttaaaactaccatctgacctcccagccctgaagcgcttcacacatagggtgatgtttcccaatgaataaataacgcagagtaagcagaactctaccctaaaggaactcgcaatgtaaatgcaacagaaggcagaaccatggacctcaatctacattaagggcctgccatactcttaaaagcccttctgatttgtagtcctcctgtcctcgtttgtactaaagtgccttctggcaagtaagagaggaagattcctaagacaggaatggactggatgaatcatggtggtccatatgatttagagcaggagctctggatacaggctacttgggtccaaatcctagctttttaccagcagtctgaccttggacaagttattgaacttctctgggcttcgataccatcctcgagcattgttgtgaggactccgtgagaagagccagtggaaagcacttagaaatgcatctagcacagagtaagagctccatgaatatgagcattagtatttgccatgccaaaatataagttcaatcttgcattttcttcactaatggatgtt

SEQ ID NO: 111461 - DNA, 1081 bp, Homo sapiens
taaaaattaaaaatatatacacaggaaaaagtattgaaaggtatgcaccaacacatttttgtagttacctttgagtacaaagactaggtctgaattttcctctctatcttattctccctctctccttcatcaatactaaattttctttcaaaataaactaaacatgaagtcatttaaataagttaactggtgctaatgcttatctaaaatagaaaaattgccaattgatttgaaacaagaggaacagattttggaacattttatttctgacagttaaatttatgtatattttaaacagactctttagaaactgtggagtgggtcagggtgatggtatagaggaactctgtgctttcttcttaatatttctgtaaacctaaatctctaaaaatatctatgaaaattttgaaagaccctttacattttcactagttggccatcttttattgtctcatgatcacaggtgatgtcagttaacatgttatgttaacatttgagttttaataagtcataagggcagtgcttataagcaagatgattctgtctatagtctggaaagaagcaaggacttgctaagaactctgaactctgttgtatctggtattatagatttcttttctggctggctcctcctagcctcttgaaccccaaactctatcagccttcatctctcgcctagtcatagaccaggcagactattcacctgctagattcctgtatttgctggttataacctctgttctcagagcctttgttgtgttcaacactgtattagtctgttctcatgctgctaataaagacatacccaagaaacaaaagaggtttaattgactcacagttcagcatggctgaggaggtctcaggaaacttacaatcatggcagaaggggaagcaaacatgtccttcttcacatgacagcaggtgagagaagaatgaaaccaagagaagggggaagtcccttataaaaccatcagatatcatgagaaattactcactatccacaagaacaacatgggcaaaaccgtcccatgattcagttatctccacctagtcccacccttgacacatggggattattaca

SEQ ID NO: 111462 - DNA, 1098 bp, Homo sapiens
ttggcagttcctcagaaagttgaacataagagttgccatacgcccagcaattccactcctatacctaggagaaataagattctgtttttatacacaaaaccttatatatgaatgttaatagcaatattattcatagtaactcaatagaaacaacccagatgttcagcaactgatgaatggtttaacaaaatgtgttatatccatacaatattcagttatgaaaatagatgaagtactgacacatgctacaacatggatgaaccttaaaaacattatgctacattaaagaagccacacataaaaggccacttattgtatgattccatttatatgaaatgtccagaatagtcaaatctatacagattagaaagattaatattgcctagggctgatggtagagtgaggagggttggagtgggcagtagagaagagagggacatggggaatgacaactaatgggtctgggtttctttaaggggtgatttcagtgctctggaattagatagtcatgacacttgtacaatcttgtcaatataatataatccactgagttgcacactttaaagtaataaattttatgatatgtgaattatgtgtcaatttttaagaatcaacacagagaacctataaaaatcaatgaacaaactaaaagtcatcctgataaagcaatgtaataattatccagagttctgatttcccccctaagttattattaaaaggtaaaagtacttaagaatatgagtggttcataggaatggaaaaccaaataccacatgttctcacttataagtgggagctaaacattgagcacacatggacataaatatgggaataatggacattgtggactagtagaaagtggagggaggtgggttgaaaaactccctattgggtattatactcactgtctgggtgatgggatccgtactccaaacctcagcatcacgcaatattcccatgcaacaaacctgtacacatacgccttgtatttaaaataaaagttgaaataaaaaaattttgaaaaagaagatgagttgtttatgacagcaagtgtttttcccaggatataaaggatagattatacaacaattacctaga

SEQ ID NO: 111463 - DNA, 1057 bp, Homo sapiens
atagacatatccattccaaaagggagaaatagcaaagaagaaaagggtaacaaatcccatgtaagtccaggctacaagccaaactccatgagatcttaaggcttgagaaaaatcttttttggcttgatgctccttccaggcccactacagtgggactcctgccttcaagaactgctaggttagaggttctgctcccacggctctgtcaggcagggcttaggctccaagccttttggcagtcctgctgtcactattttgggtggaggagatctggctgattgtgcaatgatggtcttcccttttgaaaccaaggaaggcagccctgatgatctctggaatcatctttggggtcattcttccattgtcttagaggatcatacctggcttctgttgagatggctgatccatacaaatttcattagcaaatggttgcttggtcacatctttactgttatcttgttttgcaatatggatagtctaagaattttctaaatctttacgttctgcttccttttttacctaacaatttcatatttaagtcatttctctcttctgttattttactataagcagtcggaaggagccaagcctcactttcaacacttctcttagaaatagttttggggccgggcatggtggctcatgcctgtaatcccagcactttgggagactgaggtgggtggatcatgaggtcaggagttcaagaccagcctggccaagatggtgaaaccccatctctattaaagatacaaaaattagctgggcacggtggtgggtgcctgtaatcccagctactcgggaggctgaggcaggaaaatcgcttgaaacctgggaggcagaggttgcagtgagccgagatcatgccattgtactccagcctgggggacacagcgagactccgtctcaaaaaaaaaaaaaaaaaaaaggaaaaagaaaaaagaaatagctttggccaggcacagtggctcacgcctgtaatcccagcactttgggaagccaaggcaggcagatcacctgaggtcaggaattcgagactagcctgaccaacatggagaaa

SEQ ID NO: 111464 - DNA, 1034 bp, Homo sapiens
tgcctaaaaactcacagtgatactgatattgactctggaagatttatatttctttaagtgtttagtaattgaatcttttaagagttttgatattccagcataatatcaattaataaaattatttttaaaagaaaagctataaattattggaagtgggaagtgagcatgatctagagtgtctaatagtgaagatgtagcattgctaaaatgaatgtagaaggaacagactccatagccctatttttcagagtgcatctctcctcccagaaatcttcatgtctgcctgtgttatatcacaggtcacctaagcagtttctatgaaagttgtatctacaggactctggagagactttaggtgttctgaatttgaacagttgaaagttgagctaaattgacattttatggaataataagtcataattaacttatttagcaataagatttatgtagatatccctggagggtcatgttaatattttatatgttattttctagattctgaattactggaaaatcatcagagacaatatatactcaaatgattttcttagttttttaatattctgaatctcattaataattactttaagacttacacaccatcctagcacagagttgccagagttctttttttttttttaacctagtttcctcttttgcctgggtgctgagagttaattctttatctctagtgggagacagctctcttccatcttagaaaaactcatagcattattcctttctgctatgtgcatctcttttaactttgtatctcctcactgtctcctctttcagcaatcttcagagacaaaaaatttcctttcttcagcccatagatttaaactttaccaatatggaagatttttctctcatctgtgaatgactataatagtataatatagtatgaaatggtataacacccatttgcataattgccatccaaaaataaacaacatggcatagcagttattaatatagaagtatgatcttagagtcatgtgatgaatctgtgaggggagttgtgcagtggtgaa

SEQ ID NO: 111465 - DNA, 1251 bp, Homo sapiens
gtgaaattcccctacataagatttacacccttttgccttcctgaaaatcatgtataaaaatgggcctgtttttcttcagcctcaccaacaagcttttgtttttttgtcaaactgatggatgagaaattgttttcaatataattttaatatgaattttccttttatgtaaaattgaacatattttcatattttaatgtaattttatatcttttttgtgtattttctattcctgtcttttgcccattttctagagtacttttgatctcctttcatcaacttttaaaagttctttataaattatgaatattagttctttatattatttgcaaatattttcttctaatttatttgtcctatcattttgcttatggtgtttttgccattcaattttttttagtcaaatatgtcaatttttaaaaactgcatctggatttttagtcacagaaggccttttctaccctcagattatagaggaattatagaggaatttatccatcaaaaattacttgtatacttttacttattaaaaatctgatctatttgaagtttgtgcttactggatgacatgaggaatggatgaaaatttatcttttggaaatggctttccaattgtcccaacagcacttattaaaatgttctttgctgccccagcattttgagttgcacctgtatcatatactagaataatttccacctgtggtcaggtcttttgctggacttgctgttctgcttcattgatttgcatgtgcattcatgttccaggaccacaccgttttacttatacagattttgtggtaggttttaatatctgatgtggctgttatctcctcacaactctttcttttcattgtttttcttgatattctcttttggctattgtttcatgtgaaaattcatgtgtagtaaagttcatttgtttatttcccaggggagaaaaagcttattggtttttttttaattgggatgtcacaaaatttataaattgacttagtgagtacaaacatcttttgatgacattgagacatcctaatcaagaaccaggaatgtctttccatttgttcaagtctacatttgtgttttgcagagtgttttattaaagtgttggtcctataggtttgaaacatttggagtttatttccaagtattatctcttttttccattgttgttgcaaatgaggtttttctctaccattatatcttttaagtcacccagtggttcttaaagttctgattaaaagcactaccaactgc

SEQ ID NO: 111466 - DNA, 1056 bp, Homo sapiens
cagctgaaattaaaagcaagaactcactttgggggaaaaaaaacaagaaaaataagagtgaccttggtagctgcttatattagcattcttgattaatgtctgctttaaaaaaatcacacgggtaatgcagctataatcattgtaccagtcataaccaattagttatgtttatgtaatatgaaacaatatgcaggcagggctgcctggaatcccactttcttccacaaagggagtcaagatcacatggattgccacttctgcctgtgccttgcctttgcaggacactattctgattgcgaccaggtctgttacgtaagcaccgcattcagttggctctgccagtaattcacaaagttacttcttttgtggacgtggaagggacctgaaagaactgtccataacagcatgttcccaattcaatcagcctctatccttctacgcctcagaaaagaaactggatggcaggctcataaccagcaagccctagctgttctggagccctgttttgtttggcctactcagtgtttgtgataactttcatttggagcccaaacttgaacaatagagacttcacatgaatagctggattttgtttgtgtgtttctttttgaaaaatgcaaggaatggtaggaactggtgggagttgaatcatggttgccccttagaaggggcctgtgctcccagcccaccccagaatcaatccctttcattctcttgtattacgtgtgggcccttaggtgcagtggagtttatggcctctgctttcccttcactgtcatgttttccctccaccaccctgttggtggaataaaagattataatgagcgacagttctgatcaaattggaaatagttcacttatcattgtgtcaattttttgtaaacaggaactcaagatccacacagttataaatgtccttagaggcccagaaatgtatcaagtaccggatatggcacgtagtagccgcttggcaagcgtctattgagtgaatctacgaatagaactcctgagtgtgtggggactcagggtcatttgtttggctggaagaagagacct

SEQ ID NO: 111467 - DNA, 1053 bp, Homo sapiens
acaaaacaatgactgtcaaatccacccactcagctaaaggaaaacttcagggtgtagggggaacactcatttcagaaaggattttgactaatctcttgtttctaatttaaatattctcatttattgtgccatgccagcattagacttttccattacagaatacatcttcatttctagtgtttcagatttgttatttcagggctgccaaaacaaaacaaaagaaaacaaaaaacagctttaaatacttgttttctattgtggtttgcaacgttgtttggtataatagggtctattttttctcttgatttctaagatttctgctggaaactctgacgaagaacatatgtctgccaaaatcactcccaggagaaatgttggaaccgttatatttagttttactatccaacatattaaaatagttacccatagcacatattactaaacactgtatcagtgaagtttaagatgtttaatacatatttaaaatatatcacaagctatgtagaaagatacttagagcttcctattgaggtagctaactagttaagtaatttgctaacatattaaaggatcactacaaattactttctccagtacttaatttttccatgccacatcacaaaaatgattattcttatctgagacactggaatgaatcttcttctactaatatttatatgtgtacaaatgcatgacacatactgtccatatcaccaatttttatgacaatgctggcagtaataattgtgtttgtaattattcaatgaattgtttaagagattagctattactgactcttgttaactctacattagatacaatacatatttctcaatcatgaaagagaagagatggaatgcatggaacacaagagtagttttcttgaacacaaagctatggatcaaattggagagatcatgtgatgtggtggaaaagagcacagcggggaggaggccgaattttcactcctaagtatgcccacagttgtgtaacctgcaagtcacttagcttgctgcagactcagtatactcatcataaaatgagaatcttgtt

SEQ ID NO: 111468 - DNA, 1035 bp, Homo sapiens
aaatggaaagcagtgttcttaaagacattgggaaggtaggcatagtctagtgagctttcaattggggttctcttacattccccactagaaatctaacagagcagagtcttatcaactgtgaatgaggaaggagttgaggatttgtttttccttgggttgtggaaggcagctcatgttaatgtctttagctctagtttccaaaggaaaccatgtatgtattcttatccatagtaaaacaagaccacattctacaaccagtagtaaaaatctatttgcaatgatttgtttatgttatctctcttctttggaaaagtctgggtctaatgtagaccatataaaattattattgttcttcatggctaccacttaattataaaagctttcatctccattagcacaaggcatggacgttttgtttattatgtttgagaagttatgtctttcaaacaaagcatttttcatacttagccaagtaattttctccagccttgtagaaagtgagtcttctttataacatatgaagtacttccaaacagagaatttttttttttttttttttttttgagacggagtcttgcactgtcgcccaggctggagtgcagtggcgcgatctgggctcactgcaagctccgcctcccgggttcacgccattctcctgcttcagcctcccgagtagctgggactacaggcacccgccaccacgcccggctaatttcttgtatttttagtagagacggggtttcactgtgttagccaggatggtctcgatctcctgaccttgtgatccacccgcctcggcctcccaaagtgctgggattacaggcatgagccaccgcacccggcctcaaacagagaattgtaaaagacaaggagctaataagaatttttcctcttatgcttcccttattatcacctctgcattcttctctcatcccacagtttttcctcagtaattcatcaaatttcaggatatgtatacctgcatatttctgctcctcaggacagtattccagttgaaagacagttttcaggatt

SEQ ID NO: 111469 - DNA, 1047 bp, Homo sapiens
ttacaactgtcaaccaccatgcccagccttatattttgacttttcttattttattttgaatttgaattaattggtattatccagaataatacctaaacatcccagtaaagtaggttctgctaattttagggaaatatgattaaacatcataaaatctaactaccttcacttccaataataactgcaatataactcatgaaggcattcatgttattttgtatcaaattcattatttatattttgtgtaaagctaatttccatgcgtatggattgagcctgtgtctatctgaaagtaagaagttattaaaagttctatgtgaaatgtgagtactttaaaaatgtaccacatttctattcatttgctggtgtgtgtgtgtgtgtgtgtgtgtgtgtgtgtatgtttaggtgtatgaagacttcttcattcaggaagttgcagctgaggccgcttatatatcctccatcttttcctcttgtcctctgttgggcctctctgggagaagtgtccagacttcccgggagcagaatgtgcagctgtaaaccttagtctctcatgcatgtgaactttactttgtgcccactgttgacctttcttatggttgcttatagaaaatgaaaccctgtcaagatgggaattgaatgaagtttccacagaaatgaaacattttcttgcttagtataaaacctatttgccaacttaaaatccatttaagaaaaacttaaagccatttcattaagtataacactatatgtgattgcatgtgtttggccatcaataaatatcaacttagaaagttttaatatgatttatacagtgcttggaagagtgctgggattcaaagtaggtttgaatgctaggagaatttaattaaaagttattcctaagaagcataattttggaaacagataacaagatgacatgttttaacctaggttatttggatagcttttttaaacatttatatgttgctatggtacttttggaactgaaatcatgctgtaagaatattcatttgatattcactcaaggtgttcattggcccagca

SEQ ID NO: 111470 - DNA, 1008 bp, Homo sapiens
tatagccatattacagggtaattaggaggactaaatgagataatctacaattatatctttataaatgtttatttttttctttttttctaatgtcagctatttcattgtagagacaagtatgatttcaataccaactgtattcaaagggcggagctaggtcctggagatgggattaggaataaaatgtggttcttgctattgaggatttttcagtcttagaagaaagctagatatgaatagataattaaatttagggtgataagagccatggcagacagacagagaggcttctttgggattgcaaaataggcacatttaacccatttagggaaggtcaaagaagataatgcttaggttgaatcctgagacaaagtgaagagggaaaagaacagtctaggcagggagatttgcatgcataaaagcacagaggcaaatgcaagtagttcagtaaagtttaattgtaatctgtcagaaaagaagtcgtgactgttgaggctaagcagttaattggggccaagaagataaatgggatgcatatgtaatgttaagggctttgtctggaggattttatttaactttaaataattttaagtggatcagttttttgttttagagtgagatatattgtggctagagatgatggtaattacaacttaagtggtaggggaaggaatggataagaagggatggatatataaaaatcatcaagacttggctgatttgctgtggcaggggcaagggagaattctggtagagtccaagcttctgacttggtcaactggaagagtgatggtaccacacaacagtacaggatgtagaggatgaagagcaaatttgggggtacaaatagtgatttcagctttagacacattgaatcaaatttacaggtgagatatacaagtggagaagtccaataggtagttttggctgggtttggagcaaaggagagaaatttggctggagatatgtatttacgtgttatattattatgcagattaaagtgctata

SEQ ID NO: 111471 - DNA, 1045 bp, Homo sapiens
tttttagaggctgctcaatcattgtaattgattgatgataatatgataacaagagttcttaaatcattaaatgtagccagataaagacgaatgactagtggttttgttggatgcatagttctcaattccctgtggtgttctgttctgctctctgaagaagtcacttgtcccttgtttcatgcaacttacggctcaactggcctgtttacagaaaacagcctcttaaacttggcagttctgtttgaagcacagcataacatcatttcccgagagatgggaaaaaacgttacaaaaaagtttatatctcccttaaaacatatgcatgttttaaactgagcatccattgaaagttgttttttccatcctctgaaatcaaggcttttccctatcttcctagccaaaggtacttgtagctgaattagattatttgatgaattctgtaagcttcttatgttttcctgctcttactttggataaatgctaatctgtagtaagaactctaagtagatagctctgttcttcccaggactcaggaaatatggctggtttaatgtcattttaaaaactttttattgaagtaaatataatatagaaaagtacagctcaatgaattttcactaactgaagacagctgtgtaatcatcacccagctcaacctggaagattatcaacaaccctggaagcccctcttttgctctctcccggttactccctccctctaaggagtagggacttctgaaaatctagatacatttcccttggcttttgtattttacatggatatagttatatattttttctggcttcttccattacacattatgtttgtgagtttcatctgtattatcattttatgaaattacagagcattcattctcattgttatgtaatattccattgtgtgaatataccacattttttcctccagtggcatttttaatagaagagaaagtttgtagaatgttttcacttcctcaaggacttcactatttctcactatcagaattgtatgctccacagacacagaatgtcaactagtgcccct

SEQ ID NO: 111472 - DNA, 1054 bp, Homo sapiens
atctgaaaccccagagtaaactgaaattagagctgagtaagactttctatagtcaatatggagctgtggtccgtcacaaacatgcaaaacagtcatctgtgctgtacggcataggcagaacatttatatggatgacataaatcgttcttataaacaaaaacatcccatgctaactatactgaataaatgtcatttcttttgactgaagacaaggggtgaggtgtgggtatgaagacttactgcttcatattagcagatgtttcccactttgtcgtgaatttactgttgcaccttcccccactccaggactctaacaaatgaggaaataagccaattacagatttcattaatgtaagtctctttccattcttccctgtgcccaatttaatcattttattgaagtggttgattgattagaccagcatttttggagcattttgaggtgcacttggcactataataggagctaaatgcacaaagatgactaacattttgggatattatttattttactattttcagcttctgttgttgctattgatacatctgcagccactttaatgtcagtttctttgtatgtgatccatttttctttgactgcttttcagatgtgtatgtatatatattttttacaatttcattataatgttaataatgtctaattctggatatctttacattttccctgcttggtatacattgtattccctgtgtctgtggttttatgtttttcttcagttttagaaaattctcatatattatttcatttagtattatgtctcctcttcatttttttaatttagcaattctaattaaacatgttttagaccttcacattcaatattattttcatatttttgtcttttatttctttgccatggttttgttgatatcttcagatttatcctcattttactattttcctgcttagtatttgaagtcagtatttgagtttttaatttcaaatatgtttttgacttttaaaaactcttcttttttaaaaatatcaggtagtttttgataattccttattcataccttaattattttgctt

SEQ ID NO: 111473 - DNA, 1049 bp, Homo sapiens
ttatgaataaacaatgatactcttatcactcaggaaattctaaaggtttttggtgctctttgccaggaaccagaaacaaaaaccaaatgtatttcttcttatactacacaacccaaagttcatactctgttgtttgtaatcatctcccctctcattcgatcagatagataaagaagggagagaagcaagaaaataagcaagcattttatgtagtatgtcagggtgctttctgactacagatgatggagaaatgaaataataaggaaaaatgttattattagaaggaaatgctgccttcttttccatcacaaatgccatcactcagagatgaaacaagtgcttgcctttagagggactgagtggttatattggctttgctacagaagaaccttggcccctcaaactagttaagtttggcagtgatattttggttggtgagaaactaattagaagatgggagcattttacatactcttcaaatgacccagcatttcaaacagatgtttcaggaaaatgcatacctggtgctcttccattagtgaattactttgttgtaactgtcacaagctcttttggacggtaattatgaagaattatgtcccatttggcaactcaaatgtatgctgtttagctcaatttgagggaaatttgatggtaattataggcacagtttttctgttaagtcttgaaaaggaacctatcacaacagttgagaaaacctgggtgataaagcataggagcagtccatattctccaagaagtatacatatgagggttcttataggatctttaaatgaacacatgtatacacacatgcacacacacacacattcactcacacagcataaaaccaaaacatccccaactccaaaacaacttaaacaaaaatggacaagtagagagagtataatgtataataataagactagaataaactataacttgaagtactgaaactgaaaatttatagcatttaaacatgattacaataattgctggcttcatatgatatttcataggttttagtattcttaggatctcttttttta

SEQ ID NO: 111474 - DNA, 1029 bp, Homo sapiens
agacacatgcacacgtatgtttactgtggcactatttacaatagcaaagacttgaaatcaaccgaaatgtccatgaatgatagactggattaagaaaatgtggcacatacacaccatgggatactatgcagccataaaaaaggatgagttcatgtcctttgtagggacagggatgaagctggaaaccatcattctcagcaaactatcgcaaggacaaaaaaccaaacaccacatgttctcactcataggtgggaattgaacaatgagaatacatggacacaggaagcggaacatcacacaccagggcctgtcgtggggtggtgggaggagggagggatagaatgaggagatataactaatataaatgacgagttaatggatgcagcacatcaacttggcacatgtatacatatgtaactaaccttcatgttttgcacatgtaccctagaactttataaaaaaataaataaatgaaagaaccgtatggcattattaaatgaatgagaaaatttgaagaactctttgaagcagaattccactaatacttttatatcctgtatttgcctgcacatcttaattcctgaatttactttcagcttgaactagcatgaagagcttttacaaaagaggctttttacagagcatgactgaaagcaggtagactttcgagatcatagtcactctggttttaatttcagacccctttttgtatcaaaggtcaggtccctgatgagaaatgaatcaagtcagacgcatttttttctactctattacaaagaaggttttcgagttcttgttttggcactatgcatctccaagaggaatttcttttttctatacacctgcagcaataaaacataaagggattgtgattttgatttctatctttactcatcatctctttttgcttatactggagacaattgtatttaaagtcttatatgcaactggactttctttagacattaaactttgcaaaaaggtagtgcttttcacattacacctactaaataatttaatcgtgattat

SEQ ID NO: 111475 - DNA, 1084 bp, Homo sapiens
cacctcccaaggggaggagaagcaaagaatttatgaccatctttatcttctctcaggtggattgtgagattcttattttctttgtgtttcgtagtatctataatgcagaagtattatttttgtaatttgtaagagctttttatatattaagtttataaccttccatgagatttgcataaagtagttaacattgtgtctggcataaatagagctctctataaatgtcaactgccatcagtattgtctttagttcttttatgttagaaaagaaacacattggtggacttatttgcggtggctcattttaaaaggcattaaaaagtcataattgcatctaggcaagccaaacgagatttccatgagaaaatgttccgtgagactatgttttgaaggatgaaagggaattgccggttagggaaggacgggaaagacatgcaagacaatgggaactgtatatgcaaagacacagagttctgatagcgcatagcatgttgcaggatctcacatggcagggtgtgactgtaaggcatgtgtttgtggaaaaagggctgacacctggaggggaagaattacattccagagataaccaagaaacagaatatacaggtcctagtgactgatgaactataacagttccttcagagttacagcaaacaaaatttaacttttcactagttaaagcaatcttactatctgttcctgatttagttttctttctttaaacctcaacatgaattatatgcgaaaaggacagaattcagactaagtaataaattacatatgggtaaatttcctttcaaactaaaaaaagagaagaattggagaaaatgacaggccaagccatatttttagtttaaaaataaaatgatttatatatttttttcagaaagccaatagaactgaacatttgtccatcatctcagaatgggtgctcctgcctgttgagcttattagctccattcttactgtcccagggctctcgtgtttgtgtgccatatgggttccacatctggtgaccagtccgtgctcttttgggggaaagaaaacaaaacttccttggagggactacagaaatacgtttctg

SEQ ID NO: 111476 - DNA, 1027 bp, Homo sapiens
ttctgtttcagtctgtgtaataacaatgtattgagcacatgctgtctgctagacagtaacattgtcaaactgaaacaaatatttttttttggatgtgcatacaatttcttttgtaatgtggatttatcagtacattactactacttgtgccatttttcaaagatacaggacaaagtaggattttataggctggtatgagtatctgagtcctgcttttctagtattgcttctgtgagaaaaataagtcctagattctgcatttaattgataactttttttatgagtactgggattactgaaatgcattgtttcccattagtttgtttttctttgatatatctataaatttggcattcacgttaaatttttatcttgagttttactcctcagtaagcttttaattggacactcatgagacctacacatttctccataaggatatatcatctcaatttcatttcttcttgcagaatagttattttaatgtagttcttctcccttatcacattaaagtattgtatttttgaataatgaaagagagacaaatagaaaaaagaaaataacaccatgaacttttgttcctttgcccagggtaggcatatggccagatttggagttaggtgaatctgtgccaagcatctgatcagaaaatgagagtcgaatatataggctatgtaaaccagtgctttttaactggccttgctttagaagcaatgatatcatgtgttattccagctggaaaccagagttagtaatcaggcaaagtaagtttaaggctaacaattttggttcttaccatttcatgggtttactaaaaaagtttcaaatacacaccttatgccagtgactgaaggcgcatatgggtgggtcttcattttgtgaaaaacaaggaggatacaaccattctggttattcttgcatgaccaaaagggaaataacagtggtttgtgcttccctacactaactgaatcttccatcctgagccactccctctagctgtttgtaccatgacaactaccccagtggt

SEQ ID NO: 111477 - DNA, 1032 bp, Homo sapiens
gggtcttcatgctaaggttaatttatattgtgtttcagtgatacaacattatgatactatcacagagcataaatcagtttctattgctcgattcaggactcttaaaagagcaacaaactacttttctaaagggccgtatctttgaaaaataagcagagccacaaatttttaaaaaggacaggtaatcccataagcaattcacatttaaatgtttgagttttctgtcaatcaaaaaaaaaaattttttttaagatagaattgtttgctttattccacaactctagataggggctggggtgagagtgggaggaagaaagaaggaaaaaaacagaggattgttagcaaacttctgttgtaagaaggaccaaaaagattgattcaaagcatactccaaccatgtgcccactactctttagtaacagataacacagtatggctgcccatttttgcttcatatcactagccggaatttcttgggtctcattttcatatataaacagattcataactatgaacagtaaggaagagaactggaacttgtaaacataataaaacattgatttttgaaaactgtctatcatatagcttatcatatagcatttaaaactataacatatattttaaactatgcacaattctcccatccttgctatagtttctactgaagtataaatttttctgactgtgataaaggcttctagtatttttgagatgttaaacagattttaattatagactcacgattcccttgtatttaaatttatggggagggatcccatgattgaaacctcatatcttaaatataaaatttctcagtacaaggtaaattcatgttaaaacgttatgagcaccaagagaaataaacatcatctacttaaaggaaaaatgtttaattgctaaaagacagagaaaaattcattttattattgcacatataaacatgtcatccttctgagagcttgttattaaattgtcagttaactaaatagatatgttccagaaaagtgactttgaaaacactgaaatgcagtt

SEQ ID NO: 111478 - DNA, 1010 bp, Homo sapiens
tggcctacaatattatgtgccatctggcttcctggtcccctctgactgtgtctcttcttttcttctttgcagccacataagcttccttgctgtccttccaattggacgtgctgggtcctgcctcagggctttggctcttaaagttcctctgactcagatcattattcctgcagatacacacttggcaccatttccctttttccttcttagtggggcctttcctgtccatcttagcacttcatgtccccttccctatttcatttttttttcctccatagcacttaccactttctaatatattaatatttatgttgtattttggtttcttcctctactagagagctatggagagaactctccactagggagttccacgagagcagggatatttatctgatttattcactgctgcgtccccattgccaggcactcccggcattcaagagatatttgttgaatgaacacatggtgatggatgctgccagggcaggatcggtgagtgaagtgaggctacttgactaagacagagagggtgaagctggaagagggcatggggatctctagactctgtggaatgttttgaacactgtcattggcttagtaaaaacatttgcaaaaaagggggaaactatattcacatttgcttatgacacattaaatatatctggagaatgtttaagacactgattacattagctacctcttacactgatggcattagctgcctctgtagtggagtgctgggtgactggagacacagtgagaagttagtcaaatgaatgaggatggaggcaggagggagatgtcttactacaaatatcagtttgagtattttgaattttcaatcatgtgaaagttatttgttattaaaaataaatagacattgggcttaaataaaaacatgatttccttcttaagctagcttaaggtagggttctcacttctaggaaagaaagttgttgtctcttactttggaacctctacaaagcttctctcccttatattgtcct

SEQ ID NO: 111479 - DNA, 1047 bp, Homo sapiens
attagactatgagtgagtgttatcatagattatgagctttgagtgccattcaaaaatcacacctgtaatcccagcactttgggaggcccagattggtggatcacttgaggtcaggagtttgagaccagcctggttaacatggtgaaaccccatctttacttaaaaaaaaaatacaaaaattagccaggcatggtggcgcatgcctgtaatcccagctactcgggaggttgaggcagaagaatcacttgaatctgggaggtggaggttgcagtgagttgagattgggccatggcactccagcctgggcaatagagtgagaccctgtctcaaaaaaaaaaaaaaatatggtcataagtgtcaaagatgagtctagagggatataaataaagaagaaagctttagagatagcaagtttggtgaaatagtgaaaccagaagtcaggttgtaaaagataaagcgataggtggtgagaaaattataaacaaatagaggtctaaagcaataactgggagaaaaatggtagtttttttcaattgcttggaagactgagggaattatgttgattaatttatctgcaaaagaagaattgaaataaatcacaactttcctagcacaatttatatgtctatcaaaacaataataactactaccttcgaccaaacctaccagaaacttctcaatgaaatgagagtaaggataaaaatgttagtactaaaaggcaaaacaaataagtgcttggcaacaaatgtgcctgcaatggaaaagtctttaaaaagcagtaagctttgatagtcaaaatttatttgctaagataatttttataaaaggctgtttatagcaattgaagttactgccaatttttataaaaggctgtttataattatagcaattgaagttactgccaatgcaaatgagaaattgagaacttaaaatgcattttaacatggccttccagtccttgtctgttgttctctggattatgtggagtatttcaacaagaagtaggcagaatcttttctgcttttatgttttcctcctgttgaaatg

SEQ ID NO: 111480 - DNA, 2505 bp, Homo sapiens
aagaataaaagaaggcctttctgaagattaaaaaacaaataaaaagttgagaagaaagagcacgaagagtagaagggaacaatggtgtactcgccagcaatggcaatacgggttattaaaaagaagggtgggggcggggaaccctggccgactcaggacgccacgggaggaagccacgcaaaatagcaaaccgggatcctagaggggcggggcccacctcagcgcgcaggcgcaaccaggcccaggtggccgccgcggaagcgaagccacctatacgcgccgcgccgcttgggtctcctgcgcatgcgcagacggacctgcgctggaggcttcatctttgccgccgctgccgtcgccttcctgggattggagtctcgagctttcttcgttcgttcgtcggcgggttcgcgcccttctcgcgcctcggggctgcgaggctggggaaggggttggagggggctgttgatcgccgcgtttaagttgcgctcggggcggccatgtcggccggcgaggtcgagcgcctagtgtcggagctgagcggcgggaccggaggggatgaggaggaagagtggctctatggcggtacgaaacttcctgtctctgtctctcgggttctctcaggcctcccctcttggccctcaaacggccggcgtccctggcctctcgcgccgccgcttcgggcctctggttgggagtcctgtccggcctgacttaggccgagcgcggcgtgcgcgtgcccccagtccccgcggcggtctcccgcctggcccacgcccaccatgcgcatccacccctgtggcggccgggccgggctggggggctgtgaccggtcctggcccccggcttcgctgtgctttccccgaggcgtctcgatcgcctagctgctgcgctctttacccttgtttttttctgtcgattctgaggtggtggtttttggtgtctgtttttgccctgtggccttagggtgcccttcctgtcccttctttcagaaacagtcattctgtaataatagctaaataaagttaatgctgtacaactaacgtcttgtttcttgatggtcagtttgtatggaatgcacctgcaagggtacctccttgtctgaaagtcgtgctttaaaaataattaattaagagagagagagagaaagatggcccataaagaaaactctgaatgtctcctgtattaaggtgaagttattcttttttaagagactaccgtttaacctacatcatggaggtatctcatgacccttcggcttatagttttcagtgtcatctcatgtatttgtttttctcaaaataaatttaatgcatcatgtacttctctctagaagggtacttgtttgacatctggtttttaactttaagtcacaatcccttcttgcttgttaacaccagatttgaaagttaatgtttgttccttgcctaaaacatatattcttgattgtctttagaatagaatagtaaaagtgcactttgggcaccatgcaggtccttgatgatgtgactttgataaacttgtaaaaaaaaatcgtttggtggcaagatttagcattagttactactctttgaaatgtgaatgtgtaggatttcttttacaaagatctggaaatcttcattacctcttaaatttaagcttatttttatagcagtaaagtctgatttttttttccataaaataagtatcttgttaagtaattataaggtgatctaactttggatgtgcttataggcccatgggacgtgcatgtgcacagtgatttggcaaaggacctaggttagtgcttgtgatgatcacttcagattttcataatactagtttctttaagagtggtttctttattttgtttgcttatttatttatttgtttattttacttggtagatgaaaatgaagttgaaaggccagaagaagaaaatgccaggttagtgaaattttctgttgatgcctattacacaggttgtgtgaaacaatggttctgtcagttgtcaaaattattttcttacaatcattggcttcattacaacactgacttacaacattttggaggacattgaatcctttaaggattattccagtttcaggacctaatcttacgccaattctatttgttggtagtttaaaggacaaagtttttgaacttaggattggactgattttacactgttaagtaacttgttactcttaagtgaattcagtagtgaagtatacagtataatcgttaagctactgataaaaatattttaacttaattgaaaatgtttttaagtaaatcaggaacactccaaactactgcttttccagtttattaacatttttgatgatataatggcagtttggttgtaatttcaatgctatgtattgtttgcattcaaaatgtaattagctgatttgttataaggttgatttctttgttagattgtaagaaagatgtaagtgttcatttatagaacatatacagggagtcagaattttaccccagatttcaaaaagcaagccatgtaaa

SEQ ID NO: 111481 - DNA, 1857 bp, Homo sapiens
tcaaaattatgagttgaaataggtggcagcattataagcttgtaacttttaaattgtatctcaaaaaaatacagagtggggccgggcatggtggctcacgcctgtaattccagcactttgggaggccaaggtgggtggatcacctgaggtcaggagttcgaggccagcctggccaacatggtgaaaccctgtctctgctaaaaatacaaaaattagttgggcatggtggcgggcacctgtaatcctagctactctagaggctgaggccggagaattgcttgaacctgggaggtggaggttgcagtgagctgagatcatgccactgcactcaagccggggcgacaaagtgagagtctgtctcaagacagaagaaagaaaaaaaaaaacagggtggttactttttttagttattagtattagatgttgaaatggattactgaatgtattttataatttgtttatgttcatgtagaaagtgactgagaccgaagatgatagtgatagtgacagcgatgatgatgaagatgatgttcatgtcactataggagacattaaaacgggagcaccacagtatgggtaagttattttttagtaagtaacaattgtgtaaatgctatatagtaaggagagtgtgcctatatcaaactctcagtggttgagtccattgtttttacatttttctattttaacataaaagaacttgttaaagtttcatcatgaatatacttctttgctaaaatacagttaattgattaggcgaaggtacatagaagcagcagtttttgatgctgaatttaaagtgtttttataaaagaattgagtgctaggccaggcatagaggttcatgcctgtaatcccaggactttgggaggccgaggcgggtgaatcacctgaggtcaggagttcaagaccagcctgaccagcatggtgaaaccttatctctactaaaaatacaataattagccaggcatggtggtgggcacctgtaatcccagctactccagagactaaggcaggagaatcacttgaacctgggaggtggaggttgcggtgaacccagatcgagccactgtactccagcctgggtaacagagtgagactctgtctcgagaaaaagaaaaaaaaaaagtactataaattctttgattagaattagaaatccttaaattgtaatttgtatctgtacttattattatttcactttattatccagacctgagtttaggtttttaatttttttgcctaataaaaacaatatcaaaagtatttctttttgttcttaatagtgttttcaggtttctaattctcccttaggccttttaggccaatgtttgtctccaattttgtattctataaactggaccaagtaaatggactgtcattgactcattgagcgcataaagaatcttacagaaagattggaagggaaatacattgaagtacgaattgtgatttagttacgataggagaataagagtcaatgtgttttgtttttcaaattggctgtataatgtggttattatagcttatgcattggaaacataaaatacattaatttcactatagttcattaagcaacctcatctggaatcaaccagtatatacaaaaatattgttaaatattttattagtagagtcatttgttttcagaagtcatttcaggaagcttaaagccaattcagttattgtcatagtcagttttgtattataataatgactacccatgtaattttaaaatcctagcacctttttagggaacagagtaaagaggctgatttttcatgttaggggtggatattctaaatgtgctcctcattctcatttgggaaagtaaataattacttaatgagaaagttg

SEQ ID NO: 111482 - DNA, 3954 bp, Homo sapiens
agataaaccatggcgtaaacctggtaagattattgtggattatattaatttcaatattttcagtgtgaagtcatcagaaaatttttttgaacatcaatttagaattttattttttcattataattttaattgtcttaagcaaatgatgagtaataatgacttgggattattaaatcttactggtggccttgtattacttaaaatgtagacttattgtttattataatggcgtttgtaaagggaataatttgatcaaaaatgatatagtctttttgccaccataaatgatagagtgataactgatagaactctaaatttatatttttatagtttagtatatttttgatgctgcataaaaatagagctgaaatatttgtacactaaagttgtgttttatctttaggtgctgatctttctgattattttaattatgggtttaatgaagatacctggaaagcttactgtgaaaaacaaaagaggatacgaatgggacttgaagttataccagtaacctctactacaaataaaattacggtaattaataaatactccggaatacccttggcttgtctaccgtcccacttttactccccaaataaatcgcttccctataaaagtggttaaatgctatatgatagtttaaaaattccattttgtttaccatgtttgtttttcccttccctcccttttagagtttcgtatttaatgattatctgatgttcttactttcaaatcacagactagccacagctagtttgtctttatatggcctattaattaaatattatgtggtatcttaatggggaatatgttatttaacttaggccgaagactgtactatggaagttacaccaggtgcagagatccaagatggcagattcaatctttttaaggtgaattttagtaaattatccttggttgctctcattttttgttcttgagtctgctcccatgccactactcaagggacaagattaaagtggaaatagctaccttttttccaaaccttcagcttcctggtgacttacaaatttgctgattgttgttttatctccacttttgcaagcatgtgaatttatagcctattatactaacaaatgccgagtaaaactattgtttgctatatgttgtgatttcattttgagtcgtaatacatgtttgtaggatagaaaagttagtggcaacagattatgctctcattgtagataatactctaatctttatcaacagaattggaaacttttttgttctctttaaaaaaatggtaaggaaggtggcatactgtttatctctatgacacttataacactgatatcattggtgtaatgccctgatagctcaagatatcttcaaaaatcttaggcattctctgagaggctttaagaactcaacataatgagatactgccattgattttaaaaatttgttcttaaaaggagtaggtttatgtgagagactttgaggttgatactacaacttgtataacaagtctgatttctggcttctccattccatggtatgatcacagacccagtccaaagaataatactatattgtcatagttcttttatggaaaactgattgtgtactcttttttctttaccttaatagttgactcttatattgaatgacactgggatgaagattgggagtggcttttagattgggttgtatactcagggaactttagtggactggaaagagaccactgctccccttttgggtttgcagccctgtccaccagaatactgccttatgcagtgtgtgtgctatgtctgcagatacaaccactctactgtacacagttctatatagataattttattttaatttacatcctactttgcgtaagtatttggttcttcttttgcaaatattttgaaagtatgtgatgatgtctgttgtgttttaaagggtcatcagttttttctgggttatattgtctatataggcattgaatatattaaacttgactgcaatgggtagaaaagttgtcttaatgaactagttcattagcagcagtgcattttattttcttttaatagaaatgagaactgccatcataaactgttagcttctgtatacttcattttttgtagtagacttaaaaagagaataaaaagaaactcctaggggtcagtctcattgaaggtagccgttatgaatgtgtattttatatacatactgtgtactgaaaaatttattttgaagtttcttttggctatgtgagaggaggtcatagagtattccattctgattggattctgaatgaaagattttaattcgatgggtacagtcttcatggttttcttgccttgatagtgtgtttaaatactaatatgtttggtagaaatactgatttgggaatagggtgtgtattaagaatatgtgtggcaaacattttttctttatgtatattgtggtccgtaggaaatggtggaaatagggccatgatgagcaggacattgattttaaactaacctgcaaacatttgtgtagccaataggaagctgtttgaaagttcctgagcagtagaatgaagtggcagatctggtatttagaaaaggaactggcagcaggatgggctgtagaatgaaaggggtgtgaaacagatagggagctgttgccatactatgggactaaaatgaactagggcctgaactcacttatgaggatgaatgggcaaaggagtggatttaagaattaaaatttattttcatatctgctgcaaatagaattttttcatccttaagtgtgagacagcccatcagcctctttaagataactttatttacttttcattaaacaatttgcaaacccagtaacaagtagaatagtacacatgaacccttaggtgcttatcatacagcttcaacacttaacagtgttttgacattcttgaggtaacagccttttatgtacttcaatatgaataaagtttttttaaaaagcaaaataaaagaaatttaataggtataaaaataaagccactcaattgggtacaaaaacaattgtgtaattatttaattagagtgaatggcaagagagaagtgactagtgggaatagataacatgtatgtatgagaaaacgttgactacaacgttttcttaaaatattttttattcatttgtgcacatatgcatagattttccccccggcccccccccccccccccgcccccggctgtgaatgtatgagctttgtcaccagttttctgaaattttacagttatgtgtcttggtctgttttcatccattgtaccaagcattctcgatttggaagcacatatccttcacttatggaacactttcttcttttacttttttctctgctttcttttctattctagataatattggatatcttcgaatggtcttctaattttttttattgtttttctctttttcatcttttccattatctgggagaattttttattcttataatgttattgtacttagttttcatttctgttgttaatttccaagaaaatttttctttattatttagttgtagcatcttattattcatgcctacagtaatgcaatatctttttccctcctctctcaaaggatattaatgataggctgttttgtttctgttagatttttcttttcctgcatagtctgttttcaacttgattatttaagttagttatttttatcttctgacttagacttttctgaaatgtttgttgattgttggccattcactcatgtaacggtgggctgctaaaattgattggaagctctgtacatctgaatagaacttgcttgactgcaggcttcactggagggctgttttttcacattccctgatgtcagtatttttaggtgtttttctttttgtggtaatcagattttttcagataaggtattccagtattctatctagagggtatatacttggctgatgcaaatgttctggtagctggagcttttaatttctgaatt

SEQ ID NO: 111483 - DNA, 3498 bp, Homo sapiens
aggctgggcctggtggctcacacctgtaattccagcactttgggaggctgaggtgggcagatcacttgggacgggagtttgagaccagcctgggcaacatggtgaaatcctgtctttactaaaaatacaaaacttagccaggcatggtggtgcacacctgtaatcccagctactcggggggctgtgaggcaagagaatcactttaacccaggaggtggaggcttcagtgagccgtgattgcacgactgtactccagcctgggtgacagagtgagaagaggtattaagacagatgattaacttcaagcttttaagcctactgaactgtcaggatgatggtacttttaatggtgatgggaaaatgggagaaattgtatggatgtacagtagcagattattcacatttgtgttacaggaaatcacagtctgaatagaaaatggtcagaatggctaaaatggtcacctattgttttcttagaataagggtggtgaacacagaacgggaaaattcttcaaggtctttcttgaattcgaaacatgaagtcataaccaagtatctgggacctatttgtagtgatctgcaggaatttatgaaagtgccaaagaattaacagtttattcggcttctaagtgttattaatgtgaactttttgatagttggaacattttgatcccatactctctttggtgcctttcacctaatactgttctaaaataggctaattttaataaatattcagcaaaggaacattcttagtgtttaacttcaaattaaatgttgtaaacttattttaacatctaaagtccattatgtttgagtgttctgttaaattcaacaagctaataaccttttttttttaaggtacagcagggaagaactggaaactcagagaaagaaactgcccttccatctacaaaagctgagtttacttctcctccttctttgttcaagactgggcttccaccgagcaggttagttacatagttataactcaattactgtacgacattggtatctttacattgtatttgtgctatattaagtataaaagctctgaatgttttaccaaaaaactggaacattttactttggtttagtacaaaatgaattcttcacaagaaacttcttgatgtttttccatctaaaaagcctagggtaagcaagaagtgaagtgcggtatatagttttgtgtatgaataaagagacaatcttatattcaagagaggtgaataaagagacagtcttacattcaagagaggtggtaacagtagtatttgctgtttcctgtgctccctattcttacataaagaattattggacttctaagtctagatctattggcctgaaggtcttttgctaattgtagtgaaagaggctattgaaatttcagcttggaaaatctttaaaattggaaccatttgttgttgttgtttgattttatatgataatacctcatatgttcccgaaggtatcagatgtaagaggcaaatatgctagaaaatgtcttttttacttaaatgtgacaaatggttaccctattatgccattaccaggaaactggtaaaggatagtaggctaagactagcgaagtttgaggtcagtagtttaatcttggactagataagatgactaaagtctgggcctgaaacaaattaataacccaactattactagttctcggccagatcacttaccttttgtgttactggtttaaatttattttatatagttttctgtttttgttattctacagttttgtattgttataagagacattttagaataatctaatgcaggaagagactttatagtggcatctagtctagctctaagataacgattcttgaagccttcagccaaaattaaatggcataaagtgatccaggatttttgtgaattgtcatagacataatgaaatgtgattatttaagctaaatataatctcaaaatgtttggttttaaagaatttatgacagctaagctttaaatatgtagtaatatataatattgtaatatgtagtattcttttggcttatacattttttaagaggttaactttcattcattgagtttatggtattctgcagtatagagtgatggtaacagcttggactctggagtcagatttctggagttcagatgctggctctgcggcttactagctgtgctgtcgttgggcaaattctctaatcttatgccttgatttcttaatctgtaaaatgtagtaatagtacttccctcacagtgtagttatctatattcagtggattcatttatgtaaagtgttttagaacagtgctggtacctagaaaatactctagatgtttgctattatacttaaactatttaaaaatcaatagtttttctgtactttgccttttgtttttttattgttgattggcctttcaaaatttgggccagattatgtaagggctgtgtgccattataaaggctttggcttttcctataaattaaataaatggggactcactggcggattttgagcagagcaatgaaataatctgatttaggtttgtaaagtttcgatttagtcgctttactaaaaacagactacagagttacttagggtgggtgaaaacagggaggccagttaggaggttgcagcaattatctaggcaagagataatggtaacttggaccaagataatggtgtggagatgttgagaagtagtcagataccagttatatttcagaaggtaagccaatagcctatcttgatggattggatgtagattgtagaggaaaaagcagttaaggatgaatccaaggtttttgttctgatcaactgaaccagaatgatggttttgtcatttacagagatggaaaagaccataaggaggagtggttattggaggaagaagaccaagagttcagtgtagaatataataaaaatgagatgcctattggacgtgcaagtgggaaatttgagtaggaagttggctatatggatctggagtagaagggaagagtatgggctggagataatgaatttaggataatcagtgtttaatattacttaaatgaaactacaaaatggaattagaccataaaagaggtaagtattgatagagaagtggtaagagacagccttggggcactcccttgtatgtcaggaaaataaggattaactagtaagaggagaccattaataaggaggaatgatgaatgaagtaggaaaaaaacccactgtatgtcttgaaaatgatgtgtttcaaggagaaatgtcagctatcaaatactaaatccaattgattggtcaagaaaatgaagactaagaatgaccattggattttattgatggtcattggtgatcctgaccaggatcattttcatttgtataaaatgaagataaaagactttggaatggattaaagaaagagtgggaggaaaagaattagaaagagaaaatatgggcactttttggaagactattttctttctgtgggggccagagaaatgtgacagtatctggaggga

SEQ ID NO: 111484 - DNA, 2042 bp, Homo sapiens
agaacttttactgttataagaaaacctattcagtagtttaggatttgtttacagttttttctttgtctctttttaggctaagggtatataattcagatattgggttcagaagtttcctacagagttgttatattaagaatttaaaatatataatttggtttattgtgtctgtttgtatgcagttttagcatttatttttccttccatgttcactgatttattttttgcatatgtaaaacatctaacagttcgaaaggcaagagtatccaaaggtatatagaaacttgtcacatctttctctgtttctttcattcctgtcagaacagatttcatttcgtttctggtttgtttttcctgtgtttctttttacataaacaagcagatgcataaacatgtatatatatcctgttgctttgaaagagcatcttattagttctgtaaagtattggcaatattgcaaatatctgaactttttatgaagtatgtcaacagggataaaattaacttttttgggaactttactttgaaagagttattttgaaagggattttttataaaatagtataggtttttatgaaacacgtcagagtgttgctgttaactggttgcactaacaatacttatatccattgttgaagaatatagggaaagaaataccaaaatttttagtaagattttgtaaaattgcaaaaattaatattaagaattcatagaggcacagaaatgtattttttgattaatgtattgtaacctgatgtaaatccttagttcttttctcatttctgcattgacatcatactatgttgaagaatatttctaaaaatattctagagttaagaaagtgttgatagcacatctatatttaaatacttagtaccacagcaagtagtttatatgacttgagaatgatactgtaggaacatactaaaagactttagaaaaagcatgtcaagaaaaaaaaaaaaacagaacaaggggggtcagagacaacaatatgtaagaaaaaacatagaaaatttatctcaccagaaacagcacttcttctcagtctcagacaagtactgcctccagaaaagccaattcaagcgttgggaagtggcaggatcgatatgggagggccgaatcacctgatctaaggtaaggctatttttaaacattggatactccctgatgtttagatcatcaatgttgttatgccttattagtaagataataaattttgactgtaccatatttttaccctccaacttatgctttttcagggtacagttgtaggttttttagttaccttataaatcaaaacccagcacttgtcttgctacccatctttctggctgtttataatatttaatgaattatattgaaccgtgctaatggatgctcagtaattttttttttcgttctcttgctgcaggttaattctttctcataccacatcgcatttaaaaaaaattcccaggtgcttttcactacttatcgaataaaacctaacattctgagccagtatttaggacccgtaaaatttgactctactgaatctttccaatcttatacccactacagtgcaaaaacccctgatttcattaagcagacgtagtagctgccctggaatatgctatttcccttattgttgttatgcttttgttaatgatctaccctccagtgaattttggtttgtgttctgaatcttaaatttacacagcatacaacctcgaatggatattataatttctctgagcctgaaaattgaaataataacttcatctttaagggatgcaatgagaaacaactatgttccaatatgaaactacattacttgcagtgatcaatctgagagattgtgctttgataacctgacttcaaaatacagaccaagatactttcctaatttatcatttgaggttttaaataattatgatatacaaggggtaattttgttttttgtttttttttttgcttttgttagagaattttaagctatttacctggttagctcaatgctatataaatatgtttgcaattattttaatttaaaaacttaa

SEQ ID NO: 111485 - DNA, 2161 bp, Homo sapiens
tgtccctccatctgaaatgttctatcttcccatcctacatgtcttttaaggctcatctctttcctaacgtagcttaaaagatgctacacaatttccatgcagaactgtttacagccatctatttacatatgtgacctgaattaaatgtcataacaagtgcatctcttttcaagttgggaatatgagatagccacattctaggctttttcttagcaaatggacctttgaactgtttgctgcccagttcttattagaagcccttctgtgagaaaacattcatagatgtctacattgatatgtgattcacccattcttttagaatatggttataaactttcaagcaataattcaagcaatatttcaagcaaaataatttgaaaatttgctataaactctggacttttgcctggaaattgcatctatacatatctatttatttagaaatcagggacgtcctgattcttctttagagaaccatgttgctagttaagaacctgaactgttctcaaaagcacagttacattattagatcaagcctaaccattaagagggctagatacacagaccacgttgttttgcttcccctgattaaattgctcttattgaattgggcattgttgtgcttcactcagcattaaagggcattttgagaaatagctctttaaaattcaattttttttggtaggaattttggagactttatttccatatttttgaaaacatgagattgcaatccattagtgggttgtgaaacaatttggtggtcccaaccagtatttcttggttttgtattgtttcttttgcttttttcctatgctatatttaaatattaataaaattacattttatcttagtgtcaccatttttccttttttaagtattgtttcatgaatcttttttagtttttaatgtattgtgggtactggattgctgtgtaaagtgtacttcttactgtgttttgtagtcaataaagtttaaaaactattgtactcatattttctcttagactcagaggagaatctttttctgtttattctcatttgtaaaatgacaataatgagagttgctaccttatgggtttatcatgaagactaaatatatataaagtatttagaacagtgcttaccttgcgcatagtaggtgctccataaatactagctgtcattaccaggaaaacaatcttagagcaaatgctttgttttaatcttaatgcacattaaagacatttgttgttaatgatgtcctttgctttggcttccaagaaaaagcagctgagatatatatatatgtatatatatatattttttttttgagacaggctcttgttttgttgcccagtctggagtgcagtggcacaatcacagtttactgcatccttcatctcctggactcaagcaatcctctcacctaagccctctgaatagctgggaccacaagcatgtgctactatgcctagctgatattttaaattatttgtagacacaaagtctcgccatgttgcccaggctggtcttgaattcctgggcttaagtaatcctcccgcctcaggctcccaaagtgttggcattacatgcgtgagcctgaccttcagagatcaatttatggccttttgtctatcttctattagccctgatttgtcatcttaaactttctgttgcatctctgcagggagccctcagattctttctgggatatcagaatcatcaaaatatgataatttaattccattgtaacttcagagatatttttatattcatttactgtgccaggaggggaggtagaggctcttgggaacatttactgcctgtttaaactgtacattaactcagacacccagagtggttagtttcttagctttttactagatggttgagtccaatatggagaagaggattttgataatagcattagctgtctaccttactgaacaagtttgttggcctaatcaaacctacgctttggggaactcttaagttacagtagatttcctcatagggaaactctattaaatcttcttaagcaatgaaagaaaaagctgtccattaagaactttcgtggaataatatggttcaatatttttttccataatgtggcatcagaataatattagatttttaaattatttgtcagtgttagatattatgtgctttttgttgctgtg

SEQ ID NO: 111486 - DNA, 1050 bp, Homo sapiens
atgttttttaacacttggaatatatcacaaggaaaatatcttgtgtatgttaaaatgagcattattttcaggcctttttggggaatatttaaagtttctgtaatagagctgtagtatgtgttacaattgtagtggtcccaaaatttccatttgtctagcatttgctgtcttatttaatttcacaaagataaatttatttggagactactaaaactagtaagtgtagaagagctctacagagacttaaaacttaacattatgatcattgttgggtatgttggttctagcttgtttattaataaaaatttttatgacaatgcaaagtagtgagcttaaactcagggatatttttcaatgtgtattgtgatctggttttattttaaaatttattgcaaacacattttgtttttatttctcactgcttttattattttttaagcatctaattaggtgaaactgaattgattcaatttttatgttacaggagattacctggggcaattgatgttatcggtcagactataactatcagccgagtagaaggcaggcgacgggcaaatgagaacagcaacatacaggtttagtattttaaaataaataattttctttaactgaaggatgatatcaacattataatttaatttattcaatagatagtcatagtgctatgctgtgttttaggtgatacaaagagatttaaaatgtgaagccagtcatttattataaaggcatttccagttagaatttataatctctgaatctttttttaatagggttttctttcttttccttggtagaaacatagtacaggttgagtatctcttatctgaaatgcttgggaccagaagtgtatcagattttgaaatgtttggattttgaaatgttcatacgtatgtaatcttagagatgagacccaagtctaaacatgaaatttatgtttcataaataagttatttaatttgttataatgatttgttaatttatgataatcttttttcctttggcaaccctgagtaaactgtgtagtgggcctgagttttgattgtgatc

SEQ ID NO: 111487 - DNA, 3814 bp, Homo sapiens
agactgctactgggtgcctggtatttatttcttttaaacaaaagtaaatgttgatcatatttttagctacttttgattacaattaaaaaccaggttagtggtgatagagaagaaactcacaaataattcccaaattttatttttatttgaatttttcatcgggttgcctttcttactttgtttttaacctttatctgccttaaccaagtttttatgaaactagcaagattgattgagataataattacttcttcccagggagaaagctagtagtaaatgatgaaaaaatagctgcttgtcctcatcagggcaacatgaaagacgtatgttaggctttacttcctattaatcaaatcagtttatactagagagccatgtactctcactcacttttatttgcaagagagctgtctttgttttaaggtgccagttgtgatccgagtacagaaccaaatccagggtctgaatagtccttccctaacatattcatccttggcctctaaatgtcagccactgcttctgtctttcatcttcagtgcctttgatttccttccactgtcacctctactctcaaaaagtatgagaaaaatatgaaaaaatgacttgtggctttagagggtctgttgtctcaacaatagtggaaggaagaggttggaatataggttagaggtccttattccagacaacattagtatttctaatttcagtgaatttctagttccaacaaatagattgagcagaaacgactcattagttgggattgacttgtggttcttgtgtctttaatatgctgagtattaaccaaatgaaagaggacttaggtgattcaaaatgaggacttctgtgatttctatgtgaatcctttgtcctctgaaaaagaattagataaataaaaggtagaaataattaatgtttcaacatatttgattaatgatactaaaaaaattattaatgtttgtggtactctgttggattcctttgtaatattacttaaactttactaggtagtgatttgaaataattttctttttttaattcttaaaactttttaaaaattttatttttgacagtaatacttgtatatgtttatggggtacaatgtgatgttttgattatgtctacattgtagtaaatcaagttaatatattcatcacctcacatacttaacatttttttgtggagagaacattctgaaatctcctagcagttttgaaatatacggttattaattatagtcaccatgctgtacagtagagctccaaaacttgtttttctcattttactgaaacttttgtatcctttgaaaatcatctcccctacctcacccgtggcccccagcctctggtaaccaccattttactctctgcttctatgagttggatcatataagcgagattgtgcagtaattgtctttctgtgcctggcttatttcacttagcacagtgtcctccaggttcatgcatgttgtcacaaatgacagaatgaaaggatttccttatttacaaatatagtatatccccagatggctaacattttgtatgttcagtactaattattaaagtaagtaggacagagttggtatgaattaatgacaacaaatacttagctggtataagaatattcgaaactccgtagaatattgctacagaggtaattgctacacataggcagtagcattatctggaagtttactttttttcaaaatgataaaattacttttttttttttttttttttttttggagacagggtctcactctttcgcccaggctggagtgcagtggtgcggtctcagctcactgcatcctccacctcccaggctcaagcgatcctcctgcctcagagtagctggtactacaggcgtgtgccaccatacccggcatttttgtattttttgtagagatggtgtttcgccatgtccaggctggtcttgaactcctgacctcaagcaatctgccctcctcggcctcccaaagtactggcattacaggcatgaaccactacccctgaccatttctttttcatgtaacctttgttcataagtataacaaatctttgaagagtgtttaggttattaatgacattatactatagagtgcagctaattatttttctgttgcttaatctatttttctacttaattctcagctacatgctttccatattttaaaatcgagatttccttttatgtttattcttggtttacatttctatgctcttctgtcaacatttaatgagtgcagattcaaatgaattctaatgctggtttaagcagtacctaactggtatatgtgctgagcaggataccagttcattaaaaccaaatatttgaagttgagactctctgaattgctccttacttttagtagaatgtgagctgttggggagcgtacaggctatgtatttctatctatgtttccctacagttttagtcaagtggtcttgtacgtacttggcattccctaatgtgtttgctaattgagttaacgacatatttatgtatccataacaccaaagatgattttcggatttatacctggtacattcaatcaggatgggcactggctctgaataacagtacggctgcatagatatatgccagctgccatgcttaaagctgtggttttcagttaccctttaccacagaaccacatgattacactatgttccgtagtttgttgtaatttaaatcaccttaagaatcataagcagctaatgaaagaaagctatgattcaggattctttttaaagtattgccttaaaagatattccatttttcttagataaactgtcttgttttttgctttcttcaaaaataatcaaaagaaaatggaaaaacatttttttaaagaattaatttaaatgtattttaatgttgcctttttaacattagacttctaatgtttttaaaagtaaagtccaaaatatgatgagataagtatagtaatgatattttattctcatattttaggatgctactagatttttgttttgttttgttttgttttcaaataaatagggtgaccatacatccagatttgcctggaagagtcctactttataccttctatcccagcataattattattcattcttagaaagaaattccctggtttagatgatacaatttctgattgactcttggaaatttacagaggtcttattgcataagtagataagttactgtttaacaattataaggtgttagagataactctcatttgaaggacttttaatgtcaaatagttcacagaagaggagaaatgtattgcctcctctcacccttaaacacacacctgcaaacgtatatgaaactttgctagtaacacagagaggacaaagtatttctggccataatagatttgtatgaagagtagaggagatttatgtattagaatacaacaaagaaggaagagatgtctggaagtgcaaaagcatttatcgtggttccctgcagccatactaacagtagcttgaaaacaaatactgggccaggcatggtggctcatacctgtaatttcagcattttgggaggctgaggcaggaagatcacctgaggtcagaagttcaagatcagcctggccaacatggtgaaactccatctttactaaaaatatgaaaaaattagctgggtgtggtggcatacacctgtagtcctggctacttaggaggctgaggcaggagaatcacttgaacccaggagacagaggttgcagtgagccgagatcacaccattgcactccagcctgggcgacaagagcaaaactccatctcaaaaaaaaaaaaaaaaaaaaaaaaaagaaagaaaacaaata

SEQ ID NO: 111488 - DNA, 1316 bp, Homo sapiens
gaaagcctgttttctttattaactatgttgaaatgaatcagtacctatatccagaaaatcgtattattggattacgtgtatttgtcacagtcctagaaacttttttttttaaagcatttctctgatgttgaagtacatgcatacgtatttgtgggtagggaagttagggagattataaggaacagtcatcacatttttgaaaatctgaataaggtttttactgtttgcctggcttgtgttaagaagtctgtgtttagctgaagtcagttttgaaatatttgtttattggaagaaaaactgtaaaactggaagtattaatgttatagggtaggtgattttgtgtgtttgtttattgtggtaaaatacaatctatttgtcattttagccatttataaatatgtagttcattggcattaaatacattcacaatgttatgtaaccatcaccatgagctgtacctaaaactttttcatcatctccagtgaaaactctgtgcccactaaactccttccctcctaaggatagcccctgtaacctctattctactttttgtctctatgagtttccttattctaggtacctcatataagtggaatcatgcatttgtctatctgtgtctgacttactttgtttctaaaataatagaatttaattaatgattgtgagctaactttatggtaggctttaatttaggcttttaaatgttaatttacttcagtgtcatcatatttgatgttcatttttttttttgtagtggagtttactgtagaatagaaggtaaattcagttaaactcatttgtttttgtatgaactcttatcagcctcaaatgactagttctgtgggtcttgggaacaattgaaatgtagcccagtagtggaattctgctgagttgaagaagggtctttgctttactgagatatagcccaactactgtggaccacaaaccaggatccctgcttttaaagttagctatagggtttaactgtttatctagataccagatgtgtaggattctgcattttagaaagaagtagatttcttcctaaaagactgttgtcttgtatcagtgtctggctaatcatctagtactactaatttcatgaactttaaaatcttatttattccttaaatatgttaatttcgggttagggatgatatataggaatcgggtcagggggtgggggcgggtggcgagttgctcatatctagggtcattctgcatttcctctaagtcctgcattctcattagattatttttctgttagcagtctggttctttagcacagcagttctcaaaactttttggttacgtct

SEQ ID NO: 111489 - DNA, 1039 bp, Homo sapiens
gatcctaataaaggtaacatagtttgtccattttatagtgtatgtaaaattaccttttttaccttttagacatgaagtatgctggtaaatttttggttactttgttgtgtgaccgtaccactttttaacccttttttcttttcttaaaaataacttaaaactttttttgcaccttgtaattgttttaattatgaaataatggttttgccatattctttctacattctggtttgtatttaagggtggatggtagatgagatgatacacgtgtgtgtgcgtatgtttttgtttgtgttgaatttttaaaatcctgatacatagaaacgcatttctggtagaaggtgatatttaaagatttttgtaaaccttgtccttttctactcattttgagtaaaacttctgagcttgatggctttgaaatacaagtcatgagacttaaggaaagtgatcaagtttatctgtttcttaaataatagtgccgacggaacttggaatttactagtgagaaataggaagcgtagtttacatattctgccattttttttctttcatgtgaatttgaatagagaaaagatagatggttattgcatgtattgggtttctactgccgtataacaagttactccagaatgtagtggcttaaaacaacatacatttattattgaacagttttcatgggtcaggaatctgggacagcttagctggatcctctgctttaaggtctctctcagacctcacagtcttctccaaaagcctgactaaggaagtatttgtctccaagctcactcacctctttgttaaaaggattttgtttttttctaggctgttgcattgacagggcttcagttcctcactggtgtaggcgtcttaatatgttagcttgcttaatcaaagcatgtaagccaagaaggcaacagagagggtgccagtgaaatagaaataactgtcttttgtaacctagtcatggaagtaacatcctttgattttttttgtgtgtggtagaaataagtcacaatgtccagcccccacacaggacata

SEQ ID NO: 111490 - DNA, 1450 bp, Homo sapiens
tttgagaccagcctgggcaacatagcgaaaccctgtctccacaaaaaatgcaaaaaattagctgagcatggtggtacacacctgtagtcccagctacttgggaggctgaggtgggaggattgctttgagctggggaggcagaggttgcagtgagccgtggtcatgccactcaccctacacaacagtgtgagaccctgtctcaaccaaaaaaaaaaaaaaaaaaaaaaaaaaagagagagaaatcatcttctcttttgagaatgccagatggtgtaggctctcatagtccttttaagtgtcataggtagatgcttttgtttcataaaaattcggaatgggatttatttagtctgtactaaattgctcagcagtgaaattaggagggaagcttagaatcggatccagtgatcctcatagtatagtcctgggccagcaacatcatctgggaaatttaggggaatgtaggttttctggtcccaccccagacttactgaatcagaaattctaggggaagggcccagcaatctgtgtgttttaagagactctccaggtgattctcatgcatgttcaaggtagtttttatttatttatttatttatttattattttattttatttttttgagatggagtctcgctctgttgcccaggctggagtgcagtggcgcgacctcggctcactgcaacctccgcctcctgggttcaaacgattctccagcctcagcctcctgagtagctgggactacaggtgcatgccaccatgcttggctaattttttgtatttttagtagagacagggtttcaccatgttagccaagatggtctccatctcctgactttgtgatctacctgccttggcctccggaagtactgggattacgggtgtgagccaccgcgcccggcctatgttcaagttttaataccactaatctgttcagtctgttagagcttgagtattacttttccaaaaggttttggctggcactagaaatctacttttactactgttacatacagctttccaggaaaatcaacatttttttaaactcatttttcagataaaggatatagaaaagaaacaaaatactttccttatttaagtctgttgtctaggttaggcagcatgtgtttgccaggaagatggaggtgttgggaggggaaagaagagggacgtttgagatgaattttctcttcccttacactgtttctcttttattaagaaaagtcaaatactaaatagtgatttttaagtgagaatgatgttggccttacatgatatcacgtatcagtttgaaaatacattcagtaattgtcaaagaattggttatatagtgtttcatcaactttatagtcttgttttaatgaacatttacttataaagatttgcattgaaataacatcttagatgaaatggaggtctcacaagaagggcccttgctagttgccatgcc

SEQ ID NO: 111491 - DNA, 2164 bp, Homo sapiens
tatgtcttttatctctacattttgtggaagtttaacaacttaaatgtttttgaggactaaagtttgaaggggctgactagtaattttttagtttttagcatgaatttacattttagtaagctgtagtaagccttagctaaagtgatacatcctgctcacataatcatttaggtaaagttattaggattatagtatatagaatgggtggatgattttggtatattcctttatcttataaatcttatcttacaaatctgtatcttataaatctacgaaaataatcatgtatttacttatgaaaactagatcaaatagtgaagttaagtagtgtccgtattgttctaaagaaaattaggttgtagtatatattaaaaacatttaatgatctgccttccttacttttctcatttactttggagtctgggactctactagcttgtatggtttgttggattcttttagtttagtaatttgggaaacaggaaggtaacctcaggatggatgagaattgccattagctatgggtcagtttagtagacttgtggattcataaagatttttgaaacttgatggctgctttatgtatctttagtcttgttggctttgtaagtttggaatatgtttttattgtatgggtggttaaaatcaggtgctttggtctcttttttaaggccatttgctaccttaagatctttttaatctaaatctcttactctgataaaacatgcacatcagaacatgtttagtgttagaatatgtttcctttgacaagaaaacatttgaaaacaattctgtttctttttttggcatacatttagctaataaattagattattttttggactaattttgatgcagtttttaagataggatttaggaaaccgttccaactgttttagttatttatggtatacaacttttcatgaaaaagttactttaaattgtcttacttttttttattttcctgcttagaaatctctcatttttcctccactgaagatagttaaaatttgcatgccacataaattgcctttcatgtatctcttaaatttaaaatgctgaatttaattttagtatttagtaaatacattttacattaggctttaagggcacatttggtccctgtaaattaaaaatatacatagtttattcctcagagtttataatgtgtacaaataatgagtgagagtcactcaaattaatatttgctagcacctgtagaagtaaatcattcacgtttatgttaatgtgccctgggggtgtatatatatgaattggtttttccccctttctctcctacaaatcaaaggaaatgttagccttttctcacttctgccaacaatactagaacagtcaacacttgaatgaaccacaacatattgagctttacaaaagtcagtaatatccatcatcttgagttatccttgtactacctgcagtattagagaaagaacccacagatcagtttttctattaaaatgttaaaataacaacctcaggcattgattatcatatttagtaaggattaacttcatggcatttgataattgtgtgtgcataagtgtgctttttaactgatgtctaactttgtgattactagtgggggaaaccttgttatcaagttgttagactgggttttcatcaaggaagttggatgttatactcgaattgttagtcctctacgagaaaacagaatggttctcttgagtgaataagccaggataatgaggcgaggggttttatttcaaagtttgttttggtgatggcataaatacataacaggttctgaaatccaattactatattaaatttcatcacttgttttttaggtattccaataactgtaccacctccaggtaaaacttttttcatgttttctccatcattgttaataaacatgaaatttcaagcttatagttacaggagagacggtgttgatgcggttagaatatggaataggctatggggatttcaaggtcctattttcagctctgcctttgcttcattccagttttgattaagatatttagttttcttatacctgtcttacccgtttctgtagaaatagagattctgagaaaattcttacctattcaatttgtgaagaaaacagtataggatataaaataaaagttttcttaaaaatgtctttacagaccaatga

SEQ ID NO: 111492 - DNA, 2018 bp, Homo sapiens
actataagagaagagaaagataatttattttgtctttatcattatttccgattttttaattttagtcctgctggcttagtatcgtgagaaaatgtgttctaaaccccacatagcaactagacagacagctggtcaggtggctgttcttagagtggtgattgtttattgttgtaatagtatgatcactaggagtttatatgtggcccagtgttttatttatttatttatttatttatttttacatttttgtcagttatttctttttatagtgtgatatcacacctggtagcaagtgtgtcttcctgagttcagtgttaaaagccaaggtgtgtaaagagaatgagaggtgataatgcttgcaagggtgggtctaaattcaaaatgacttcaataaacagaaagagtgaagtttaggtagcatagtacagtatacatacttagatgtggaatacagacattgattatgtgtgaatgtgtctgaaaaagactcatcagggaaagtcaaaggaatcatttgtgtctttttagtttaaaaaacaatgtggttgtgaggctgtatgaaataggattgtggactttaggactaatgtggtaattgccaaattttgtacttttaagatgtttaatagaggaattatagatcctaacactggatacagtgaagaacatggtaaacatgaaaacaatttgaagtggggctaaaaatggatttaagtggacctttgagaaggattcagagaactgattcattttttcacagaattactaaaacggaggcttagtggaagtgttttcacataactagaaggtgatagacagtatgacagtggaatacctcttgttctcatttaggacagtgtctgaattgtagtatgagagacttaagttagataatttagtgcatttcctagtagtgagagttgttaattgttaacacttggaaggaattggtatcataaggaattgacatcataagttttggaaatctttttctgctaggatgctttatagcctatctgaatttgaaagtgtagtgtagattaactgttttttagccatattattctgtggtattccatttaggtattgtgaattattcagaatgcagaccccacgatatagaggtacaaattatattccttccaaactaatacacaaactatattatgtgcttttctttgtaaaacagtttgttagggttgtgctatttgaacatattttctggtggatattctcagctttgaacactgtacatttactggtaagattttatttataaattacacattttaaggaaatttctatacttctaaaactcgaaatattttttgaaagaggtaattgctatatatctgctttccttctaaaatatttcaaatatatctggtggctactgttttatgtatggagaaggtaaggcattgagattaactttctcatacttacaaaatgggctgtgtgtggtgctgaaaataagaccggtgtcctgactcccagtttgttttctgtgtattagaccagactgcttacttaaagttttattgcgctaaaaatctgttcataagtttgagctccatttttttctgtccattattacaacatagagaagcacattcatatccccagagaaatttagtgatatgcagcaactttgtttcactcttgacattaagtgtacattgttaacattttttatcttatgattgaatgtttcaggttttcctcctccaccaggcgctccacctccatctcttataccaacaatagaaaggtaaatcagtatggatactgatttttgatcattgatagccttttgacagaagaaccatatacttggaaatattttcagatatttaattttataaacacagcacctgtcttttaatttataaatctagatctatgttagttacttttatataagatgttggacctgtagcccgatatcaaaacagggcaaagaaaactaaaatcgtaatattttgaaataatatcttgctttgatttatgacacactt

SEQ ID NO: 111493 - DNA, 1053 bp, Homo sapiens
catgcccggcaaatttttatatttttaatagagacggggtttcaccatgttgaccaggctggtctcaaactcctagcctcaagttatctgcccgccttggcttcccaaagcgttgggattacaggcgtaagccatcgcgcctggcctcctctcaacactttgaagatgtcccagtgtattctggtttccattttttatattgggaagtttgtggtcaacctaattctgattcctgttcaccttgtataatgaagggtctttatatgttaggtttttaagatttgtttctggatcttcccgatactgtgggtattcattcaccatgtgatatttctcttttctatttataaaatgaatttctattataatctcatgacacatttttggtgggcattttgtttttttaaagtaccataacgtttgtttttaatcgtgttttttctttagttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacaggtttgttgggtgtgcaggagtttatactatgtattttataagcacttacaaatttattttcgttatgaggaagtgaatttcagttcacttggaaaagagatgctcagggagtacataggaaagccatcttaaaatgataaaggattagaggcttcccattaccttgaacagtagtccttaaatttgtttgtttacttatctcttaaaagaattttctaccccttcatttatttttatcttgccatctaagtttttcatcttaagcttaaattagttgaccatatagatatttccagtgtattataaatattaatatttaaaaagaaaattatcaccacttctattattattctatttttagagacggtcttgctttgtcatccaggctggct

SEQ ID NO: 111494 - DNA, 5401 bp, Homo sapiens
ttattagccatgtagcccccctgcccacacagatgtaattaggatgtcagaatgcaggtatgtccaatctgcattttgtatggatgctgtagaagttgctttgatgtctctgttctttatttttatacttctctatttgatgaatatttagtaataaacctaaagtttaaaaacttatttgctttctgttttgtagtaattgtgagtcgtgtatttttataatgttaaacgtatgtccaagactttccaagaatattgattagaaatctgagatatacaaatactattttaattctaaaaggagcaaaaattttaaaagctgataacaatttaaatcagttgcagatctcactttttcaagaaatgaaaaaaccaaagcattgttatattaaatctttttaacagctatgaaagcacagaacaaaattggtcatttaacatgtgtaattattatatatttatattcttagctctagtgctattttgagaacaagcattattttcctctcaattcaacgaatatttcttcctcactaatgttataaaagatgctaatgtgaggattttggatttggactgcagatcacatctcttttacagtttgaatccattcagaattaatggtccagttgtcaagaaaacatttctatttcaatttcagcgatgaagaacgatacagatacagggaatatgcagaaagaggttatgagcgtcacagagcaagtcgagaaaaagaagaacgacatagagaaagacgacacagggagaaagaggaaaccagacataagtcttctcgaaggtttgctctttaataaaatagtgaaccaatagtatgtgagagattttgacttactacattgtcgcattggaagaggggaaattttggcctatgaaccagtcttgcttggtttcattaaagaaaaattcagggccttgtctcaaatttttttaaaaaagcattaaacaaaatacctattgtttgccaaaaatcaaccctatacagtatttccggttttgagttaatgcctgtttctaatttgttactgtatattataatatgcatttcagaagctgtgtataggcactgggaatctgagataatatcagtgaagatggccctataaaataaatacaatccctgcataaaagtcacataaaactgattattcctcacattatatttatgagaaaatgcattagattattttaaacccagtgttatattgagaatttccttagagtgattggatttttgtcactgattgtgtatttaaacagaacacaccttttttttttttttttttttccagtaatagtagacgtcgccatgaaagtgaagaaggagatagtcacaggagacacaaacacaaaaaatctaaaagaagcaaagaaggaaaagaagcgggcagtgagcctgcccctgaacaggagagcaccgaagctacacctgcagaataggcatggttttggccttttgtgtatattagtaccagaagtagatactataaatcttgttatttttctggataatgtttaagaaatttaccttaaatcttgttctgtttgttagtatgaaaagttaactttttttccaaaataaaagagtgaatttttcatgttaagttaaaaatctttgtcttgtactatttcaaaaataaaaagacagcaatgactttatatccaagaaaggaatgtgaatgagtcacttaacagggaatctaaagagctgtgttagctgtgtacatacacagattatctgagaaaaggtcaagggttccacttgggccacagtttttttgttaatcaaacaccactctcttaagaggctgcatcacaaaaggcaacaaagggcccctctaaggcttgagattaaaactagtctttatcattactgctgtgacactcttgcttagtatattaagagactcatacatttttgatatcacaactttttgatggcttttcaatattctaaatttgggttcctggtgaaaccaaatggggtacactttcatatccaaattaataaaacctataaggcatctgggtggcctctatgaaataaattaattaattacccatagtgtagtttctaggaggcatgtgtacacacactcttcattgtggcacaaatttaaatcgcctcatgaccatgtctgtgagccagggtcaagctggtttggccttcttgatgcattttccaaggcccactggtggagcagcatgagtttttatacagttactaacgattgtggaaaaaaagagctttagccatttcttactaaaaacaaaacaagtttataattaattctctgagcgagcatttttagggataagcctaggaggtattcatcggtgatggtaacaaataacatggtatttgaaagaataaattactaggatcttttaaatagtgataatacaaaagtaatcttaattagtatcacatactaaaagacaactataacttctgaaaaatatttattcttgtttgatgaaagcaacgtttctcagcaatgcattttaaaaaatattttagctgtaaattaaaaatggccataatgtacccttggcagacttcagcatataccaaattttaaatttaaatcagcttgaattcagtggggtatacaaatcattttagttgttttagggctttttattgaatagaaaaaatataaacaatgttgtagagtaatgagaaatcctccacactgaaaaaaaactagtagttttaatttttttggaatcatattttctgaggtgtaactggctttcattagatgatcatacttttcctgacatttttacaatgtattctttctttaaatataaaaactgacaagataaatatagtgtttcaacttcttagcctatttgtgatttttctgttttcctctgacccatcattgattctataaaaaagtgccaggccaagaaacaatagttagagtaattcttcctttaagttctttcagcagtcttgccaagcaagcatgtatcattcctgatgtacttctaccattgacagcaagaagaatatcaccacatctaaaaaaaaaaacaaaacaagatatgattagtattttaattcgttgctgaagttaatgcaagtttatcttagtggtgctagattttgctacatctgaccattttaattatgttaacttctaattgagatatttcttgcctcttatttacattctccaaactcactatccattcagcttgtgttagaaggaatgctaaaagtatggggagttgtagtatgggaccaagaatatgtgtaattattttggatttctcagaagttgaatgctacgtacatacttttaatccccacaaagtataataaatacatgccttatctcaaatggggccaagctttggcatttatgaaacaacatttaatacaagtatttttgattagtcattattattacctaattcttccatcattgtatgctggtgttccttcaacaatggatttgatgaaaaaaggtttgtttccattgtattcttcataacctcctacaatgcagaagcccagacttccagctgtgtttcttcgtaatacaatatctttacagttatacaagcacctgaaatagaatgtaatcagtgtacatgcatatttaagtttcacagttaagggaatacttactgtgactcatcctccattccttttgttggcatttttaatggctaagtaccactgcataggtcccactcaaaattgtatcataccttggtgacctttgtgctgttagctggctttttgtaattgaacctgttttccataattttgaatatccttaaaaaactgacagccctattgtgttctgttacacatctactgggaatgataatcatatttttaacttaagacaatgcttgaatatgtattagcaaaaagttggataaacctaaatccttattggtgaacaaacacacttatggatgtcatatttttatttacttgatataattttaatgagggcaaaaatcctttgaataatctcaatgaaagcagtttaagcctaatcctaataaatgaattcgtatactttttttgaccttggaaaaataccactttacacccagtgctacgtttgataagtcatagagaagcatgcacgcataaagtgaatggaaacagaaacgtttaaagattataagaacaattcaaataggaggaaaaacaaactgcaggaaactggataggaagttataaaaggaatgggagaaggaaaggcccagctcttctgtaaattagaatcctcaactaaaatagcaaatgagattgaagaaatttttattcagtggcccccaatggatcagtgttcatataggtacaggccaagtgttaactatgttataattgccatagaagtgtgtgtcaggagctgaattttactccaggatgacgttgttgaccacatttgtagctgtagtccgggaattggtttgaaaggaaattggcattttcatgttgccaaaaatcagatatggctattttgtttatataccgtaccttaaaatattaactgctttttagaaaccaataaaaagtcttgtgaaatgttaaatgataaagttgatcattacatttgttaccaaccttgttagtcaatgtgacgtgacttttttcatgatgatgttttcacttgaaataaaatgagctttagggtttggcaaatacctttaaaatgtaatgctgaaattcaactctaaccagttctgaatctatcgtcatacatacacatcatctataacaatttcttttactgaaatgattgcttaaaagtatgaatttcattaaatttcctattgtaaaatatttatctgctgcatttcacagtaaaccttgatgtcagtggtaaattcattctttgggagctgtggtgtgtcacataacacactttacataacggttcactgactcctcatgtacaaagcaggtaactggctattctgtaaataccaaagcattacattcccacctgggaggatgtgtgcccaattttttggagaaaggtaagaattagatgattgttatctaaggtcatgatcaaatatcagttttaattgcccagtttgattctttaaaatagataaatgagtatacttttactgaatattttatttcatatggagaagctgtaaacataaccatcaaaaatattacgtgttctagttcaaagctttgaacccagtaagtcatagtgtgcctattttctaacctcttgatactggagagaacataactgctttgatcatctttctgcagatgtttaaacaaaacacaaaatcccctgccctcctgaagcatccattcaagttgatatcagtgttcctagttttatttaattaaaaagtaaacgccttcttttagtggtgt

SEQ ID NO: 111495 - DNA, 1049 bp, Homo sapiens
ttgtttaagtagctttataaagagatctagcctttcaataaaagagcctggaaacttcctttcatatcagtttgtctgaaactgtgcaaggatttcttccttttgctgagaacatgggcaaaaaaaccttgcaggggaccaccctgagacctgacacattcccatccgcacacacacagtatcacacgcacatacactccatcgtgctcacacactcagaccctcactcacacactatcacatctacatacacacacagtggtgaggactggaagttctggtatgagttgacccagggagaaaaattcaattggagatttttgggaagaaaatgtcaactcggcttgaagagctgtttaatgcaatcatttgactgaggcaaatgggaaaaatgcttttcttttgccttttcctaccttatcttccttccctctcttcctgccagctaaaaaataatgacaacagaaatgaaggctaggattctgggaataaatatgtgggcttgggtaagaacaaggtggagaaagatggtgtctactcacagaggcctggagaggtgctgcaggccacgcttggagagaacagggttagaaacgctgttggaaggtgcggttattggacacaggatgaggtgggagagcagagcagtctttaaagacaggatcctggcttttctgtgggcctggatctttcaggaagggttgtggcaggtggagctgaccgcacgattgttccacctgcccccaggtcaacgggatggacatcagcaatgtccctcacaactacgctgtgcgtctcctgcggcagccctgccaggtgctgtggctgactgtgatgcgtgaacagaagttccgcagcaggaacaatggacaggccccggatgcctacagaccccgagatgacagctttcatgtgattctcaacaaaagtagccccgaggagcagcttggaataaaactggtgcgcaaggtggatgagcctggggttttcatcttcaatgtgctggatggcggtgtggcatatcgacatggtcagcttgaggagaatga

SEQ ID NO: 111496 - DNA, 1196 bp, Homo sapiens
tttgtgagttagtcttgtttccttgagtcatcatactgtagtttttaaagaattgataacttattttctgaatttttattattttattcacatttttcatcctgaccagaaaaacgtgagcattctcagaagtgacttgtttcttttttcacaaagagagacctatgcaaaaaatgccattgctgcttgcactagttactatcttagaatccatcacagaaagcccaaaagatagcacaaccttttgtacctacagtcttagatattgttagatagccattcagttttgtttgcattgtgtatgagatgaatatttcttgagacttttttgtttgctctactaaagaaatcaaccaagggaaaaaaaatccaaaaaacaaaacaaacaaaaaacaccctctaactcatgtgaagcatgcagggtgttgtaatttcagtttgcaaagcggtgtgatacaatgttgctgagccaaaagcacacgatagatttaatgtagccaattgtgtacttttgaaaaaaagagtaactgttccctgtgagttaattttggatttcttcaaaatctctcttttaggctttgtgctggattcttccagacaaatgcgtattccatgtgggccactgttctgctaaatgctctcagttctccttttgcaatcaagattatgttgctaaggagattttgcttttattgctgccattgatttgtgttaatacgttttgaatacctctcggtattctttcgtagacaaggccaaaagaaaaacttccccgagtttcccaatttacattacaaatggagcggtggtgtaatgaagccgatataaagtgggcagttgaaaggagactaaagaagggcactcaagtgagaaatgaagaaatgtgccgagtgcagtctgtgggctgcccttggtccagctgcaggaactggctctggccagaggtagagtgagtgagcacctccctctgcaaagaccacccacttttggagcctaggctggcacaccaaagattacctcattgattaatacagggcttgaaaatttctgaggtggcaaaatcacttctaaatctcttttttgagtccttcctagagcatgactgaggccacacttcctgtgccttatgacctgaagttgtaaaggataacctatggatggaccagttcttttggttctgaggactagtgtatttc

SEQ ID NO: 111497 - DNA, 2255 bp, Homo sapiens
caattgtgatacaacttctctggatcatcagtttcctcatctgtgaaataaggattataatacttgcctcatagaaaagttgttgggtttaaagagacccaatgtagtatggaacacctggtatacagttagttctaagtaaatactagcctcttttctcatgagtgcaggggagcgtgcatgtatgcatgtttgctcctccagtgtatcaggggcactatctatatcacccttctcagactttggtgattttacttgcttatttgtcttccttttcatagagccaaggtatttcgtgtatttggtaaaggtccagaaataaaaagaaaaattctcagtgatggaactctgcattatcagataaagatctgttttagtaatgcaaagttgcgttttaaaatgtgaatggattttcaaaaaaattgtgaaagcatataattgaagttttaagaaaaaattttgtttaaatcttttaaaacctttttcttctccttttacaggtcatcctcatagaatttttaccaaagacaccgatttttcgaccagattagcatttactttatttatagagactttccaagtatgttgtctttccaatggtgccttgcttggtgctctcctggtggtgacataacattggttctacagaatcgtgtggtgttttttttgtttttgtttttgttttttttttaaataaccgcatgttctaagtgtgcatttttgtcaatctttgcaacagttatttcatacagatgtttaatacttaagttattgtgctcttttctgttatgtattctgattttcaaggattacttttttgtattatcaaaaaaatacatttgaacttagcataaaaagtggccagccttttttattttgtcaccaaggtacacacagtcctttatttataaattccttaacagagaaaaacacctttgtaaggctcaacttacctattccagcaagcacactttttctgtcattttttctttcttttcaaatttgatattgtcattattttaaaatagtaagttttctttaatagtcttttgggacctaacataccctttctcatacaattcctaatgctctgtttatggcagataatctgtaatgttatgaagacctatcaaaaagttttaaaagtatttctgtcttcaaaggtagtaagacaggattaaatttttattagaatagacaaatcagtgaatggtatgcatgtatctagtggttactagaactcaggatcacacaatatagtagcatcacgatctgtgtatatttttgatcaagatgataataatggccttacttgggtttttatcgtttatcaaatcttacatacaaaagagtggaagtattcctttacaaaatttctaaggaaaatatttcttccaatctatcacaattatagaatggatatatgtttctgaaaagtttttgaaagaaagcaaaagttctagaactaaaagtaagctggtatttaatatcccgttgatatttagaaaagattgttaataagaaatggaggatgcatttagtactatttttatccactagttcactttcagtacagttatgtatacttgttttgattgagagtgtgacatacatgttaaatcagattagcttgtttcttttaaatatacatatacacaaatacatataattttttctcctttttgttgtgcatatctctatgcatttttaaacttttagatttgtgaatgacctatgtgtaaatttttgtttttataaaccagaaattatacaagttttaatgtgtgtcaagaacttgttccatacaactgtggtatcgagcaataatgttaataacttttggaattatataaactatgcttaataatttgtattgagaattggtaccactatacaatacttttttcctgtattaaatcttttaaataccagtttcattaatttatatacctgtatttttaaaagtatttctttgtacttgccaaagtactgtaatcctatataaatttgaatagtcaaatgccagtatctcatgtcctatatcctgtcttggatattaggagctatcttaaaaactaggatttaagatttttttttgcttgagaattatatgttttccttgccccccaagtaacaacttgaatttgtagaacacttttcctgtgaagagttcaaagtacaaagaactcaaatacttattttatttaacttgtatctagggtgtgtcctaccaccttaaagtagtgcaattaaaa

SEQ ID NO: 111498 - DNA, 1466 bp, Homo sapiens
tgatgtgaaaattaatttgattttataactcattgatttttttaatattccaattttttgttttggaacttactgaaaggccatttgcattttgttaactaatatttacttttgttttaaaatatgtattaaggaacttccgttactatttaagtattggaaacatttttgaaagaagtgggaatttaattttatttggcagatgacattagctttttaaaccttgatagttttaaatcagaggctagtaaaaaaagattcgtatgataaaaataaaggcatatcttttttaagaaagagtactcttttgtgttcaggttaccatttagtgcttagaacatcgatagtgatgcacaccacactatactcagtcactgtcttatacctctccccttttcacagaaaaagcagctgcaaaacaaagttttctaaaaccagtcaagagtaaacttttttctcatttgtcttccagacacgaagatcgattgagaagttattagaatgggaaaacaataggttataccacaaggtgagtaccacagggagcagcttcgtactgttggggtctgaattgcacagtatggaaacagatgcttttgttgaactaaaaatatgaaaggtggacaaatgggttagtctgtgtgctgcaataaaatagagctcatttttcttcttttactttcctacttgtctagctgtgcttgcattggagactgagcaaaaggaaatgtgaaacgaataacatgatggaatatgtaagttaaagggctgttttgtgagtttctctattaaatgatcatttattttgcttctgatcttattctttccatgattattaatcagcaaaggtgtcaggagcttaatctcctgagtgcaaggattttctacggttcacagatgcatggtttcatgtgcaagactgatttataaagttatgaatgacttgaaaacaaggcttcactgtgttctgaaaaataataaattaattgccaagataaaatagcctgaacatgtgttgatggagtgtgaaattttagatgctgtataaagaataaccacaactttggttacgcagcaagtcagatatggcttttttatataatgctaatcaagtttccaagtatggaagaaaacctttcagccaagccattggagcttaagaaacctttaccctttatagattttaactgcccgtacctcagtgccctttaaagaatctcttttaaagtgttattagaatactgctttgtaaaaattaaaagtaagcaggagatgagatgttgatcatcttgtgtttacttgttaaaaaatatctaatttggcatatatatacaatgaattttagaacttactcagcatgggatttaatttactgactccatgatttacttgaacagtttttctccttttgaaaatttcagaatactctagaaaattaagaattttaattctcttttgagcttgga

SEQ ID NO: 111499 - DNA, 1600 bp, Homo sapiens
aaaattacatttcttgttgatcatcttttgcagaaagacggagaattacattggtaaagaaccgctaacctgtcccctcacccccagggtgtgagcagtgaaaaggattaaggcccactgtagggaagcttacactaaagcctgcactgccccttcccctgttctttcagctaaatagatttttagttcccatgactatcaatctggtgcttttcacaagcactaaattctcttaaagaaaattaaagatgacttatttttttagaaactggcctggaatactgaaagatggtgttttttggtactttgtttcatgttgacagatcccatacatatttttttctgatgcatgttaatttgcttcagcttgttttgaatttggagttgaaataaacatttaaaaaccaaggacaggttgttatatgattagatttgcttgtccacagttagcaagtgtagagttcgacactgttgaatcttacatttcattagaaatagctacctgacagccttgtggacataaactctttaacttttatctagatgactacaattataaagtgctttcttttaaaagcttttaagtagcttttataaatgctgaagtgtcattttttttagtatctgccaaattggtattgtatttaatcttgaaaatatattttgattttcttaactaacaataattgcatagtattaaacattctcagtagctcaaccttttttttttctatttaatttgagcttttgttgttactaacaaataatttgtggcacagtttctttccttttttttttaaatgactgctagaatctatatacttgtcaccttagtgtgctagaaatgttccactcaaatcaagggttcctttctggttttgtatgttctcacctgctcctcactgtaaatcattgagatgtcaagtgcaatgattaattaagctgcacgtgcaagtgctttttttttcacctgtcaagcaggaaagaagtcttatagcaaaattagatggtgctaattcacagcttttacttcagactgtgaagtgtgtagaaatattttatatttatatgcttattcagaatgtggcatatcagggcttgtttgttttataattcttaaatattgtaagatacaattattataccaagccctatcattaaactcctaattataaacagagaagaaattcagaattcctacttaaatattttggaattcaagatttatactttgtaattatcttttattcaaatactagtagttgatttaagttaaagtaaatatttttaagttttaaaattgtgtgtatgtatgtgtctatatatcataatgagatctattcttattatagcatgggtttaaacttctgatgaaatgatggtggtaactacatttttttctttaagtaataagtatttgcagaatgtagtattaagcttttgggtactattttatacattaatataaaacagtgggcttggaaaacttgttctgctctagttctttcatcatccacccacccccaaaatcatcagtaaaagtaaaacctcaaattgtatagtaatcttaatctattattaaaaggccctagaaagaaag

SEQ ID NO: 111500 - DNA, 1043 bp, Homo sapiens
attttaagcagattttatacaaagttatagttggacaaccaagagttgatatattgcctttgcttctgttttgcttttataaaaacaaatgaaaatcaacatcctgtctttgaaaagttatttattaggttcctactccctagcaaataagtttacatgacttctggtaaagttatttttcttctagtattagatcctttcttgaaacttgtgtatttacttttagagagattgagaatgacatgtaatgagtgcatgtcccatgcagtaaagatgggacaggaactctgaatgaaagaactgggttttctttatctagccctaggcatttaatttgtggtttcttgccccttcttcactatcttccccattataagatacagaataatgaaataggtttgacctttttgaaatcttatttcagtccctttacaaaaggggtcctgcataaaagatttctcataactagatgaatacatttactgcagttccattttaaagaatgctttggccttgaaacttaaacagattcttatgtaaattactgccattattatgaacactagtgacaatttgtttttaattaaaattaaaccgcattactaagttttcatcataaaagaggatactcataaaaatgtaaactttgagccttaaaaatgcagaggtagcactgtaaagatatgctagaatgcttagaaaatgtgttttgtcaacagctggctgacattcatttctctgtaaatatttagaacatagtattggtgtggtggtttatagaaggatttgcacctatcttctgtgacctgagtttttaatatgagatactgtatttttcaattctagggtgtccatttgctgttttttaaaatagattccagttttcttttgaaattcttcgttttttcatccagctttctactttcttttcttgaacacattaatcatagttttagagtaagttgattattcaaggccgatagccttgttagtggctaagaaaacttgcatgtcatacatatgttatttgtctcaggataata

SEQ ID NO: 111501 - DNA, 1616 bp, Homo sapiens
gtgttgcatggaatgtgctcagtagttgtgatttgaatgaattctctgttctccaagtactggtagacttctgatagataaaagcaagataggttgtttttattatgtcttttatcttcttgttatatttaccattctttgaaaatagtttaaatcttttatcaattctaaagccatggaatattttaaccatgattcaagaaaaggtcttttaggtaataggaatagatataggtatagtacacgtctacattttctttcataccatctaatgcactgacaaataggtgttcaatggaacctaagacggttcttggtagcactttgtccattcctacttttttattttttctctccctttttccttattcttcccctcctcactctttttcctgcatttttccttctcatcttattgcttgtgtaggacacctgctaaaattcacaggtattgtttgtttccaccaataacattaaaagctggaaaaaatcgctatcccacccattaaaataatatgctttgtagttactttttaagatataaagttggtagctcaaattaaatgaaccatttatatttttgtttacatactgctggttaattaacattcagccccttatcattatgcaaaagtttccatttaactgctaaaataattgttacatttcataaattgcttgttacagttattttatctcaaacttccattttatgtctaaaacttcctccatatgtgaaaatgctttctattgacttgacctttaaattaaatggtctacatttttggcaacaataacatgtaataacatattcttcttattttttaaaatagatttggactgagcaacaaatttgaatctgaattcccttcttcattaactggaaaagtgagtgtctcatttatgtactatttgtatgcctcaaaatgaaagtttttttctgagaaaattagaaaaaagtatgctcatcagtcatgttttttgacattaatattgcattgttattatttcttaaaatttttctttaggtagctcctgaagaatttaaagccagcatcaacagagttaacagttgtcttaagaagaaccttcctgttaatgtacgttggctactttgtggctgcctttgttgctgctgcacattaggttgcagtatgtggccagttatttgcctcagtaaaagagtaagttgaattatatattttaatttaaatttagaagtggacaagcaagtcttgcatttatctagtttttattttttgtattgaatgaatcacactatcctgaataaaatatgaaaataatctgatccaggagaggagtgagtcagtaaagttactatatatccaagtgctgttattaaatagccatctaaaaattatatttataattttagaagcaaggagtagtgtatggcattgtctgtatctgtacattgacagtggtgtggtatagtgatcaaggatgctggcttcagctctaccacttttctctgtgaccttaggcacgtttcctaacctctttaaaccctacttgacacaactgtaaaatgttcacctactacttgaatataaaggtaaaatgaaaatgtttggaaaactcttagctgaatatct
